US008758764B2

(12) United States Patent
Masignani et al.

(10) Patent No.: US 8,758,764 B2
(45) Date of Patent: Jun. 24, 2014

(54) PROTEINS AND NUCLEIC ACIDS FROM MENINGITIS/SEPSIS-ASSOCIATED *ESCHERICHIA COLI*

(75) Inventors: Vega Masignani, Siena (IT); Danilo Gomes Moriel, Monteriggioni (IT); Francesco Berlanda Scorza, Trento (IT); Nathalie Norais, Siena (IT); Maria Rita Fontana, Siena (IT); Mariagrazia Pizza, Siena (IT); Laura Serino, Monticiano (IT); Herve Tettelin, Gaithersburg, MD (US)

(73) Assignees: Novartis Vaccines and Diagnostics Srl, Siena (IT); J. Craig Venter Institute, Rockville, MD (US)

( * ) Notice: Subject to any disclaimer, the term of this patent is extended or adjusted under 35 U.S.C. 154(b) by 16 days.

(21) Appl. No.: 11/884,812

(22) PCT Filed: Feb. 17, 2006

(86) PCT No.: PCT/US2006/005913
§ 371 (c)(1),
(2), (4) Date: Mar. 26, 2008

(87) PCT Pub. No.: WO2006/089264
PCT Pub. Date: Aug. 24, 2006

(65) Prior Publication Data
US 2008/0193470 A1    Aug. 14, 2008

Related U.S. Application Data

(60) Provisional application No. 60/712,720, filed on Aug. 29, 2005, provisional application No. 60/654,632, filed on Feb. 18, 2005.

(51) Int. Cl.
*A61K 39/108*     (2006.01)
*C07K 14/245*     (2006.01)

(52) U.S. Cl.
USPC ............... 424/185.1; 424/257.1; 530/300; 530/350

(58) Field of Classification Search
CPC combination set(s) only.
See application file for complete search history.

(56) References Cited

U.S. PATENT DOCUMENTS

| 2003/0165870 A1 | 9/2003 | Blattner et al. |
| 2004/0123343 A1 | 6/2004 | La Rosa et al. |

FOREIGN PATENT DOCUMENTS

| EP | 1342784 A1 | 9/2003 |
| WO | WO-9822575 | 5/1998 |
| WO | WO-01/66572 A2 | 9/2001 |
| WO | WO-0216439 | 2/2002 |
| WO | WO-02/059320 | 8/2002 |
| WO | WO-02/077183 | 10/2002 |
| WO | WO-2004/005535 A2 | 1/2004 |
| WO | WO-2005/076010 | 8/2005 |

OTHER PUBLICATIONS

Houghten et al. (New Approaches to Immunization, Vaccines86, Cold Spring Harbor Laboratory, p. 21-25, 1986.*
McGuinness et al. (Lancet 337: 514-517, Mar. 1991.*
McGuinness et al. (Mol. Microbiol. 7:505-514, Feb. 1993).*
Accession No. Q46837 2002 ( or Q2M9M2 or Q46838 or Q6BF5) or Science 277:1453-1474(1997).*
EMBL accession No. AJ617685 (Created on May 11, 2004), "*Escherichia coli* pathogenicity island V, strain 536."
UniProt accession No. Q46837 (Integrated on Apr. 16, 2002). "Putative lipprotein acfD homolog."
Hughes et al. (Aug. 19, 1994). "Sequence analysis of the *Vibrio cholerae* acfD gene reveals the presence of an overlapping reading frame, orfZ, which encodes a protein that shares sequence similarity to the FliA and FliC products of *Salmonella*,", Gene 146(1): 79-82.
European Search Report mailed Dec. 23, 2008, for EP patent application No. 06748228.1, filed Feb. 17, 2006.
European Examination Report mailed Dec. 29, 2008, for EP patent application No. 06748228.1, filed Feb. 17, 2006.
International Search Report mailed Feb. 15, 2007, for International patent application No. PCT/US2006/005913, field Feb. 17, 2006.
Bernadac et al. (1998) "*Escherichia coli* tol-pal mutants form outer membrane vesicles," Journal of Bacteriology, 180(18): 4872-4878.
Wu (2002) "The relationship between outer membrane vesicles and pathogenicity" Foreign Medicine (Microbiology Section) 4:13-15.
EBI accession No. Q8FKK3, Mar. 1, 2003 (version 56, dated May 1, 2013).
EBI accession No. Q8X6G3, Mar. 1, 2002 (version 71, dated May 1, 2013).
Dean-Nystrom et al. (2002). "Vaccination of pregnant dams with intimin(O157) protects suckling piglets from *Escherichia coli* O157:H7 infection," Infect Immun. 70(5):2414-8.
Judge et al. (2004). "Plant cell-based intimin vaccine given orally to mice primed with intimin reduces time of *Escherichia coli* O157:H7 shedding in feces," Infect Immun. 72(1):168-75.
Perna et al. (2001). "Genome sequence of enterohaemorrhagic *Escherichia coli* O157:H7." Nature. 409(6819):529-33.
Welch et al. (2002). "Extensive mosaic structure revealed by the complete genome sequence of uropathogenic *Escherichia coli.*" Proc Natl Acad Sci USA. 99(26):17020-4.
Bonacorsi, S. et al. (Apr. 2000). "Identification of Regions of the *Escherichia coli* Chromosome Specific for Neonatal Meningitis-associated Strains," *Infection and Immunity* 68(4):2096-2101.
Database EMBL-EBI Accession No. AY395687, last updated Jan. 27, 2008, located at <http://www.ebi.ac.uk/cgi-bin/dbfetch?db=embl&id=AY395687&style=raw>, last visited on Jun. 19, 2008, 18 pages.

(Continued)

*Primary Examiner* — Padma V Baskar
(74) *Attorney, Agent, or Firm* — Morrison & Foerster LLP

(57) ABSTRACT

Disclosed herein are various open reading frames from a strain of *E. coli* responsible for neonatal meningitis (MNEC), and a subset of these that is of particular interest for preparing compositions for immunising against MNEC infections.

16 Claims, 4 Drawing Sheets

(56) References Cited

OTHER PUBLICATIONS

Gonzalez, M. et al. (May 1, 2001). "Adaptation of Signature-tagged Mutagenesis to *Escherichia coli* K1 and the Infant-rat Model of Invasive Disease," *FEMS Microbiology Letters* 198(2):125-128.

Henry, T. et al. (Jul. 2004). "Improved Methods for Producing Outer Membrane Vesicles in Gram-negative Bacteria," *Research in Microbiology* 155(6):437-446.

International Search Report mailed on Feb. 15, 2007, for PCT Patent Application No. PCT/US2006/005913 filed on Feb. 17, 2006, 6 pages.

Janke, B. et al. (May 15, 2001). "A Subtractive Hybridisation Analysis of Genomic Differences between the Uropathogenic *E. coli* Strain 536 and the *E. coli* K-12 Strain MG1655," *FEMS Microbiology Letters* 199(1):61-66.

Rode, C. et al. (Jan. 1999). "Type-specific Contributions to Chromosome Size Differences in *Escherichia coli*," *Infection and Immunity* 67(1):230-236.

Zhang, L. et al. (Apr. 2000). "Molecular Epidemiologic Approaches to Urinary Tract Infection Gene Discovery in Uropathogenic *Escherichi coli*," *Infection and Immunity* 68(4):2009-2015.

\* cited by examiner

— ◇ — IHE3034
— □ — DH5
▫ ○ ▫ FISIOL.

▫ ◇ ▫ OMV IHE
▫ □ ▫ OMV DH5
▫ ○ ▫ FISIOL.

PROTEINS AND NUCLEIC ACIDS FROM MENINGITIS/SEPSIS-ASSOCIATED *ESCHERICHIA COLI*

RELATED APPLICATIONS

This application claims the benefit of U.S. Provisional Application No. 60/654,632, filed Feb. 18, 2005 and U.S. Provisional Application No. 60/712,720, filed Aug. 29, 2005. The teachings of both these applications are incorporated herein in their entirety by reference.

TECHNICAL FIELD

This invention is in the field of *Escherichia coli* biology, and in particular relates to immunogens for use in immunising against extraintestinal pathogenic *E. coli* (ExPEC) strains.

BACKGROUND ART

Few microorganisms are as versatile as *E. coli*. As well as being an important member of the normal intestinal microflora of mammals, it has been widely exploited as a host in recombinant DNA technology. In addition, however, *E. coli* can also be a deadly pathogen.

*E. coli* strains have traditionally been classified as either commensal or pathogenic, and pathogenic strains are then sub-classified as intestinal or extraintestinal strains. Classification may also be based on the 'K' antigens. The best-studied 'K' antigen is 'K1', which is considered to be the major determinant of virulence among those strains of *E. coli* that cause neonatal meningitis. The K1 antigen is a homopolymer of $\alpha$-2,8-linked sialic acid, like the capsular saccharide of serogroup B meningococcus.

More recent taxonomic techniques such as multilocus enzyme electrophoresis (MLEE) classify *E. coli* into five phylogenetic groups (A, B1, B2, D & E), and these groupings do not match the traditional ones. For instance, MLEE group B1 includes both commensal and pathogenic strains, and group D includes both intestinal and extraintestinal strains.

The extraintestinal pathogenic strains (or 'ExPEC' strains [1]) of *E. coli* fall into MLEE groups B2 and D, and include both uropathogenic (UPEC) strains and meningitis/sepsis-associated (MNEC) strains. UPEC strains cause urinary tract infections (UTIs), and are a common cause of cystitis. They also cause pyelonephritis (and its complications such as sepsis) and catheter-associated infections. MNEC strains cause neonatal meningitis (0.1 cases per 1000 live births) with case fatality rates ranging from 25 to 40%, and are also responsible for around ⅙ of sepsis cases.

Most previous ExPEC vaccines have been based on cell lysates or on cellular structures. SOLCOUROVAC™ includes ten different heat-killed bacteria including six ExPEC strains, and a successful phase II clinical trial was reported in reference 2. URO-VAXOM™ is an oral tablet vaccine containing lyophilised bacterial lysates of 18 selected *E. coli* strains [3]. Baxter Vaccines developed a UTI vaccine based on pili from 6 to 10 different strains, but this product has been abandoned. MedImmune developed a product called MEDI 516 based on the FimH adhesin complex [4], but phase II clinical trials shows inadequate efficacy. Moreover, there was a risk with this vaccine that it would also affect non-pathogenic FimH$^{+ve}$ strains in the normal intestinal flora, and it was expected that it would be effective against UPEC strains only, because of its bladder-specific adherence mechanism, leaving other ExPEC strains uncontrolled.

There is thus a need for improved ExPEC vaccines, including a need to move away from crude cell lysates and towards better-defined molecules, and a need to identify further antigens that are suitable for inclusion in vaccines, particularly antigens that are prevalent among clinical ExpEC strains without also being found in commensal strains. Within the ExPEC group, there is a particular need to identify antigens suitable for immunising against MNEC strains.

One way of addressing these needs was reported in reference 5, where the inventors looked for genes present in genomes of MLEE types B2 and D but absent from MLEE types A and B1. Further comparative approaches, based on subtractive hybridisation, have been reported in references 6 & 7. Virulence genes in ExPEC strains have also been identified in reference 8. Reference 9 discloses an analysis of four pathogenicity islands in UPEC *E. coli* strain 536.

Reference 10 used the genome sequence of UPEC (O6:K2:H1) strain CFT073 [11,12] to identify sequences not present in non-pathogenic *E. coli* strains. Reference 13 discloses a comparison of the genome sequence of *E. coli* human pyelonephritis isolate 536 (O6:K15:H31), an UPEC, with sequence data for strains CFT073 (UPEC), EDL933 (enterohemorrhagic) and MG1655 (non-pathogenic laboratory strain). Genome sequences of pathogenic strains are available in the databases under accession numbers AE005174, BA000007 and NC-004431. A sequence from a non-pathogenic strain is available under accession number U00096.

It is an object of the invention to provide further antigens for use in immunisation against pathogenic *E. coli* strains, particularly against ExPEC strains, and more particularly against MNEC strains.

SUMMARY OF THE INVENTION

The inventors have identified various open reading frames from a strain of *E. coli* responsible for neonatal meningitis (MNEC), and have identified a subset of these that is of particular interest for preparing compositions for immunising against MNEC infections.

In one aspect, the present invention relates to a polypeptide comprising: (a) an amino acid sequence selected from the group consisting of SEQ ID NOs 706, 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, 1288, 1290, 1292, 1294, 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, 1820, 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, 2502, 2504, 2506, 2508, 2510, 2512, 2514, 2516, 2518, 2520, 2522, 2524, 2526, 2528, 2530, 2532, 2534, 2536, 2538, 2540, 2542, 2544, 2546, 2548, 2550, 2552, 2554, 2556, 2558, 2560, 2562, 2564, 2566, 2568, 2570, 2572, 2574, 2576, 2578, 2580, 2582, 2584, 2586, 2588, 2590, 2592, 2594, 2596, 2598, 2600, 2602, 2604, 2606, 2608, 2610, 2612, 2614, 2616, 2618, 2620, 2622, 2624, 2626, 2628, 2630, 2632, 2634, 2636, 2638, 2640, 2642, 2644, 2646, 2648, 2650, 2652, 2654, 2656, 2658, 2660, 2662, 2664, 2666, 2668, 2670, 2672, 2674, 2676, 2678, 2680, 2682, 2684, 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764, 2766, 2768, 2770, 2772, 2774, 2776, 2778, 2780, 2782, 2784, 2786, 2788, 2790, 2792, 2794, 2796, 2798, 2800, 2802, 2804, 2806, 2808, 2810, 2812, 2814, 2816, 2818, 2820, 2822, 2824, 2826, 2828, 2830, 2832, 2834, 2836, 2838, 2840, 2842, 2844, 2846, 2848, 2850, 2852, 2854, 2856, 2858, 2860, 2862, 2864, 2866, 2868, 2870, 2872, 2874, 2876, 2878, 2880, 2882, 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, 3016, 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086, 3088, 3090, 3092, 3094, 3096, 3098, 3100, 3102, 3104, 3106, 3108, 3110, 3112, 3114, 3116, 3118, 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, 3180, 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372, 3374, 3376, 3378, 3380, 3382, 3384, 3386, 3388, 3390, 3392, 3394, 3396, 3398, 3400, 3402,
3404, 3406, 3408, 3410, 3412, 3414, 3416, 3418, 3420, 3422,
3424, 3426, 3428, 3430, 3432, 3434, 3436, 3438, 3440, 3442,
3444, 3446, 3448, 3450, 3452, 3454, 3456, 3458, 3460, 3462,
3464, 3466, 3468, 3470, 3472, 3474, 3476, 3478, 3480, 3482,
3484, 3486, 3488, 3490, 3492, 3494, 3496, 3498, 3500, 3502,
3504, 3506, 3508, 3510, 3512, 3514, 3516, 3518, 3520, 3522,
3524, 3526, 3528, 3530, 3532, 3534, 3536, 3538, 3540, 3542,
3544, 3546, 3548, 3550, 3552, 3554, 3556, 3558, 3560, 3562,
3564, 3566, 3568, 3570, 3572, 3574, 3576, 3578, 3580, 3582,
3584, 3586, 3588, 3590, 3592, 3594, 3596, 3598, 3600, 3602,
3604, 3606, 3608, 3610, 3612, 3614, 3616, 3618, 3620, 3622,
3624, 3626, 3628, 3630, 3632, 3634, 3636, 3638, 3640, 3642,
3644, 3646, 3648, 3650, 3652, 3654, 3656, 3658, 3660, 3662,
3664, 3666, 3668, 3670, 3672, 3674, 3676, 3678, 3680, 3682,
3684, 3686, 3688, 3690, 3692, 3694, 3696, 3698, 3700, 3702,
3704, 3706, 3708, 3710, 3712, 3714, 3716, 3718, 3720, 3722,
3724, 3726, 3728, 3730, 3732, 3734, 3736, 3738, 3740, 3742,
3744, 3746, 3748, 3750, 3752, 3754, 3756, 3758, 3760, 3762,
3764, 3766, 3768, 3770, 3772, 3774, 3776, 3778, 3780, 3782,
3784, 3786, 3788, 3790, 3792, 3794, 3796, 3798, 3800, 3802,
3804, 3806, 3808, 3810, 3812, 3814, 3816, 3818, 3820, 3822,
3824, 3826, 3828, 3830, 3832, 3834, 3836, 3838, 3840, 3842,
3844, 3846, 3848, 3850, 3852, 3854, 3856, 3858, 3860, 3862,
3864, 3866, 3868, 3870, 3872, 3874, 3876, 3878, 3880, 3882,
3884, 3886, 3888, 3890, 3892, 3894, 3896, 3898, 3900, 3902,
3904, 3906, 3908, 3910, 3912, 3914, 3916, 3918, 3920, 3922,
3924, 3926, 3928, 3930, 3932, 3934, 3936, 3938, 3940, 3942,
3944, 3946, 3948, 3950, 3952, 3954, 3956, 3958, 3960, 3962,
3964, 3966, 3968, 3970, 3972, 3974, 3976, 3978, 3980, 3982,
3984, 3986, 3988, 3990, 3992, 3994, 3996, 3998, 4000, 4002,
4004, 4006, 4008, 4010, 4012, 4014, 4016, 4018, 4020, 4022,
4024, 4026, 4028, 4030, 4032, 4034, 4036, 4038, 4040, 4042,
4044, 4046, 4048, 4050, 4052, 4054, 4056, 4058, 4060, 4062,
4064, 4066, 4068, 4070, 4072, 4074, 4076, 4078, 4080, 4082,
4084, 4086, 4088, 4090, 4092, 4094, 4096, 4098, 4100, 4102,
4104, 4106, 4108, 4110, 4112, 4114, 4116, 4118, 4120, 4122,
4124, 4126, 4128, 4130, 4132, 4134, 4136, 4138, 4140, 4142,
4144, 4146, 4148, 4150, 4152, 4154, 4156, 4158, 4160, 4162,
4164, 4166, 4168, 4170, 4172, 4174, 4176, 4178, 4180, 4182,
4184, 4186, 4188, 4190, 4192, 4194, 4196, 4198, 4200, 4202,
4204, 4206, 4208, 4210, 4212, 4214, 4216, 4218, 4220, 4222,
4224, 4226, 4228, 4230, 4232, 4234, 4236, 4238, 4240, 4242,
4244, 4246, 4248, 4250, 4252, 4254, 4256, 4258, 4260, 4262,
4264, 4266, 4268, 4270, 4272, 4274, 4276, 4278, 4280, 4282,
4284, 4286, 4288, 4290, 4292, 4294, 4296, 4298, 4300, 4302,
4304, 4306, 4308, 4310, 4312, 4314, 4316, 4318, 4320, 4322,
4324, 4326, 4328, 4330, 4332, 4334, 4336, 4338, 4340, 4342,
4344, 4346, 4348, 4350, 4352, 4354, 4356, 4358, 4360, 4362,
4364, 4366, 4368, 4370, 4372, 4374, 4376, 4378, 4380, 4382,
4384, 4386, 4388, 4390, 4392, 4394, 4396, 4398, 4400, 4402,
4404, 4406, 4408, 4410, 4412, 4414, 4416, 4418, 4420, 4422,
4424, 4426, 4428, 4430, 4432, 4434, 4436, 4438, 4440, 4442,
4444, 4446, 4448, 4450, 4452, 4454, 4456, 4458, 4460, 4462,
4464, 4466, 4468, 4470, 4472, 4474, 4476, 4478, 4480, 4482,
4484, 4486, 4488, 4490, 4492, 4494, 4496, 4498, 4500, 4502,
4504, 4506, 4508, 4510, 4512, 4514, 4516, 4518, 4520, 4522,
4524, 4526, 4528, 4530, 4532, 4534, 4536, 4538, 4540, 4542,
4544, 4546, 4548, 4550, 4552, 4554, 4556, 4558, 4560, 4562,
4564, 4566, 4568, 4570, 4572, 4574, 4576, 4578, 4580, 4582,
4584, 4586, 4588, 4590, 4592, 4594, 4596, 4598, 4600, 4602,
4604, 4606, 4608, 4610, 4612, 4614, 4616, 4618, 4620, 4622,
4624, 4626, 4628, 4630, 4632, 4634, 4636, 4638, 4640, 4642,
4644, 4646, 4648, 4650, 4652, 4654, 4656, 4658, 4660, 4662,
4664, 4666, 4668, 4670, 4672, 4674, 4676, 4678, 4680, 4682,
4684, 4686, 4688, 4690, 4692, 4694, 4696, 4698, 4700, 4702,
4704, 4706, 4708, 4710, 4712, 4714, 4716, 4718, 4720, 4722,
4724, 4726, 4728, 4730, 4732, 4734, 4736, 4738, 4740, 4742,
4744, 4746, 4748, 4750, 4752, 4754, 4756, 4758, 4760, 4762,
4764, 4766, 4768, 4770, 4772, 4774, 4776, 4778, 4780, 4782,
4784, 4786, 4788, 4790, 4792, 4794, 4796, 4798, 4800, 4802,
4804, 4806, 4808, 4810, 4812, 4814, 4816, 4818, 4820, 4822,
4824, 4826, 4828, 4830, 4832, 4834, 4836, 4838, 4840, 4842,
4844, 4846, 4848, 4850, 4852, 4854, 4856, 4858, 4860, 4862,
4864, 4866, 4868, 4870, 4872, 4874, 4876, 4878, 4880, 4882,
4884, 4886, 4888, 4890, 4892, 4894, 4896, 4898, 4900, 4902,
4904, 4906, 4908, 4910, 4912, 4914, 4916, 4918, 4920, 4922,
4924, 4926, 4928, 4930, 4932, 4934, 4936, 4938, 4940, 4942,
4944, 4946, 4948, 4950, 4952, 4954, 4956, 4958, 4960, 4962,
4964, 4966, 4968, 4970, 4972, 4974, 4976, 4978, 4980, 4982,
4984, 4986, 4988, 4990, 4992, 4994, 4996, 4998, 5000, 5002,
5004, 5006, 5008, 5010, 5012, 5014, 5016, 5018, 5020, 5022,
5024, 5026, 5028, 5030, 5032, 5034, 5036, 5038, 5040, 5042,
5044, 5046, 5048, 5050, 5052, 5054, 5056, 5058, 5060, 5062,
5064, 5066, 5068, 5070, 5072, 5074, 5076, 5078, 5080, 5082,
5084, 5086, 5088, 5090, 5092, 5094, 5096, 5098, 5100, 5102,
5104, 5106, 5108, 5110, 5112, 5114, 5116, 5118, 5120, 5122,
5124, 5126, 5128, 5130, 5132, 5134, 5136, 5138, 5140, 5142,
5144, 5146, 5148, 5150, 5152, 5154, 5156, 5158, 5160, 5162,
5164, 5166, 5168, 5170, 5172, 5174, 5176, 5178, 5180, 5182,
5184, 5186, 5188, 5190, 5192, 5194, 5196, 5198, 5200, 5202,
5204, 5206, 5208, 5210, 5212, 5214, 5216, 5218, 5220, 5222,
5224, 5226, 5228, 5230, 5232, 5234, 5236, 5238, 5240, 5242,
5244, 5246, 5248, 5250, 5252, 5254, 5256, 5258, 5260, 5262,
5264, 5266, 5268, 5270, 5272, 5274, 5276, 5278, 5280, 5282,
5284, 5286, 5288, 5290, 5292, 5294, 5296, 5298, 5300, 5302,
5304, 5306, 5308, 5310, 5312, 5314, 5316, 5318, 5320, 5322,
5324, 5326, 5328, 5330, 5332, 5334, 5336, 5338, 5340, 5342,
5344, 5346, 5348, 5350, 5352, 5354, 5356, 5358, 5360, 5362,
5364, 5366, 5368, 5370, 5372, 5374, 5376, 5378, 5380, 5382,
5384, 5386, 5388, 5390, 5392, 5394, 5396, 5398, 5400, 5402,
5404, 5406, 5408, 5410, 5412, 5414, 5416, 5418, 5420, 5422,
5424, 5426, 5428, 5430, 5432, 5434, 5436, 5438, 5440, 5442,
5444, 5446, 5448, 5450, 5452, 5454, 5456, 5458, 5460, 5462,
5464, 5466, 5468, 5470, 5472, 5474, 5476, 5478, 5480, 5482,
5484, 5486, 5488, 5490, 5492, 5494, 5496, 5498, 5500, 5502,
5504, 5506, 5508, 5510, 5512, 5514, 5516, 5518, 5520, 5522,
5524, 5526, 5528, 5530, 5532, 5534, 5536, 5538, 5540, 5542,
5544, 5546, 5548, 5550, 5552, 5554, 5556, 5558, 5560, 5562,
5564, 5566, 5568, 5570, 5572, 5574, 5576, 5578, 5580, 5582,
5584, 5586, 5588, 5590, 5592, 5594, 5596, 5598, 5600, 5602,
5604, 5606, 5608, 5610, 5612, 5614, 5616, 5618, 5620, 5622,
5624, 5626, 5628, 5630, 5632, 5634, 5636, 5638, 5640, 5642,
5644, 5646, 5648, 5650, 5652, 5654, 5656, 5658, 5660, 5662,
5664, 5666, 5668, 5670, 5672, 5674, 5676, 5678, 5680, 5682,
5684, 5686, 5688, 5690, 5692, 5694, 5696, 5698, 5700, 5702,
5704, 5706, 5708, 5710, 5712, 5714, 5716, 5718, 5720, 5722,
5724, 5726, 5728, 5730, 5732, 5734, 5736, 5738, 5740, 5742,
5744, 5746, 5748, 5750, 5752, 5754, 5756, 5758, 5760, 5762,
5764, 5766, 5768, 5770, 5772, 5774, 5776, 5778, 5780, 5782,
5784, 5786, 5788, 5790, 5792, 5794, 5796, 5798, 5800, 5802,
5804, 5806, 5808, 5810, 5812, 5814, 5816, 5818, 5820, 5822,
5824, 5826, 5828, 5830, 5832, 5834, 5836, 5838, 5840, 5842,
5844, 5846, 5848, 5850, 5852, 5854, 5856, 5858, 5860, 5862,
5864, 5866, 5868, 5870, 5872, 5874, 5876, 5878, 5880, 5882,
5884, 5886, 5888, 5890, 5892, 5894, 5896, 5898, 5900, 5902,
5904, 5906, 5908, 5910, 5912, 5914, 5916, 5918, 5920, 5922,
5924, 5926, 5928, 5930, 5932, 5934, 5936, 5938, 5940, 5942,
5944, 5946, 5948, 5950, 5952, 5954, 5956, 5958, 5960, 5962,
5964, 5966, 5968, 5970, 5972, 5974, 5976, 5978, 5980, 5982,
5984, 5986, 5988, 5990, 5992, 5994, 5996, 5998, 6000, 6002,
6004, 6006, 6008, 6010, 6012, 6014, 6016, 6018, 6020, 6022,
6024, 6026, 6028, 6030, 6032, 6034, 6036, 6038, 6040, 6042,
6044, 6046, 6048, 6050, 6052, 6054, 6056, 6058, 6060, 6062, 6064, 6066, 6068, 6070, 6072, 6074, 6076, 6078, 6080, 6082,
6084, 6086, 6088, 6090, 6092, 6094, 6096, 6098, 6100, 6102,
6104, 6106, 6108, 6110, 6112, 6114, 6116, 6118, 6120, 6122,
6124, 6126, 6128, 6130, 6132, 6134, 6136, 6138, 6140, 6142,
6144, 6146, 6148, 6150, 6152, 6154, 6156, 6158, 6160, 6162,
6164, 6166, 6168, 6170, 6172, 6174, 6176, 6178, 6180, 6182,
6184, 6186, 6188, 6190, 6192, 6194, 6196, 6198, 6200, 6202,
6204, 6206, 6208, 6210, 6212, 6214, 6216, 6218, 6220, 6222,
6224, 6226, 6228, 6230, 6232, 6234, 6236, 6238, 6240, 6242,
6244, 6246, 6248, 6250, 6252, 6254, 6256, 6258, 6260, 6262,
6264, 6266, 6268, 6270, 6272, 6274, 6276, 6278, 6280, 6282,
6284, 6286, 6288, 6290, 6292, 6294, 6296, 6298, 6300, 6302,
6304, 6306, 6308, 6310, 6312, 6314, 6316, 6318, 6320, 6322,
6324, 6326, 6328, 6330, 6332, 6334, 6336, 6338, 6340, 6342,
6344, 6346, 6348, 6350, 6352, 6354, 6356, 6358, 6360, 6362,
6364, 6366, 6368, 6370, 6372, 6374, 6376, 6378, 6380, 6382,
6384, 6386, 6388, 6390, 6392, 6394, 6396, 6398, 6400, 6402,
6404, 6406, 6408, 6410, 6412, 6414, 6416, 6418, 6420, 6422,
6424, 6426, 6428, 6430, 6432, 6434, 6436, 6438, 6440, 6442,
6444, 6446, 6448, 6450, 6452, 6454, 6456, 6458, 6460, 6462,
6464, 6466, 6468, 6470, 6472, 6474, 6476, 6478, 6480, 6482,
6484, 6486, 6488, 6490, 6492, 6494, 6496, 6498, 6500, 6502,
6504, 6506, 6508, 6510, 6512, 6514, 6516, 6518, 6520, 6522,
6524, 6526, 6528, 6530, 6532, 6534, 6536, 6538, 6540, 6542,
6544, 6546, 6548, 6550, 6552, 6554, 6556, 6558, 6560, 6562,
6564, 6566, 6568, 6570, 6572, 6574, 6576, 6578, 6580, 6582,
6584, 6586, 6588, 6590, 6592, 6594, 6596, 6598, 6600, 6602,
6604, 6606, 6608, 6610, 6612, 6614, 6616, 6618, 6620, 6622,
6624, 6626, 6628, 6630, 6632, 6634, 6636, 6638, 6640, 6642,
6644, 6646, 6648, 6650, 6652, 6654, 6656, 6658, 6660, 6662,
6664, 6666, 6668, 6670, 6672, 6674, 6676, 6678, 6680, 6682,
6684, 6686, 6688, 6690, 6692, 6694, 6696, 6698, 6700, 6702,
6704, 6706, 6708, 6710, 6712, 6714, 6716, 6718, 6720, 6722,
6724, 6726, 6728, 6730, 6732, 6734, 6736, 6738, 6740, 6742,
6744, 6746, 6748, 6750, 6752, 6754, 6756, 6758, 6760, 6762,
6764, 6766, 6768, 6770, 6772, 6774, 6776, 6778, 6780, 6782,
6784, 6786, 6788, 6790, 6792, 6794, 6796, 6798, 6800, 6802,
6804, 6806, 6808, 6810, 6812, 6814, 6816, 6818, 6820, 6822,
6824, 6826, 6828, 6830, 6832, 6834, 6836, 6838, 6840, 6842,
6844, 6846, 6848, 6850, 6852, 6854, 6856, 6858, 6860, 6862,
6864, 6866, 6868, 6870, 6872, 6874, 6876, 6878, 6880, 6882,
6884, 6886, 6888, 6890, 6892, 6894, 6896, 6898, 6900, 6902,
6904, 6906, 6908, 6910, 6912, 6914, 6916, 6918, 6920, 6922,
6924, 6926, 6928, 6930, 6932, 6934, 6936, 6938, 6940, 6942,
6944, 6946, 6948, 6950, 6952, 6954, 6956, 6958, 6960, 6962,
6964, 6966, 6968, 6970, 6972, 6974, 6976, 6978, 6980, 6982,
6984, 6986, 6988, 6990, 6992, 6994, 6996, 6998, 7000, 7002,
7004, 7006, 7008, 7010, 7012, 7014, 7016, 7018, 7020, 7022,
7024, 7026, 7028, 7030, 7032, 7034, 7036, 7038, 7040, 7042,
7044, 7046, 7048, 7050, 7052, 7054, 7056, 7058, 7060, 7062,
7064, 7066, 7068, 7070, 7072, 7074, 7076, 7078, 7080, 7082,
7084, 7086, 7088, 7090, 7092, 7094, 7096, 7098, 7100, 7102,
7104, 7106, 7108, 7110, 7112, 7114, 7116, 7118, 7120, 7122,
7124, 7126, 7128, 7130, 7132, 7134, 7136, 7138, 7140, 7142,
7144, 7146, 7148, 7150, 7152, 7154, 7156, 7158, 7160, 7162,
7164, 7166, 7168, 7170, 7172, 7174, 7176, 7178, 7180, 7182,
7184, 7186, 7188, 7190, 7192, 7194, 7196, 7198, 7200, 7202,
7204, 7206, 7208, 7210, 7212, 7214, 7216, 7218, 7220, 7222,
7224, 7226, 7228, 7230, 7232, 7234, 7236, 7238, 7240, 7242,
7244, 7246, 7248, 7250, 7252, 7254, 7256, 7258, 7260, 7262,
7264, 7266, 7268, 7270, 7272, 7274, 7276, 7278, 7280, 7282,
7284, 7286, 7288, 7290, 7292, 7294, 7296, 7298, 7300, 7302,
7304, 7306, 7308, 7310, 7312, 7314, 7316, 7318, 7320, 7322,
7324, 7326, 7328, 7330, 7332, 7334, 7336, 7338, 7340, 7342,
7344, 7346, 7348, 7350, 7352, 7354, 7356, 7358, 7360, 7362,
7364, 7366, 7368, 7370, 7372, 7374, 7376, 7378, 7380, 7382,
7384, 7386, 7388, 7390, 7392, 7394, 7396, 7398, 7400, 7402,
7404, 7406, 7408, 7410, 7412, 7414, 7416, 7418, 7420, 7422,
7424, 7426, 7428, 7430, 7432, 7434, 7436, 7438, 7440, 7442,
7444, 7446, 7448, 7450, 7452, 7454, 7456, 7458, 7460, 7462,
7464, 7466, 7468, 7470, 7472, 7474, 7476, 7478, 7480, 7482,
7484, 7486, 7488, 7490, 7492, 7494, 7496, 7498, 7500, 7502,
7504, 7506, 7508, 7510, 7512, 7514, 7516, 7518, 7520, 7522,
7524, 7526, 7528, 7530, 7532, 7534, 7536, 7538, 7540, 7542,
7544, 7546, 7548, 7550, 7552, 7554, 7556, 7558, 7560, 7562,
7564, 7566, 7568, 7570, 7572, 7574, 7576, 7578, 7580, 7582,
7584, 7586, 7588, 7590, 7592, 7594, 7596, 7598, 7600, 7602,
7604, 7606, 7608, 7610, 7612, 7614, 7616, 7618, 7620, 7622,
7624, 7626, 7628, 7630, 7632, 7634, 7636, 7638, 7640, 7642,
7644, 7646, 7648, 7650, 7652, 7654, 7656, 7658, 7660, 7662,
7664, 7666, 7668, 7670, 7672, 7674, 7676, 7678, 7680, 7682,
7684, 7686, 7688, 7690, 7692, 7694, 7696, 7698, 7700, 7702,
7704, 7706, 7708, 7710, 7712, 7714, 7716, 7718, 7720, 7722,
7724, 7726, 7728, 7730, 7732, 7734, 7736, 7738, 7740, 7742,
7744, 7746, 7748, 7750, 7752, 7754, 7756, 7758, 7760, 7762,
7764, 7766, 7768, 7770, 7772, 7774, 7776, 7778, 7780, 7782,
7784, 7786, 7788, 7790, 7792, 7794, 7796, 7798, 7800, 7802,
7804, 7806, 7808, 7810, 7812, 7814, 7816, 7818, 7820, 7822,
7824, 7826, 7828, 7830, 7832, 7834, 7836, 7838, 7840, 7842,
7844, 7846, 7848, 7850, 7852, 7854, 7856, 7858, 7860, 7862,
7864, 7866, 7868, 7870, 7872, 7874, 7876, 7878, 7880, 7882,
7884, 7886, 7888, 7890, 7892, 7894, 7896, 7898, 7900, 7902,
7904, 7906, 7908, 7910, 7912, 7914, 7916, 7918, 7920, 7922,
7924, 7926, 7928, 7930, 7932, 7934, 7936, 7938, 7940, 7942,
7944, 7946, 7948, 7950, 7952, 7954, 7956, 7958, 7960, 7962,
7964, 7966, 7968, 7970, 7972, 7974, 7976, 7978, 7980, 7982,
7984, 7986, 7988, 7990, 7992, 7994, 7996, 7998, 8000, 8002,
8004, 8006, 8008, 8010, 8012, 8014, 8016, 8018, 8020, 8022,
8024, 8026, 8028, 8030, 8032, 8034, 8036, 8038, 8040, 8042,
8044, 8046, 8048, 8050, 8052, 8054, 8056, 8058, 8060, 8062,
8064, 8066, 8068, 8070, 8072, 8074, 8076, 8078, 8080, 8082,
8084, 8086, 8088, 8090, 8092, 8094, 8096, 8098, 8100, 8102,
8104, 8106, 8108, 8110, 8112, 8114, 8116, 8118, 8120, 8122,
8124, 8126, 8128, 8130, 8132, 8134, 8136, 8138, 8140, 8142,
8144, 8146, 8148, 8150, 8152, 8154, 8156, 8158, 8160, 8162,
8164, 8166, 8168, 8170, 8172, 8174, 8176, 8178, 8180, 8182,
8184, 8186, 8188, 8190, 8192, 8194, 8196, 8198, 8200, 8202,
8204, 8206, 8208, 8210, 8212, 8214, 8216, 8218, 8220, 8222,
8224, 8226, 8228, 8230, 8232, 8234, 8236, 8238, 8240, 8242,
8244, 8246, 8248, 8250, 8252, 8254, 8256, 8258, 8260, 8262,
8264, 8266, 8268, 8270, 8272, 8274, 8276, 8278, 8280, 8282,
8284, 8286, 8288, 8290, 8292, 8294, 8296, 8298, 8300, 8302,
8304, 8306, 8308, 8310, 8312, 8314, 8316, 8318, 8320, 8322,
8324, 8326, 8328, 8330, 8332, 8334, 8336, 8338, 8340, 8342,
8344, 8346, 8348, 8350, 8352, 8354, 8356, 8358, 8360, 8362,
8364, 8366, 8368, 8370, 8372, 8374, 8376, 8378, 8380, 8382,
8384, 8386, 8388, 8390, 8392, 8394, 8396, 8398, 8400, 8402,
8404, 8406, 8408, 8410, 8412, 8414, 8416, 8418, 8420, 8422,
8424, 8426, 8428, 8430, 8432, 8434, 8436, 8438, 8440, 8442,
8444, 8446, 8448, 8450, 8452, 8454, 8456, 8458, 8460, 8462,
8464, 8466, 8468, 8470, 8472, 8474, 8476, 8478, 8480, 8482,
8484, 8486, 8488, 8490, 8492, 8494, 8496, 8498, 8500, 8502,
8504, 8506, 8508, 8510, 8512, 8514, 8516, 8518, 8520, 8522,
8524, 8526, 8528, 8530, 8532, 8534, 8536, 8538, 8540, 8542,
8544, 8546, 8548, 8550, 8552, 8554, 8556, 8558, 8560, 8562,
8564, 8566, 8568, 8570, 8572, 8574, 8576, 8578, 8580, 8582,
8584, 8586, 8588, 8590, 8592, 8594, 8596, 8598, 8600, 8602,
8604, 8606, 8608, 8610, 8612, 8614, 8616, 8618, 8620, 8622,
8624, 8626, 8628, 8630, 8632, 8634, 8636, 8638, 8640, 8642,
8644, 8646, 8648, 8650, 8652, 8654, 8656, 8658, 8660, 8662,
8664, 8666, 8668, 8670, 8672, 8674, 8676, 8678, 8680, 8682,
8684, 8686, 8688, 8690, 8692, 8694, 8696, 8698, 8700, 8702,
8704, 8706, 8708, 8710, 8712, 8714, 8716, 8718, 8720, 8722,
8724, 8726, 8728, 8730, 8732, 8734, 8736, 8738, 8740, 8742, 8744, 8746, 8748, 8750, 8752, 8754, 8756, 8758, 8760, 8762, 8764, 8766, 8768, 8770, 8772, 8774, 8776, 8778, 8780, 8782, 8784, 8786, 8788, 8790, 8792, 8794, 8796, 8798, 8800, 8802, 8804, 8806, 8808, 8810, 8812, 8814, 8816, 8818, 8820, 8822, 8824, 8826, 8828, 8830, 8832, 8834, 8836, 8838, 8840, 8842, 8844, 8846, 8848, 8850, 8852, 8854, 8856, 8858, 8860, 8862, 8864, 8866, 8868, 8870, 8872, 8874, 8876, 8878, 8880, 8882, 8884, 8886, 8888, 8890, 8892, 8894, 8896, 8898, 8900, 8902, 8904, 8906, 8908, 8910, 8912, 8914, 8916, 8918, 8920, 8922, 8924, 8926, 8928, 8930, 8932, 8934, 8936, 8938, 8940, 8942, 8944, 8946, 8988, 8950, 8952, 8954, 8956, 8958, 8960, 8962, 8964, 8966, 8968, 8970, 8972, 8974, 8976, 8978, 8980, 8982, 8984, 8986, 8988, 8990, 8992, 8994, 8996, 8998, 9000, 9002, 9004, 9006, 9008, 9010, 9012, 9014, 9016, 9018, 9020, 9022, 9024, 9026, 9028, 9030, 9032, 9034, 9036, 9038, 9040, 9042, 9044, 9046, 9048, 9050, 9052, 9054, 9056, 9058, 9060, 9062, 9064, 9066, 9068, 9070, 9072, 9074, 9076, 9078, 9080, 9082, 9084, 9086, 9088, 9090, 9092, 9094, 9096, 9098, 9100, 9102, 9104, 9106, 9108, 9110, 9112, 9114, 9116, 9118, 9120, 9122, 9124, 9126, 9128, 9130, 9132, 9134, 9136, 9138, 9140, 9142, 9144, 9146, 9148, 9150, 9152, 9154, 9156, 9158, 9160, 9162, 9164, 9166, 9168, 9170, 9172, 9174, 9176, 9178, 9180, 9182, 9184, 9186, 9188, 9190, 9192, 9194, 9196, 9198, 9200, 9202, 9204, 9206, 9208, 9210, 9212, 9214, 9216, 9218, 9220, 9222, 9224, 9226, 9228, 9230, 9232, 9234, 9236, 9238, 9240, 9242, 9244, 9246, 9248, 9250, 9252, 9254, 9256, 9258, 9260, 9262, 9264, 9266, 9268, 9270, 9272, 9274, 9276, 9278, 9280, 9282, 9284, 9286, 9288, 9290, 9292, 9294, 9296, 9298, 9300, 9302, 9304, 9306, 9308, 9310, 9312, 9314, 9316, 9318, 9320, 9322, 9324, 9326, 9328, 9330, 9332, 9334, 9336, 9338, 9340, 9342, 9344, 9346, 9348, 9350, 9352, 9354, 9356, 9358, 9360, 9362, 9364, 9366, 9368, 9370, 9372, 9374, 9376, 9378, 9380, 9382, 9384, 9386, 9388, 9390, 9392, 9394, 9396, 9398, 9400, 9402, 9404, 9406, 9408, 9410, 9412, 9414, 9416, 9418, 9420, 9422, 9424, 9426, 9428, 9430, 9432, 9434, 9436, 9438, 9440, 9442, 9444, 9446, 9448, 9450, 9452, 9454, 9456, 9458, 9460, 9462, 9464, 9466, 9468, 9470, 9472, 9474, 9476, 9478, 9480, 9482, 9484, 9486, 9488, 9490, 9492, 9494, 9496, 9498, 9500, 9502, 9504, 9506, 9508, 9510, 9512, 9514, 9516, 9518, 9520, 9522, 9524, 9526, 9528, 9530, 9532, 9534, 9536, 9538, 9540, 9542, 9544, 9546, 9548, 9550, 9552, 9554, 9556, 9558, 9560, 9562, 9564, 9566, 9568, 9570, 9572, 9574, 9576, 9578, 9580, 9582, 9584, 9586, 9588, 9590, 9592, 9594, 9596, 9598, 9600, 9602, 9604, 9606, 9608, 9610, 9612, 9614, 9616, 9618, 9620, 9622, 9624, 9626, 9628, 9630, 9632, 9634, 9636, 9638, 9640, 9642, 9644, 9646, 9648, 9650, 9652, 9654, 9656, 9658, 9660, 9662, 9664, 9666, 9668, 9670, 9672, 9674, 9676, 9678, 9680, 9682, 9684, 9686, 9688, 9690, 9692, 9694, 9696, 9698, 9700, 9702, 9704, 9706, 9708, 9710, 9712, 9714, 9716, 9718, 9720, 9722, 9724, 9726, 9728, 9730, 9732, 9734, 9736, 9738, 9740, 9742, 9744, 9746, 9748, 9750, 9752, 9754, 9756, 9758, 9760, 9762, 9764, 9766, 9768, 9770, 9772, 9774, 9776, 9778, 9780, 9782, 9784, 9786, 9788, 9790, 9792, 9794, 9796, 9798, 9800, 9802, 9804, 9806, 9808, 9810, 9812, 9814, 9816, 9818, 9820, 9822, 9824, 9826, 9828, 9830, 9832, 9834, 9836, 9838, 9840, 9842, 9844, 9846, 9848, 9850, 9852, 9854, 9856, 9858, 9860, 9862, 9864, 9866, 9868, 9870, 9872, 9874, 9876, 9878, 9880, 9882, 9884, 9886, 9888, 9890, 9892, 9894, 9896, 9898, 9900, 9902, 9904, 9906, 9908, 9910, 9912, 9914, 9916, 9918, 9920, 9922, 9924, 9926, 9928, 9930, 9932, 9934, 9936, 9938, 9940, 9942, 9944, 9946, 9948, 9950, 9952, 9954, 9956, 9958, 9960, 9962, 9964, 9966, 9968, 9970, 9972, 9974, 9976, 9978, 9980, 9982, 9984, 9986, 9988, 9990; (b) an amino acid sequence having at least 80% sequence identity to an amino acid sequence of (a); (c) an amino acid sequence which is a fragment of at least 10 consecutive amino acids from an amino acid sequence of (a); or (d) an amino acid sequence having at least 80% sequence identity to an amino acid sequence of (a) and including a fragment of at least 10 consecutive amino acids from an amino acid sequence of (a). In a particular embodiment, the polypeptides of this aspect of the invention comprise a fragment which comprises at least one B-cell epitope of (a).

In a second aspect, the invention relates to a polypeptide comprising: (a) an amino acid sequence selected from the group consisting of SEQ ID NOs 512, 2454, 2456, 2678, 2692, 4596, 4748, 7004, 7052, 8168, 4628 and 5700; (b) an amino acid sequence having at least 80% sequence identity to an amino acid sequence of (a); (c) an amino acid sequence which is a fragment of at least 10 consecutive amino acids from an amino acid sequence of (a); or (d) an amino acid sequence having at least 80% sequence identity to an amino acid sequence of (a) and including a fragment of at least 10 consecutive amino acids from an amino acid sequence of (a). In a particular embodiment, the polypeptides of this aspect of the invention comprise a fragment which comprises at least one B-cell epitope of (a).

In another aspect, the invention relates to a polypeptide comprising: (a) an amino acid sequence selected from the group consisting of SEQ ID NOs 8564, 2728, 9872, 4672, 5680, 534, 3222, 3226 and 7004; (b) an amino acid sequence having at least 80% sequence identity to an amino acid sequence of (a); (c) an amino acid sequence which is a fragment of at least 10 consecutive amino acids from an amino acid sequence of (a); or (d) an amino acid sequence having at least 80% sequence identity to an amino acid sequence of (a) and including a fragment of at least 10 consecutive amino acids from an amino acid sequence of (a). In a particular embodiment, the polypeptides of this aspect of the invention comprise a fragment which comprises at least one B-cell epitope of (a).

The present invention also relates to a nucleic acid comprising: (a) a nucleotide sequence selected from the group consisting of SEQ ID NOs 705, 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295, 1297, 1299, 1301, 1303, 1305, 1307, 1309, 1311, 1313, 1315, 1317, 1319, 1321, 1323, 1325, 1327, 1329, 1331, 1333, 1335, 1337, 1339, 1341, 1343, 1345, 1347, 1349, 1351, 1353, 1355, 1357, 1359, 1361, 1363, 1365, 1367, 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1629, 1631, 1633, 1635, 1637, 1639, 1641, 1643, 1645, 1647, 1649, 1651, 1653, 1655, 1657, 1659, 1661, 1663, 1665, 1667, 1669, 1671, 1673, 1675, 1677, 1679, 1681, 1683, 1685, 1687, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733, 1735, 1737, 1739, 1741, 1743, 1745, 1747, 1749, 1751, 1753, 1755, 1757, 1759, 1761, 1763, 1765, 1767, 1769, 1771, 1773, 1775, 1777, 1779, 1781, 1783, 1785, 1787, 1789, 1791, 1793, 1795, 1797, 1799, 1801, 1803, 1805, 1807, 1809, 1811, 1813, 1815, 1817, 1819, 1821, 1823, 1825, 1827, 1829, 1831, 1833, 1835, 1837, 1839, 1841, 1843, 1845, 1847, 1849, 1851, 1853, 1855, 1857, 1859, 1861, 1863, 1865, 1867, 1869, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, 2135, 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2183, 2185, 2187, 2189, 2191, 2193, 2195, 2197, 2199, 2201, 2203, 2205, 2207, 2209, 2211, 2213, 2215, 2217, 2219, 2221, 2223, 2225, 2227, 2229, 2231, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, 2357, 2359, 2361, 2363, 2365, 2367, 2369, 2371, 2373, 2375, 2377, 2379, 2381, 2383, 2385, 2387, 2389, 2391, 2393, 2395, 2397, 2399, 2401, 2403, 2405, 2407, 2409, 2411, 2413, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2499, 2501, 2503, 2505, 2507, 2509, 2511, 2513, 2515, 2517, 2519, 2521, 2523, 2525, 2527, 2529, 2531, 2533, 2535, 2537, 2539, 2541, 2543, 2545, 2547, 2549, 2551, 2553, 2555, 2557, 2559, 2561, 2563, 2565, 2567, 2569, 2571, 2573, 2575, 2577, 2579, 2581, 2583, 2585, 2587, 2589, 2591, 2593, 2595, 2597, 2599, 2601, 2603, 2605, 2607, 2609, 2611, 2613, 2615, 2617, 2619, 2621, 2623, 2625, 2627, 2629, 2631, 2633, 2635, 2637, 2639, 2641, 2643, 2645, 2647, 2649, 2651, 2653, 2655, 2657, 2659, 2661, 2663, 2665, 2667, 2669, 2671, 2673, 2675, 2677, 2679, 2681, 2683, 2685, 2687, 2689, 2691, 2693, 2695, 2697, 2699, 2701, 2703, 2705, 2707, 2709, 2711, 2713, 2715, 2717, 2719, 2721, 2723, 2725, 2727, 2729, 2731, 2733, 2735, 2737, 2739, 2741, 2743, 2745, 2747, 2749, 2751, 2753, 2755, 2757, 2759, 2761, 2763, 2765, 2767, 2769, 2771, 2773, 2775, 2777, 2779, 2781, 2783, 2785, 2787, 2789, 2791, 2793, 2795, 2797, 2799, 2801, 2803, 2805, 2807, 2809, 2811, 2813, 2815, 2817, 2819, 2821, 2823, 2825, 2827, 2829, 2831, 2833, 2835, 2837, 2839, 2841, 2843, 2845, 2847, 2849, 2851, 2853, 2855, 2857, 2859, 2861, 2863, 2865, 2867, 2869, 2871, 2873, 2875, 2877, 2879, 2881, 2883, 2885, 2887, 2889, 2891, 2893, 2895, 2897, 2899, 2901, 2903, 2905, 2907, 2909, 2911, 2913, 2915, 2917, 2919, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, 2969, 2971, 2973, 2975, 2977, 2979, 2981, 2983, 2985, 2987, 2989, 2991, 2993, 2995, 2997, 2999, 3001, 3003, 3005, 3007, 3009, 3011, 3013, 3015, 3017, 3019, 3021, 3023, 3025, 3027, 3029, 3031, 3033, 3035, 3037, 3039, 3041, 3043, 3045, 3047, 3049, 3051, 3053, 3055, 3057, 3059, 3061, 3063, 3065, 3067, 3069, 3071, 3073, 3075, 3077, 3079, 3081, 3083, 3085, 3087, 3089, 3091, 3093, 3095, 3097, 3099, 3101, 3103, 3105, 3107, 3109, 3111, 3113, 3115, 3117, 3119, 3121, 3123, 3125, 3127, 3129, 3131, 3133, 3135, 3137, 3139, 3141, 3143, 3145, 3147, 3149, 3151, 3153, 3155, 3157, 3159, 3161, 3163, 3165, 3167, 3169, 3171, 3173, 3175, 3177, 3179, 3181, 3183, 3185, 3187, 3189, 3191, 3193, 3195, 3197, 3199, 3201, 3203, 3205, 3207, 3209, 3211, 3213, 3215, 3217, 3219, 3221, 3223, 3225, 3227, 3229, 3231, 3233, 3235, 3237, 3239, 3241, 3243, 3245, 3247, 3249, 3251, 3253, 3255, 3257, 3259, 3261, 3263, 3265, 3267, 3269, 3271, 3273, 3275, 3277, 3279, 3281, 3283, 3285, 3287, 3289, 3291, 3293, 3295, 3297, 3299, 3301, 3303, 3305, 3307, 3309, 3311, 3313, 3315, 3317, 3319, 3321, 3323, 3325, 3327, 3329, 3331, 3333, 3335, 3337, 3339, 3341, 3343, 3345, 3347, 3349, 3351, 3353, 3355, 3357, 3359, 3361, 3363, 3365, 3367, 3369, 3371, 3373, 3375, 3377, 3379, 3381, 3383, 3385, 3387, 3389, 3391, 3393, 3395, 3397, 3399, 3401, 3403, 3405, 3407, 3409, 3411, 3413, 3415, 3417, 3419, 3421, 3423, 3425, 3427, 3429, 3431, 3433, 3435, 3437, 3439, 3441, 3443, 3445, 3447, 3449, 3451, 3453, 3455, 3457, 3459, 3461, 3463, 3465, 3467, 3469, 3471, 3473, 3475, 3477, 3479, 3481, 3483, 3485, 3487, 3489, 3491, 3493, 3495, 3497, 3499, 3501, 3503, 3505, 3507, 3509, 3511, 3513, 3515, 3517, 3519, 3521, 3523, 3525, 3527, 3529, 3531, 3533, 3535, 3537, 3539, 3541, 3543, 3545, 3547, 3549, 3551, 3553, 3555, 3557, 3559, 3561, 3563, 3565, 3567, 3569, 3571, 3573, 3575, 3577, 3579, 3581, 3583, 3585, 3587, 3589, 3591, 3593, 3595, 3597, 3599, 3601, 3603, 3605, 3607, 3609, 3611, 3613, 3615, 3617, 3619, 3621, 3623, 3625, 3627, 3629, 3631, 3633, 3635, 3637, 3639, 3641, 3643, 3645, 3647, 3649, 3651, 3653, 3655, 3657, 3659, 3661, 3663, 3665, 3667, 3669, 3671, 3673, 3675, 3677, 3679, 3681, 3683, 3685, 3687, 3689, 3691, 3693, 3695, 3697, 3699, 3701, 3703, 3705, 3707, 3709, 3711, 3713, 3715, 3717, 3719, 3721, 3723, 3725, 3727, 3729, 3731, 3733, 3735, 3737, 3739, 3741, 3743, 3745, 3747, 3749, 3751, 3753, 3755, 3757, 3759, 3761, 3763, 3765, 3767, 3769, 3771, 3773, 3775, 3777, 3779, 3781, 3783, 3785, 3787, 3789, 3791, 3793, 3795, 3797, 3799, 3801, 3803, 3805, 3807, 3809, 3811, 3813, 3815, 3817, 3819, 3821, 3823, 3825, 3827, 3829, 3831, 3833, 3835, 3837, 3839, 3841, 3843, 3845, 3847, 3849, 3851, 3853, 3855, 3857, 3859, 3861, 3863, 3865, 3867, 3869, 3871, 3873, 3875, 3877, 3879, 3881, 3883, 3885, 3887, 3889, 3891, 3893, 3895, 3897, 3899, 3901, 3903, 3905, 3907, 3909, 3911, 3913, 3915, 3917, 3919, 3921, 3923, 3925, 3927, 3929, 3931, 3933, 3935, 3937, 3939, 3941, 3943, 3945, 3947, 3949, 3951, 3953, 3955, 3957, 3959, 3961, 3963, 3965, 3967, 3969, 3971, 3973, 3975, 3977, 3979, 3981, 3983, 3985, 3987, 3989, 3991, 3993, 3995, 3997, 3999, 4001, 4003, 4005, 4007, 4009, 4011, 4013, 4015, 4017, 4019, 4021, 4023, 4025, 4027, 4029, 4031, 4033, 4035, 4037, 4039, 4041, 4043, 4045, 4047, 4049, 4051, 4053, 4055, 4057, 4059, 4061, 4063, 4065, 4067, 4069, 4071, 4073, 4075, 4077, 4079, 4081, 4083, 4085, 4087, 4089, 4091, 4093, 4095, 4097, 4099, 4101, 4103, 4105, 4107, 4109, 4111, 4113, 4115, 4117, 4119, 4121, 4123, 4125, 4127, 4129, 4131, 4133, 4135, 4137, 4139, 4141, 4143, 4145, 4147, 4149, 4151, 4153, 4155, 4157, 4159, 4161, 4163, 4165, 4167, 4169, 4171, 4173, 4175, 4177, 4179, 4181, 4183, 4185, 4187, 4189, 4191, 4193, 4195, 4197, 4199, 4201, 4203, 4205, 4207, 4209, 4211, 4213, 4215, 4217, 4219, 4221, 4223, 4225, 4227, 4229, 4231, 4233, 4235, 4237, 4239, 4241, 4243, 4245, 4247, 4249, 4251, 4253, 4255, 4257, 4259, 4261, 4263, 4265, 4267, 4269, 4271, 4273, 4275, 4277, 4279, 4281, 4283, 4285, 4287, 4289, 4291, 4293, 4295, 4297, 4299, 4301, 4303, 4305, 4307, 4309, 4311, 4313, 4315, 4317, 4319, 4321, 4323, 4325, 4327, 4329, 4331, 4333, 4335, 4337, 4339, 4341, 4343, 4345, 4347, 4349, 4351, 4353, 4355, 4357, 4359, 4361, 4363, 4365, 4367, 4369, 4371, 4373, 4375, 4377, 4379, 4381, 4383, 4385, 4387, 4389, 4391, 4393, 4395, 4397, 4399, 4401, 4403, 4405, 4407, 4409, 4411, 4413, 4415, 4417, 4419, 4421, 4423, 4425, 4427, 4429, 4431, 4433, 4435, 4437, 4439, 4441, 4443, 4445, 4447, 4449, 4451, 4453, 4455, 4457, 4459, 4461, 4463, 4465, 4467, 4469, 4471, 4473, 4475, 4477, 4479, 4481, 4483, 4485, 4487, 4489, 4491, 4493, 4495, 4497, 4499, 4501, 4503, 4505, 4507, 4509, 4511, 4513, 4515, 4517, 4519, 4521, 4523, 4525, 4527, 4529, 4531, 4533, 4535, 4537, 4539, 4541, 4543, 4545, 4547, 4549, 4551, 4553, 4555, 4557, 4559, 4561, 4563, 4565, 4567, 4569, 4571, 4573, 4575, 4577, 4579, 4581, 4583, 4585, 4587, 4589, 4591, 4593, 4595, 4597, 4599, 4601, 4603, 4605, 4607, 4609, 4611, 4613, 4615, 4617, 4619, 4621, 4623, 4625, 4627, 4629, 4631, 4633, 4635, 4637, 4639, 4641, 4643, 4645, 4647, 4649, 4651, 4653, 4655, 4657, 4659, 4661, 4663, 4665, 4667, 4669, 4671, 4673, 4675, 4677, 4679, 4681, 4683, 4685, 4687, 4689, 4691, 4693, 4695, 4697, 4699, 4701, 4703, 4705, 4707, 4709, 4711, 4713, 4715, 4717, 4719, 4721, 4723, 4725, 4727, 4729, 4731, 4733, 4735, 4737, 4739, 4741, 4743, 4745, 4747, 4749, 4751, 4753, 4755, 4757, 4759, 4761, 4763, 4765, 4767, 4769, 4771, 4773, 4775, 4777, 4779, 4781, 4783, 4785, 4787, 4789, 4791, 4793, 4795, 4797, 4799, 4801, 4803, 4805, 4807, 4809, 4811, 4813, 4815, 4817, 4819, 4821, 4823, 4825, 4827, 4829, 4831, 4833, 4835, 4837, 4839, 4841, 4843, 4845, 4847, 4849, 4851, 4853, 4855, 4857, 4859, 4861, 4863, 4865, 4867, 4869, 4871, 4873, 4875, 4877, 4879, 4881, 4883, 4885, 4887, 4889, 4891, 4893, 4895, 4897, 4899, 4901, 4903, 4905, 4907, 4909, 4911, 4913, 4915, 4917, 4919, 4921, 4923, 4925, 4927, 4929, 4931, 4933, 4935, 4937, 4939, 4941, 4943, 4945, 4947, 4949, 4951, 4953, 4955, 4957, 4959, 4961, 4963, 4965, 4967, 4969, 4971, 4973, 4975, 4977, 4979, 4981, 4983, 4985, 4987, 4989, 4991, 4993, 4995, 4997, 4999, 5001, 5003, 5005, 5007, 5009, 5011, 5013, 5015, 5017, 5019, 5021, 5023, 5025, 5027, 5029, 5031, 5033, 5035, 5037, 5039, 5041, 5043, 5045, 5047, 5049, 5051, 5053, 5055, 5057, 5059, 5061, 5063, 5065, 5067, 5069, 5071, 5073, 5075, 5077, 5079, 5081, 5083, 5085, 5087, 5089, 5091, 5093, 5095, 5097, 5099, 5101, 5103, 5105, 5107, 5109, 5111, 5113, 5115, 5117, 5119, 5121, 5123, 5125, 5127, 5129, 5131, 5133, 5135, 5137, 5139, 5141, 5143, 5145, 5147, 5149, 5151, 5153, 5155, 5157, 5159, 5161, 5163, 5165, 5167, 5169, 5171, 5173, 5175, 5177, 5179, 5181, 5183, 5185, 5187, 5189, 5191, 5193, 5195, 5197, 5199, 5201, 5203, 5205, 5207, 5209, 5211, 5213, 5215, 5217, 5219, 5221, 5223, 5225, 5227, 5229, 5231, 5233, 5235, 5237, 5239, 5241, 5243, 5245, 5247, 5249, 5251, 5253, 5255, 5257, 5259, 5261, 5263, 5265, 5267, 5269, 5271, 5273, 5275, 5277, 5279, 5281, 5283, 5285, 5287, 5289, 5291, 5293, 5295, 5297, 5299, 5301, 5303, 5305, 5307, 5309, 5311, 5313, 5315, 5317, 5319, 5321, 5323, 5325, 5327, 5329, 5331, 5333, 5335, 5337, 5339, 5341, 5343, 5345, 5347, 5349, 5351, 5353, 5355, 5357, 5359, 5361, 5363, 5365, 5367, 5369, 5371, 5373, 5375, 5377, 5379, 5381, 5383, 5385, 5387, 5389, 5391, 5393, 5395, 5397, 5399, 5401, 5403, 5405, 5407, 5409, 5411, 5413, 5415, 5417, 5419, 5421, 5423, 5425, 5427, 5429, 5431, 5433, 5435, 5437, 5439, 5441, 5443, 5445, 5447, 5449, 5451, 5453, 5455, 5457, 5459, 5461, 5463, 5465, 5467, 5469, 5471, 5473, 5475, 5477, 5479, 5481, 5483, 5485, 5487, 5489, 5491, 5493, 5495, 5497, 5499, 5501, 5503, 5505, 5507, 5509, 5511, 5513, 5515, 5517, 5519, 5521, 5523, 5525, 5527, 5529, 5531, 5533, 5535, 5537, 5539, 5541, 5543, 5545, 5547, 5549, 5551, 5553, 5555, 5557, 5559, 5561, 5563, 5565, 5567, 5569, 5571, 5573, 5575, 5577, 5579, 5581, 5583, 5585, 5587, 5589, 5591, 5593, 5595, 5597, 5599, 5601, 5603, 5605, 5607, 5609, 5611, 5613, 5615, 5617, 5619, 5621, 5623, 5625, 5627, 5629, 5631, 5633, 5635, 5637, 5639, 5641, 5643, 5645, 5647, 5649, 5651, 5653, 5655, 5657, 5659, 5661, 5663, 5665, 5667, 5669, 5671, 5673, 5675, 5677, 5679, 5681, 5683, 5685, 5687, 5689, 5691, 5693, 5695, 5697, 5699, 5701, 5703, 5705, 5707, 5709, 5711, 5713, 5715, 5717, 5719, 5721, 5723, 5725, 5727, 5729, 5731, 5733, 5735, 5737, 5739, 5741, 5743, 5745, 5747, 5749, 5751, 5753, 5755, 5757, 5759, 5761, 5763, 5765, 5767, 5769, 5771, 5773, 5775, 5777, 5779, 5781, 5783, 5785, 5787, 5789, 5791, 5793, 5795, 5797, 5799, 5801, 5803, 5805, 5807, 5809, 5811, 5813, 5815, 5817, 5819, 5821, 5823, 5825, 5827, 5829, 5831, 5833, 5835, 5837, 5839, 5841, 5843, 5845, 5847, 5849, 5851, 5853, 5855, 5857, 5859, 5861, 5863, 5865, 5867, 5869, 5871, 5873, 5875, 5877, 5879, 5881, 5883, 5885, 5887, 5889, 5891, 5893, 5895, 5897, 5899, 5901, 5903, 5905, 5907, 5909, 5911, 5913, 5915, 5917, 5919, 5921, 5923, 5925, 5927, 5929, 5931, 5933, 5935, 5937, 5939, 5941, 5943, 5945, 5947, 5949, 5951, 5953, 5955, 5957, 5959, 5961, 5963, 5965, 5967, 5969, 5971, 5973, 5975, 5977, 5979, 5981, 5983, 5985, 5987, 5989, 5991, 5993, 5995, 5997, 5999, 6001, 6003, 6005, 6007, 6009, 6011, 6013, 6015, 6017, 6019, 6021, 6023, 6025, 6027, 6029, 6031, 6033, 6035, 6037, 6039, 6041, 6043, 6045, 6047, 6049, 6051, 6053, 6055, 6057, 6059, 6061, 6063, 6065, 6067, 6069, 6071, 6073, 6075, 6077, 6079, 6081, 6083, 6085, 6087, 6089, 6091, 6093, 6095, 6097, 6099, 6101, 6103, 6105, 6107, 6109, 6111, 6113, 6115, 6117, 6119, 6121, 6123, 6125, 6127, 6129, 6131, 6133, 6135, 6137, 6139, 6141, 6143, 6145, 6147, 6149, 6151, 6153, 6155, 6157, 6159, 6161, 6163, 6165, 6167, 6169, 6171, 6173, 6175, 6177, 6179, 6181, 6183, 6185, 6187, 6189, 6191, 6193, 6195, 6197, 6199, 6201, 6203,
6205, 6207, 6209, 6211, 6213, 6215, 6217, 6219, 6221, 6223,
6225, 6227, 6229, 6231, 6233, 6235, 6237, 6239, 6241, 6243,
6245, 6247, 6249, 6251, 6253, 6255, 6257, 6259, 6261, 6263,
6265, 6267, 6269, 6271, 6273, 6275, 6277, 6279, 6281, 6283,
6285, 6287, 6289, 6291, 6293, 6295, 6297, 6299, 6301, 6303,
6305, 6307, 6309, 6311, 6313, 6315, 6317, 6319, 6321, 6323,
6325, 6327, 6329, 6331, 6333, 6335, 6337, 6339, 6341, 6343,
6345, 6347, 6349, 6351, 6353, 6355, 6357, 6359, 6361, 6363,
6365, 6367, 6369, 6371, 6373, 6375, 6377, 6379, 6381, 6383,
6385, 6387, 6389, 6391, 6393, 6395, 6397, 6399, 6401, 6403,
6405, 6407, 6409, 6411, 6413, 6415, 6417, 6419, 6421, 6423,
6425, 6427, 6429, 6431, 6433, 6435, 6437, 6439, 6441, 6443,
6445, 6447, 6449, 6451, 6453, 6455, 6457, 6459, 6461, 6463,
6465, 6467, 6469, 6471, 6473, 6475, 6477, 6479, 6481, 6483,
6485, 6487, 6489, 6491, 6493, 6495, 6497, 6499, 6501, 6503,
6505, 6507, 6509, 6511, 6513, 6515, 6517, 6519, 6521, 6523,
6525, 6527, 6529, 6531, 6533, 6535, 6537, 6539, 6541, 6543,
6545, 6547, 6549, 6551, 6553, 6555, 6557, 6559, 6561, 6563,
6565, 6567, 6569, 6571, 6573, 6575, 6577, 6579, 6581, 6583,
6585, 6587, 6589, 6591, 6593, 6595, 6597, 6599, 6601, 6603,
6605, 6607, 6609, 6611, 6613, 6615, 6617, 6619, 6621, 6623,
6625, 6627, 6629, 6631, 6633, 6635, 6637, 6639, 6641, 6643,
6645, 6647, 6649, 6651, 6653, 6655, 6657, 6659, 6661, 6663,
6665, 6667, 6669, 6671, 6673, 6675, 6677, 6679, 6681, 6683,
6685, 6687, 6689, 6691, 6693, 6695, 6697, 6699, 6701, 6703,
6705, 6707, 6709, 6711, 6713, 6715, 6717, 6719, 6721, 6723,
6725, 6727, 6729, 6731, 6733, 6735, 6737, 6739, 6741, 6743,
6745, 6747, 6749, 6751, 6753, 6755, 6757, 6759, 6761, 6763,
6765, 6767, 6769, 6771, 6773, 6775, 6777, 6779, 6781, 6783,
6785, 6787, 6789, 6791, 6793, 6795, 6797, 6799, 6801, 6803,
6805, 6807, 6809, 6811, 6813, 6815, 6817, 6819, 6821, 6823,
6825, 6827, 6829, 6831, 6833, 6835, 6837, 6839, 6841, 6843,
6845, 6847, 6849, 6851, 6853, 6855, 6857, 6859, 6861, 6863,
6865, 6867, 6869, 6871, 6873, 6875, 6877, 6879, 6881, 6883,
6885, 6887, 6889, 6891, 6893, 6895, 6897, 6899, 6901, 6903,
6905, 6907, 6909, 6911, 6913, 6915, 6917, 6919, 6921, 6923,
6925, 6927, 6929, 6931, 6933, 6935, 6937, 6939, 6941, 6943,
6945, 6947, 6949, 6951, 6953, 6955, 6957, 6959, 6961, 6963,
6965, 6967, 6969, 6971, 6973, 6975, 6977, 6979, 6981, 6983,
6985, 6987, 6989, 6991, 6993, 6995, 6997, 6999, 7001, 7003,
7005, 7007, 7009, 7011, 7013, 7015, 7017, 7019, 7021, 7023,
7025, 7027, 7029, 7031, 7033, 7035, 7037, 7039, 7041, 7043,
7045, 7047, 7049, 7051, 7053, 7055, 7057, 7059, 7061, 7063,
7065, 7067, 7069, 7071, 7073, 7075, 7077, 7079, 7081, 7083,
7085, 7087, 7089, 7091, 7093, 7095, 7097, 7099, 7101, 7103,
7105, 7107, 7109, 7111, 7113, 7115, 7117, 7119, 7121, 7123,
7125, 7127, 7129, 7131, 7133, 7135, 7137, 7139, 7141, 7143,
7145, 7147, 7149, 7151, 7153, 7155, 7157, 7159, 7161, 7163,
7165, 7167, 7169, 7171, 7173, 7175, 7177, 7179, 7181, 7183,
7185, 7187, 7189, 7191, 7193, 7195, 7197, 7199, 7201, 7203,
7205, 7207, 7209, 7211, 7213, 7215, 7217, 7219, 7221, 7223,
7225, 7227, 7229, 7231, 7233, 7235, 7237, 7239, 7241, 7243,
7245, 7247, 7249, 7251, 7253, 7255, 7257, 7259, 7261, 7263,
7265, 7267, 7269, 7271, 7273, 7275, 7277, 7279, 7281, 7283,
7285, 7287, 7289, 7291, 7293, 7295, 7297, 7299, 7301, 7303,
7305, 7307, 7309, 7311, 7313, 7315, 7317, 7319, 7321, 7323,
7325, 7327, 7329, 7331, 7333, 7335, 7337, 7339, 7341, 7343,
7345, 7347, 7349, 7351, 7353, 7355, 7357, 7359, 7361, 7363,
7365, 7367, 7369, 7371, 7373, 7375, 7377, 7379, 7381, 7383,
7385, 7387, 7389, 7391, 7393, 7395, 7397, 7399, 7401, 7403,
7405, 7407, 7409, 7411, 7413, 7415, 7417, 7419, 7421, 7423,
7425, 7427, 7429, 7431, 7433, 7435, 7437, 7439, 7441, 7443,
7445, 7447, 7449, 7451, 7453, 7455, 7457, 7459, 7461, 7463,
7465, 7467, 7469, 7471, 7473, 7475, 7477, 7479, 7481, 7483,
7485, 7487, 7489, 7491, 7493, 7495, 7497, 7499, 7501, 7503,
7505, 7507, 7509, 7511, 7513, 7515, 7517, 7519, 7521, 7523,
7525, 7527, 7529, 7531, 7533, 7535, 7537, 7539, 7541, 7543,
7545, 7547, 7549, 7551, 7553, 7555, 7557, 7559, 7561, 7563,
7565, 7567, 7569, 7571, 7573, 7575, 7577, 7579, 7581, 7583,
7585, 7587, 7589, 7591, 7593, 7595, 7597, 7599, 7601, 7603,
7605, 7607, 7609, 7611, 7613, 7615, 7617, 7619, 7621, 7623,
7625, 7627, 7629, 7631, 7633, 7635, 7637, 7639, 7641, 7643,
7645, 7647, 7649, 7651, 7653, 7655, 7657, 7659, 7661, 7663,
7665, 7667, 7669, 7671, 7673, 7675, 7677, 7679, 7681, 7683,
7685, 7687, 7689, 7691, 7693, 7695, 7697, 7699, 7701, 7703,
7705, 7707, 7709, 7711, 7713, 7715, 7717, 7719, 7721, 7723,
7725, 7727, 7729, 7731, 7733, 7735, 7737, 7739, 7741, 7743,
7745, 7747, 7749, 7751, 7753, 7755, 7757, 7759, 7761, 7763,
7765, 7767, 7769, 7771, 7773, 7775, 7777, 7779, 7781, 7783,
7785, 7787, 7789, 7791, 7793, 7795, 7797, 7799, 7801, 7803,
7805, 7807, 7809, 7811, 7813, 7815, 7817, 7819, 7821, 7823,
7825, 7827, 7829, 7831, 7833, 7835, 7837, 7839, 7841, 7843,
7845, 7847, 7849, 7851, 7853, 7855, 7857, 7859, 7861, 7863,
7865, 7867, 7869, 7871, 7873, 7875, 7877, 7879, 7881, 7883,
7885, 7887, 7889, 7891, 7893, 7895, 7897, 7899, 7901, 7903,
7905, 7907, 7909, 7911, 7913, 7915, 7917, 7919, 7921, 7923,
7925, 7927, 7929, 7931, 7933, 7935, 7937, 7939, 7941, 7943,
7945, 7947, 7949, 7951, 7953, 7955, 7957, 7959, 7961, 7963,
7965, 7967, 7969, 7971, 7973, 7975, 7977, 7979, 7981, 7983,
7985, 7987, 7989, 7991, 7993, 7995, 7997, 7999, 8001, 8003,
8005, 8007, 8009, 8011, 8013, 8015, 8017, 8019, 8021, 8023,
8025, 8027, 8029, 8031, 8033, 8035, 8037, 8039, 8041, 8043,
8045, 8047, 8049, 8051, 8053, 8055, 8057, 8059, 8061, 8063,
8065, 8067, 8069, 8071, 8073, 8075, 8077, 8079, 8081, 8083,
8085, 8087, 8089, 8091, 8093, 8095, 8097, 8099, 8101, 8103,
8105, 8107, 8109, 8111, 8113, 8115, 8117, 8119, 8121, 8123,
8125, 8127, 8129, 8131, 8133, 8135, 8137, 8139, 8141, 8143,
8145, 8147, 8149, 8151, 8153, 8155, 8157, 8159, 8161, 8163,
8165, 8167, 8169, 8171, 8173, 8175, 8177, 8179, 8181, 8183,
8185, 8187, 8189, 8191, 8193, 8195, 8197, 8199, 8201, 8203,
8205, 8207, 8209, 8211, 8213, 8215, 8217, 8219, 8221, 8223,
8225, 8227, 8229, 8231, 8233, 8235, 8237, 8239, 8241, 8243,
8245, 8247, 8249, 8251, 8253, 8255, 8257, 8259, 8261, 8263,
8265, 8267, 8269, 8271, 8273, 8275, 8277, 8279, 8281, 8283,
8285, 8287, 8289, 8291, 8293, 8295, 8297, 8299, 8301, 8303,
8305, 8307, 8309, 8311, 8313, 8315, 8317, 8319, 8321, 8323,
8325, 8327, 8329, 8331, 8333, 8335, 8337, 8339, 8341, 8343,
8345, 8347, 8349, 8351, 8353, 8355, 8357, 8359, 8361, 8363,
8365, 8367, 8369, 8371, 8373, 8375, 8377, 8379, 8381, 8383,
8385, 8387, 8389, 8391, 8393, 8395, 8397, 8399, 8401, 8403,
8405, 8407, 8409, 8411, 8413, 8415, 8417, 8419, 8421, 8423,
8425, 8427, 8429, 8431, 8433, 8435, 8437, 8439, 8441, 8443,
8445, 8447, 8449, 8451, 8453, 8455, 8457, 8459, 8461, 8463,
8465, 8467, 8469, 8471, 8473, 8475, 8477, 8479, 8481, 8483,
8485, 8487, 8489, 8491, 8493, 8495, 8497, 8499, 8501, 8503,
8505, 8507, 8509, 8511, 8513, 8515, 8517, 8519, 8521, 8523,
8525, 8527, 8529, 8531, 8533, 8535, 8537, 8539, 8541, 8543,
8545, 8547, 8549, 8551, 8553, 8555, 8557, 8559, 8561, 8563,
8565, 8567, 8569, 8571, 8573, 8575, 8577, 8579, 8581, 8583,
8585, 8587, 8589, 8591, 8593, 8595, 8597, 8599, 8601, 8603,
8605, 8607, 8609, 8611, 8613, 8615, 8617, 8619, 8621, 8623,
8625, 8627, 8629, 8631, 8633, 8635, 8637, 8639, 8641, 8643,
8645, 8647, 8649, 8651, 8653, 8655, 8657, 8659, 8661, 8663,
8665, 8667, 8669, 8671, 8673, 8675, 8677, 8679, 8681, 8683,
8685, 8687, 8689, 8691, 8693, 8695, 8697, 8699, 8701, 8703,
8705, 8707, 8709, 8711, 8713, 8715, 8717, 8719, 8721, 8723,
8725, 8727, 8729, 8731, 8733, 8735, 8737, 8739, 8741, 8743,
8745, 8747, 8749, 8751, 8753, 8755, 8757, 8759, 8761, 8763,
8765, 8767, 8769, 8771, 8773, 8775, 8777, 8779, 8781, 8783,
8785, 8787, 8789, 8791, 8793, 8795, 8797, 8799, 8801, 8803,
8805, 8807, 8809, 8811, 8813, 8815, 8817, 8819, 8821, 8823,
8825, 8827, 8829, 8831, 8833, 8835, 8837, 8839, 8841, 8843,
8845, 8847, 8849, 8851, 8853, 8855, 8857, 8859, 8861, 8863, 8865, 8867, 8869, 8871, 8873, 8875, 8877, 8879, 8881, 8883, 8885, 8887, 8889, 8891, 8893, 8895, 8897, 8899, 8901, 8903, 8905, 8907, 8909, 8911, 8913, 8915, 8917, 8919, 8921, 8923, 8925, 8927, 8929, 8931, 8933, 8935, 8937, 8939, 8941, 8943, 8945, 8947, 8949, 8951, 8953, 8955, 8957, 8959, 8961, 8963, 8965, 8967, 8969, 8971, 8973, 8975, 8977, 8979, 8981, 8983, 8985, 8987, 8989, 8991, 8993, 8995, 8997, 8999, 9001, 9003, 9005, 9007, 9009, 9011, 9013, 9015, 9017, 9019, 9021, 9023, 9025, 9027, 9029, 9031, 9033, 9035, 9037, 9039, 9041, 9043, 9045, 9047, 9049, 9051, 9053, 9055, 9057, 9059, 9061, 9063, 9065, 9067, 9069, 9071, 9073, 9075, 9077, 9079, 9081, 9083, 9085, 9087, 9089, 9091, 9093, 9095, 9097, 9099, 9101, 9103, 9105, 9107, 9109, 9111, 9113, 9115, 9117, 9119, 9121, 9123, 9125, 9127, 9129, 9131, 9133, 9135, 9137, 9139, 9141, 9143, 9145, 9147, 9149, 9151, 9153, 9155, 9157, 9159, 9161, 9163, 9165, 9167, 9169, 9171, 9173, 9175, 9177, 9179, 9181, 9183, 9185, 9187, 9189, 9191, 9193, 9195, 9197, 9199, 9201, 9203, 9205, 9207, 9209, 9211, 9213, 9215, 9217, 9219, 9221, 9223, 9225, 9227, 9229, 9231, 9233, 9235, 9237, 9239, 9241, 9243, 9245, 9247, 9249, 9251, 9253, 9255, 9257, 9259, 9261, 9263, 9265, 9267, 9269, 9271, 9273, 9275, 9277, 9279, 9281, 9283, 9285, 9287, 9289, 9291, 9293, 9295, 9297, 9299, 9301, 9303, 9305, 9307, 9309, 9311, 9313, 9315, 9317, 9319, 9321, 9323, 9325, 9327, 9329, 9331, 9333, 9335, 9337, 9339, 9341, 9343, 9345, 9347, 9349, 9351, 9353, 9355, 9357, 9359, 9361, 9363, 9365, 9367, 9369, 9371, 9373, 9375, 9377, 9379, 9381, 9383, 9385, 9387, 9389, 9391, 9393, 9395, 9397, 9399, 9401, 9403, 9405, 9407, 9409, 9411, 9413, 9415, 9417, 9419, 9421, 9423, 9425, 9427, 9429, 9431, 9433, 9435, 9437, 9439, 9441, 9443, 9445, 9447, 9449, 9451, 9453, 9455, 9457, 9459, 9461, 9463, 9465, 9467, 9469, 9471, 9473, 9475, 9477, 9479, 9481, 9483, 9485, 9487, 9489, 9491, 9493, 9495, 9497, 9499, 9501, 9503, 9505, 9507, 9509, 9511, 9513, 9515, 9517, 9519, 9521, 9523, 9525, 9527, 9529, 9531, 9533, 9535, 9537, 9539, 9541, 9543, 9545, 9547, 9549, 9551, 9553, 9555, 9557, 9559, 9561, 9563, 9565, 9567, 9569, 9571, 9573, 9575, 9577, 9579, 9581, 9583, 9585, 9587, 9589, 9591, 9593, 9595, 9597, 9599, 9601, 9603, 9605, 9607, 9609, 9611, 9613, 9615, 9617, 9619, 9621, 9623, 9625, 9627, 9629, 9631, 9633, 9635, 9637, 9639, 9641, 9643, 9645, 9647, 9649, 9651, 9653, 9655, 9657, 9659, 9661, 9663, 9665, 9667, 9669, 9671, 9673, 9675, 9677, 9679, 9681, 9683, 9685, 9687, 9689, 9691, 9693, 9695, 9697, 9699, 9701, 9703, 9705, 9707, 9709, 9711, 9713, 9715, 9717, 9719, 9721, 9723, 9725, 9727, 9729, 9731, 9733, 9735, 9737, 9739, 9741, 9743, 9745, 9747, 9749, 9751, 9753, 9755, 9757, 9759, 9761, 9763, 9765, 9767, 9769, 9771, 9773, 9775, 9777, 9779, 9781, 9783, 9785, 9787, 9789, 9791, 9793, 9795, 9797, 9799, 9801, 9803, 9805, 9807, 9809, 9811, 9813, 9815, 9817, 9819, 9821, 9823, 9825, 9827, 9829, 9831, 9833, 9835, 9837, 9839, 9841, 9843, 9845, 9847, 9849, 9851, 9853, 9855, 9857, 9859, 9861, 9863, 9865, 9867, 9869, 9871, 9873, 9875, 9877, 9879, 9881, 9883, 9885, 9887, 9889, 9891, 9893, 9895, 9897, 9899, 9901, 9903, 9905, 9907, 9909, 9911, 9913, 9915, 9917, 9919, 9921, 9923, 9925, 9927, 9929, 9931, 9933, 9935, 9937, 9939, 9941, 9943, 9945, 9947, 9949, 9951, 9953, 9955, 9957, 9959, 9961, 9963, 9965, 9967, 9969, 9971, 9973, 9975, 9977, 9979, 9981, 9983, 9985, 9987, 9989; (b) a nucleotide sequence having at least 80% sequence identity to an amino acid sequence of (a); (c) a nucleotide sequence which is a fragment of at least 10 consecutive nucleotides from a nucleotide sequence of (a); or (d) a nucleotide sequence having at least 80% sequence identity to a nucleotide sequence of (a) and including a fragment of at least 10 consecutive nucleotides from a nucleotide sequence of (a).

In another aspect, the invention relates to a nucleic acid comprising: (a) a nucleotide sequence selected from the group consisting of SEQ ID NOs 511, 2453, 2455, 2677, 2691, 4595, 4747, 7003, 7051, 8167, 4627 and 5699; (b) a nucleotide sequence having at least 80% sequence identity to an amino acid sequence of (a); (c) a nucleotide sequence which is a fragment of at least 10 consecutive nucleotides from a nucleotide sequence of (a); or (d) a nucleotide sequence having at least 80% sequence identity to a nucleotide sequence of (a) and including a fragment of at least 10 consecutive nucleotides from a nucleotide sequence of (a).

In a further aspect, the invention relates to a nucleic acid comprising: (a) a nucleotide sequence selected from the group consisting of SEQ ID Nos 8563, 2727, 9871, 4671, 5679, 533, 3221, 3225 and 7003, (b) a nucleotide sequence having at least 80% sequence identity to an amino acid sequence of (a); (c) a nucleotide sequence which is a fragment of at least 10 consecutive nucleotides from a nucleotide sequence of (a); or (d) a nucleotide sequence having at least 80% sequence identity to a nucleotide sequence of (a) and including a fragment of at least 10 consecutive nucleotides from a nucleotide sequence of (a).

The present invention also relates to nucleic acids of the invention encoding a polypeptide the invention, and to monoclonal antibodies specific for a polypeptide of the invention.

The polypeptides, nucleic acids and antibodies of the invention can be used in medicine and in the manufacture of a medicament for raising an immune response in a patient.

The present invention also relates to pharmaceutical compositions comprising a polypeptide, nucleic acid or antibody of the invention, in admixture with a pharmaceutically acceptable carrier. The invention further relates to a pharmaceutical composition comprising two or more polypeptides of the invention, in admixture with a pharmaceutically acceptable carrier. In a particular embodiment, the pharmaceutical compositions of the invention further comprise a vaccine adjuvant. The present invention further relates to immunogenic compositions comprising one or more outer membrane vesicles (OMVs) expressing or overexpressing one or more polypeptides encoded by:

(a) a nucleotide sequence selected from the group consisting of SEQ ID NOs 511, 2453, 2455, 2677, 2691, 4595, 4747, 7003, 7051, 8167, 4627 and 5699; (b) a nucleotide sequence having at least 80% sequence identity to an amino acid sequence of (a); (c) a nucleotide sequence which is a fragment of at least 10 consecutive nucleotides from a nucleotide sequence of (a); or (d) a nucleotide sequence having at least 80% sequence identity to a nucleotide sequence of (a) and including a fragment of at least 10 consecutive nucleotides from a nucleotide sequence of (a).

The present invention also relates to immunogenic compositions comprising one or more OMVs expressing or overexpressing one or more polypeptides encoded by: (a) a nucleotide sequence selected from the group consisting of SEQ ID Nos 8563, 2727, 9871, 4671, 5679, 533, 3221, 3225 and 7003; (b) a nucleotide sequence having at least 80% sequence identity to an amino acid sequence of (a); (c) a nucleotide sequence which is a fragment of at least 10 consecutive nucleotides from a nucleotide sequence of (a); or (d) a nucleotide sequence having at least 80% sequence identity to a nucleotide sequence of (a) and including a fragment of at least 10 consecutive nucleotides from a nucleotide sequence of (a).

The present invention also relates to methods for raising an immune response in a patient, comprising the step of administering to the patient a pharmaceutical composition or immunogenic composition of the invention. In a particular embodiment, the immune response is protective against ExPEC infection, and in particular against a MNEC infection.

Further aspects of the invention are described below.

DETAILED DESCRIPTION OF THE INVENTION

Figure 1:
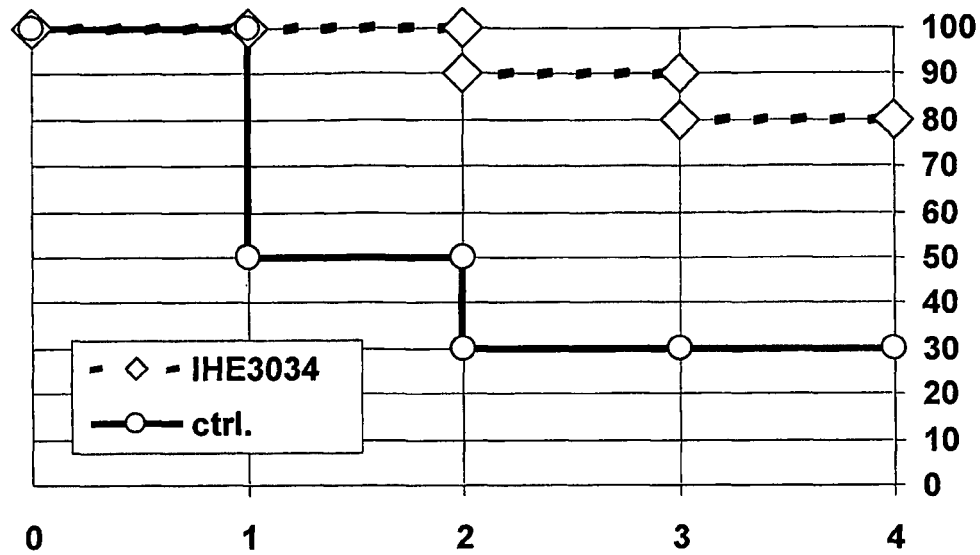
FIG. 1 shows the % survival of mice over time after challenge with IHE3034 following immunization with heat-inactivated IHE3034 or with a control ('fisiol'), and also bacteremia levels (cfa/ml) after 24 hours.
Figure 1:
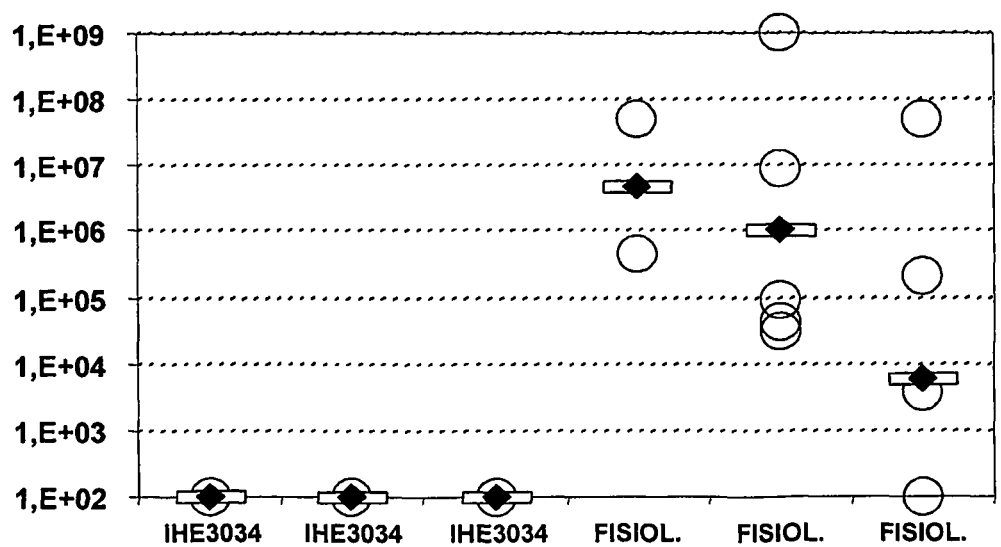

The inventors have identified 4995 open reading frames from a K1/B2 MNEC strain, and have identified a subset of these that is of particular interest for preparing immunogenic compositions against MNEC strains.

Polypeptides

The invention provides polypeptides comprising the amino acid sequences disclosed in the examples. These amino acid sequences are given in the sequence listing as the even-numbered sequences SEQ ID NOs 2 to 9990.

Preferred amino acid sequences from within SEQ ID NOs 2 to 9990 are given in Table 2. Further preferred amino acid sequences are those not identified in the prior art e.g. not identified in any of references 5, 6, 7, 8, 9, 10, 11 and 13.

The invention also provides a polypeptide encoded within any one of nucleic acid sequences SEQ ID NOs 9991 to 10273 or within SEQ ID NO: 10274. The coding sequence in the nucleic acid preferably begins with a start codon and ends with a stop codon. Preferred polypeptides are those not identified in the prior art e.g. not identified in any of references 5, 6, 8, 10 and 11.

The invention also provides polypeptides comprising amino acid sequences that have sequence identity to the amino acid sequences disclosed in the examples. Similarly, the invention provides polypeptides comprising amino acid sequences that have sequence identity to the amino acid sequences encoded within SEQ ID NOs 9991 to 10273 or within SEQ ID NO: 10274. Depending on the particular sequence, the degree of sequence identity is preferably greater than 50% (e.g. 60%, 70%, 75%, 80%, 85%, 90%, 91%, 92%, 93%, 94%, 95%, 96%, 97%, 98%, 99% or more). These polypeptides include homologs, orthologs, allelic variants and mutants. Typically, 50% identity or more between two polypeptide sequences is considered to be an indication of functional equivalence. Identity between polypeptides is preferably determined by the Smith-Waterman homology search algorithm as implemented in the MPSRCH program (Oxford Molecular), using an affine gap search with parameters gap open penalty=12 and gap extension penalty=1.

These polypeptide may, compared to the sequences of the examples, include one or more (e.g. 1, 2, 3, 4, 5, 6, 7, 8, 9, 10, etc.) conservative amino acid substitutions i.e. replacements of one amino acid with another which has a related side chain. Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cysteine, serine, threonine, tyrosine. Phenylalanine, tryptophan, and tyrosine are sometimes classified jointly as aromatic amino acids. In general, substitution of single amino acids within these families does not have a major effect on the biological activity. Moreover, the polypeptides may have one or more (e.g. 1, 2, 3, 4, 5, 6, 7, 8, 9, 10, etc.) single amino acid deletions relative to a reference sequence. Furthermore, the polypeptides may include one or more (e.g. 1, 2, 3, 4, 5, 6, 7, 8, 9, 10, etc.) insertions (e.g. each of 1, 2, 3, 4 or 5 amino acids) relative to a reference sequence.

Preferred polypeptides include polypeptides that are lipidated, that are located in the outer membrane, that are located in the inner membrane, or that are located in the periplasm. Particularly preferred polypeptides are those that fall into more than one of these categories e.g. lipidated polypeptides that are located in the outer membrane. Lipoproteins may have a N-terminal cysteine to which lipid is covalently attached, following post-translational processing of the signal peptide.

Polypeptides that may be lipidated include SEQ ID NOs: 620, 630, 660, 724, 946, 1196, 1304, 1510, 1530, 1548, 1600, 1700, 1958, 2030, 2396, 2610, 3040, 3364, 3414, 3422, 3554, 3678, 3824, 4072, 4116, 4178, 4240, 4374, 4412, 4462, 4576, 4664, 4856, 5178, 5286, 5362, 5662, 5682, 5984, 6018, 6132, 6256, 6286, 6532, 6714, 6754, 6764, 6790, 6938, 7144, 7442, 7674, 7872, 8278, 8498, 8564, 8782, 8784, 9276 and 9580. SEQ ID NOs 5662 (ORF02831) and 8564 (ORF04282) are preferred lipoproteins.

Preferred polypeptides are those listed in Table 2.

The invention further provides polypeptides comprising fragments of the amino acid sequences disclosed in the examples. Similarly, the invention provides polypeptides comprising fragments of the amino acid sequences encoded within SEQ ID NOs 9991 to 10273 or within SEQ ID NO: 10274. The fragments should comprise at least n consecutive amino acids from the sequences and, depending on the particular sequence, n is 7 or more (e.g. 8, 10, 12, 14, 16, 18, 20, 22, 24, 26, 28, 30, 35, 40, 45, 50, 60, 70, 80, 90, 100 or more). The fragment may comprise at least one T-cell or, preferably, a B-cell epitope of the sequence. T- and B-cell epitopes can be identified empirically (e.g. using PEPSCAN [14,15] or similar methods), or they can be predicted (e.g. using the Jameson-Wolf antigenic index [16], matrix-based approaches [17], TEPITOPE [18], neural networks [19], OptiMer & EpiMer [20,21], ADEPT [22], Tsites [23], hydrophilicity [24], antigenic index [25] or the methods disclosed in reference 26, etc.). Other preferred fragments are (a) the N-terminal signal peptides of the polypeptides of the invention, (b) the polypeptides, but without their N-terminal signal peptides, (c) the polypeptides, but without 1, 2, 3, 4, 5, 6, 7, 8, 9 or 10 of their N-terminal amino acid residue(s).

Other preferred fragments are those that begin with an amino acid encoded by a potential start codon (ATG, GTG, TTG). Fragments starting at the methionine encoded by a start codon downstream of the indicated start codon are polypeptides of the invention.

Other preferred fragments are those that are common to a polypeptide of the invention and to a polypeptide identified in any of references 5, 6, 8, 10 and 11.

Polypeptides of the invention can be prepared in many ways e.g. by chemical synthesis (in whole or in part), by digesting longer polypeptides using proteases, by translation from RNA, by purification from cell culture (e.g. from recombinant expression), from the organism itself (e.g. after bacterial culture, or direct from patients), etc. A preferred method for production of peptides <40 amino acids long involves in vitro chemical synthesis [27,28]. Solid-phase peptide synthesis is particularly preferred, such as methods based on tboc or Fmoc [29] chemistry. Enzymatic synthesis [30] may also be used in part or in fall. As an alternative to chemical synthesis, biological synthesis may be used e.g. the polypeptides may be produced by translation. This may be carried out in vitro or in vivo. Biological methods are in general restricted to the production of polypeptides based on L-amino acids, but manipulation of translation machinery (e.g. of aminoacyl tRNA molecules) can be used to allow the introduction of D-amino acids (or of other non natural amino acids, such as iodotyrosine or methylphenylalanine, azidohomoalanine, etc.) [31]. Where D-amino acids are included, however, it is preferred to use chemical synthesis. Polypeptides of the invention may have covalent modifications at the C-terminus and/or N-terminus.

Polypeptides of the invention can take various forms (e.g. native, fusions, glycosylated, non-glycosylated, lipidated, non-lipidated, phosphorylated, non-phosphorylated, myristoylated, non-myristoylated, monomeric, multimeric, particulate, denatured, etc.).

Polypeptides of the invention are preferably provided in purified or substantially purified form i.e. substantially free from other polypeptides (e.g. free from naturally-occurring polypeptides), particularly from other ExPEC or host cell polypeptides, and are generally at least about 50% pure (by weight), and usually at least about 90% pure i.e. less than about 50%, and more preferably less than about 10% (e.g. 5% or less) of a composition is made up of other expressed polypeptides. Polypeptides of the invention are preferably ExPEC, and more preferably MNEC, polypeptides.

Polypeptides of the invention may be attached to a solid support. Polypeptides of the invention may comprise a detectable label (e.g. a radioactive or fluorescent label, or a biotin label).

The term polypeptide refers to amino acid polymers of any length. The polymer may be linear or branched, it may comprise modified amino acids, and it may be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art. Polypeptides can occur as single chains or associated chains. Polypeptides of the invention can be naturally or non-naturally glycosylated (i.e. the polypeptide has a glycosylation pattern that differs from the glycosylation pattern found in the corresponding naturally occurring polypeptide).

Polypeptides of the invention may be at least 40 amino acids long (e.g. at least 40, 50, 60, 70, 80, 90, 100, 120, 140, 160, 180, 200, 220, 240, 260, 280, 300, 350, 400, 450, 500 or more). Polypeptides of the invention may be shorter than 500 amino acids (e.g. no longer than 40, 50, 60, 70, 80, 90, 100, 120, 140, 160, 180, 200, 220, 240, 260, 280, 300, 350, 400 or 450 amino acids).

The invention provides polypeptides comprising a sequence -X-Y- or -Y-X-, wherein: -X- is an amino acid sequence as defined above and -Y- is not a sequence as defined above i.e. the invention provides fusion proteins. Where the N-terminus codon of a polypeptide-coding sequence is not ATG then that codon will be translated as the standard amino acid for that codon rather than as a Met, which occurs when the codon is translated as a start codon.

The invention provides a process for producing polypeptides of the invention, comprising the step of culturing a host cell of to the invention under conditions which induce polypeptide expression.

The invention provides a process for producing a polypeptide of the invention, wherein the polypeptide is synthesised in part or in whole using chemical means.

The invention provides a composition comprising two or more (e.g. 2, 3, 4, 5, 6 or more) polypeptides of the invention. The different polypeptides may be selected such that they are involved in different bacterial metabolic and/or signalling pathways e.g. selection from 2, 3, 4, 5, 6 or more of the following categories: adhesins; autotransporter proteins; toxins; iron acquisitions proteins; and membrane-associated proteins, including in particular integral outer membrane proteins. Such combinations of antigens may target the immune response against different aspects of the bacterial life cycle, resulting in a more effective immune response.

The invention also provides a hybrid polypeptide represented by the formula $NH_2$-A-[-X-L-]$_n$-B—COOH, wherein X is a polypeptide of the invention as defined above, L is an optional linker amino acid sequence, A is an optional N-terminal amino acid sequence, B is an optional C-terminal amino acid sequence, and n is an integer greater than 1. The value of n is between 2 and x, and the value of x is typically 3, 4, 5, 6, 7, 8, 9 or 10. Preferably n is 2, 3 or 4; it is more preferably 2 or 3; most preferably, n=2. for each n instances, -X- may be the same or different. For each n instances of [-X-L-], linker amino acid sequence -L- may be present or absent. For instance, when n=2 the hybrid may be $NH_2$—$X_1$-$L_1$-$X_2$-$L_2$-COOH, $NH_2$—$X_1$—$X_2$—COOH, $NH_2$—$X_1$-$L_1$-$X_2$—COOH, $NH_2$—$X_1$—$X_2$-$L_2$-COOH, etc. Linker amino acid sequence(s) -L- will typically be short (e.g. 20 or fewer amino acids i.e. 19, 18, 17, 16, 15, 14, 13, 12, 11, 10, 9, 8, 7, 6, 5, 4, 3, 2, 1). Examples include short peptide sequences which facilitate cloning, poly-glycine linkers (i.e. $Gly_n$ where n=2, 3, 4, 5, 6, 7, 8, 9, 10 or more), and histidine tags (i.e. $His_n$ where n=3, 4, 5, 6, 7, 8, 9, 10 or more). Other suitable linker amino acid sequences will be apparent to those skilled in the art. -A- and —B— are optional sequences which will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct polypeptide trafficking, or short peptide sequences which facilitate cloning or purification (e.g. histidine tags i.e. $His_n$ where n=3, 4, 5, 6, 7, 8, 9, 10 or more). Other suitable N-terminal and C-terminal amino acid sequences will be apparent to those skilled in the art.

Various tests can be used to assess the in vivo immunogenicity of polypeptides of the invention. For example, polypeptides can be expressed recombinantly and used to screen patient sera by immunoblot. A positive reaction between the polypeptide and patient serum indicates that the patient has previously mounted an immune response to the protein in question i.e. the protein is an immunogen. This method can also be used to identify immunodominant proteins.

Antibodies

The invention provides antibodies that bind to polypeptides of the invention. These may be polyclonal or monoclonal and may be produced by any suitable means (e.g. by recombinant expression). To increase compatibility with the human immune system, the antibodies may be chimeric or humanised [e.g. refs. 32 & 33], or fully human antibodies may be used. The antibodies may include a detectable label (e.g.

for diagnostic assays). Antibodies of the invention may be attached to a solid support. Antibodies of the invention are preferably neutralising antibodies.

Monoclonal antibodies are particularly useful in identification and purification of the individual polypeptides against which they are directed. Monoclonal antibodies of the invention may also be employed as reagents in immunoassays, radioimmunoassays (RIA) or enzyme-linked immunosorbent assays (ELISA), etc. In these applications, the antibodies can be labelled with an analytically-detectable reagent such as a radioisotope, a fluorescent molecule or an enzyme. The monoclonal antibodies produced by the above method may also be used for the molecular identification and characterization (epitope mapping) of polypeptides of the invention.

Antibodies of the invention are preferably specific to ExPEC strains of *E. coli*, i.e. they bind preferentially to ExPEC *E. coli* relative to other bacteria (e.g. relative to non-ExPEC *E. coli* and relative to non *E. coli* bacteria). More preferably, the antibodies are specific to MNEC strains i.e. they bind preferentially to MNEC bacteria relative to other bacteria, including relative to other ExPEC *E. coli*.

Antibodies of the invention are preferably provided in purified or substantially purified form. Typically, the antibody will be present in a composition that is substantially free of other polypeptides e.g. where less than 90% (by weight), usually less than 60% and more usually less than 50% of the composition is made up of other polypeptides.

Antibodies of the invention can be of any isotype (e.g. IgA, IgG, IgM i.e. an $\alpha$, $\gamma$ or $\mu$ heavy chain), but will generally be IgG. Within the IgG isotype, antibodies may be IgG1, IgG2, IgG3 or IgG4 subclass. Antibodies of the invention may have a $\kappa$ or a $\lambda$ light chain.

Antibodies of the invention can take various forms, including whole antibodies, antibody fragments such as $F(ab')_2$ and $F(ab)$ fragments, Fv fragments (non-covalent heterodimers), single-chain antibodies such as single chain Fv molecules (scFv), minibodies, oligobodies, etc. The term "antibody" does not imply any particular origin, and includes antibodies obtained through non-conventional processes, such as phage display.

The invention provides a process for detecting polypeptides of the invention, comprising the steps of: (a) contacting an antibody of the invention with a biological sample under conditions suitable for the formation of an antibody-antigen complexes; and (b) detecting said complexes.

The invention provides a process for detecting antibodies of the invention, comprising the steps of: (a) contacting a polypeptide of the invention with a biological sample (e.g. a blood or serum sample) under conditions suitable for the formation of an antibody-antigen complexes; and (b) detecting said complexes.

Preferred antibodies bind to a polypeptide of the invention with substantially greater affinity than antibodies known in the art. Preferably, the affinity is at least 1.5-fold, 2-fold, 5-fold 10-fold, 100-fold, $10^3$-fold, $10^4$-fold, $10^5$-fold, $10^6$-fold etc. stronger than antibodies known in the art.

Nucleic Acids

The invention also provides nucleic acid comprising a nucleotide sequence encoding the polypeptides of the invention (e.g. the odd-numbered SEQ ID NOs: 1 to 9989). The invention also provides nucleic acid comprising any one of SEQ ID NOs 9991 to 10273.

The invention also provides nucleic acid comprising nucleotide sequences having sequence identity to such nucleotide sequences. Identity between sequences is preferably determined by the Smith-Waterman homology search algorithm as described above. Depending on the particular sequence, the degree of sequence identity is preferably greater than 50% (e.g. 60%, 70%, 75%, 80%, 85%, 90%, 91%, 92%, 93%, 94%, 95%, 96%, 97%, 98%, 99% or more).

The invention also provides nucleic acid which can hybridize to these nucleic acids. Hybridization reactions can be performed under conditions of different "stringency". Conditions that increase stringency of a hybridization reaction of widely known and published in the art [e.g. page 7.52 of reference 34]. Examples of relevant conditions include (in order of increasing stringency): incubation temperatures of 25° C., 37° C., 50° C., 55° C. and 68° C.; buffer concentrations of 10×SSC, 6×SSC, 1×SSC, 0.1×SSC (where SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. Hybridization techniques and their optimization are well known in the art [e.g. see refs 34-37, etc.].

In some embodiments, nucleic acid of the invention hybridizes to a target under low stringency conditions; in other embodiments it hybridizes under intermediate stringency conditions; in preferred embodiments, it hybridizes under high stringency conditions. An exemplary set of low stringency hybridization conditions is 50° C. and 10×SSC. An exemplary set of intermediate stringency hybridization conditions is 55° C. and 1×SSC. An exemplary set of high stringency hybridization conditions is 68° C. and 0.1×SSC.

Nucleic acid comprising fragments of these sequences are also provided. These should comprise at least at consecutive nucleotides from the sequences and, depending on the particular sequence, n is 10 or more (e.g. 12, 14, 15, 18, 20, 25, 30, 35, 40, 50, 60, 70, 80, 90, 100, 150, 200 or more). Preferred fragments are those that are common to a nucleic acid sequence of the invention and to a nucleic acid sequence identified in any of references 5, 6, 8, 10 and 11.

The invention provides nucleic acid of formula 5'-X-Y-Z-3', wherein: -X- is a nucleotide sequence consisting of x nucleotides; -Z- is a nucleotide sequence consisting of z nucleotides; -Y- is a nucleotide sequence consisting of either (a) a fragment of a nucleic acid sequence selected from odd-numbered SEQ ID NOS: 1 to 9989, (b) a fragment of any one of SEQ ID NOs 9991 to 10273; (c) a fragment of SEQ ID NO: 10274; or (d) the complement of (a) or (b) or (c); and said nucleic acid 5'-X-Y-Z-3' is neither (i) a fragment of either an odd-numbered nucleic acid from SEQ ID NOS: 1 to 9989 or of SEQ ID NOs 9991 to 10273 or of SEQ ID NO: 10274, nor (ii) the complement of (i). The -X- and/or -Z- moieties may comprise a promoter sequence (or its complement).

The invention also provides nucleic acid comprising a fragment of at least n consecutive nucleotides from SEQ ID 10274, wherein n is 10 or more e.g. 12, 14, 15, 18, 20, 25, 30, 35, 40, 50, 60, 70, 80, 90, 100, 150, 200, 250, 300, 350, 400, 450, 500, 600, 700, 800, 900, 1000, 1500, 2000, 3000, 4000, 5000, 10000, 100000, 1000000 or more. This nucleic acid may be single-stranded, at least in part, such that it can act as a hybridisation probe and/or amplification primer. In some embodiments, the fragment is not, or does not include, a fragment of a prior art ExPEC sequence e.g. not a fragment of a nucleic acid sequence specifically disclosed in any of refs. 5, 6, 7, 8, 9, 10, 11 and 13. In other embodiments, the fragment is also a fragment of a prior art ExPEC sequence e.g. is identical to a fragment of a nucleic acid sequence specifically disclosed in any of refs. 5, 6, 7, 8, 9, 10, 11 and 13. The invention includes nucleic acid comprising sequences complementary to these sequences (e.g. for antisense or probing, or for use as primers).

Nucleic acids of the invention can be used in hybridisation reactions (e.g. Northern or Southern blots, or in nucleic acid microarrays or 'gene chips') and amplification reactions (e.g. PCR, SDA, SSSR, LCR, TMA, NASBA, etc.) and other nucleic acid techniques.

Nucleic acid according to the invention can take various forms (e.g. single-stranded, double-stranded, vectors, primers, probes, labelled etc.). Nucleic acids of the invention may be circular or branched, but will generally be linear. Unless otherwise specified or required, any embodiment of the invention that utilizes a nucleic acid may utilize both the double-stranded form and each of two complementary single-stranded forms which make up the double-stranded form. Primers and probes are generally single-stranded, as are antisense nucleic acids.

Nucleic acids of the invention are preferably provided in purified or substantially purified form i.e. substantially free from other nucleic acids (e.g. free from naturally-occurring nucleic acids), particularly from other ExPEC or host cell nucleic acids, generally being at least about 50% pure (by weight), and usually at least about 90% pure. Nucleic acids of the invention are preferably ExPEC nucleic acids.

Nucleic acids of the invention may be prepared in many ways e.g. by chemical synthesis (e.g. phosphoramidite synthesis of DNA) in whole or in part, by digesting longer nucleic acids using nucleases (e.g. restriction enzymes), by joining shorter nucleic acids or nucleotides (e.g. using ligases or polymerases), from genomic or cDNA libraries, etc.

Nucleic acid of the invention may be attached to a solid support (e.g. a bead, plate, filter, film, slide, microarray support, resin, etc.). Nucleic acid of the invention may be labelled e.g. with a radioactive or fluorescent label, or a biotin label. This is particularly useful where the nucleic acid is to be used in detection techniques e.g. where the nucleic acid is a primer or as a probe.

The term "nucleic acid" includes in general means a polymeric form of nucleotides of any length, which contain deoxyribonucleotides, ribonucleotides, and/or their analogs. It includes DNA, RNA, DNA/RNA hybrids. It also includes DNA or RNA analogs, such as those containing modified backbones (e.g. peptide nucleic acids (PNAs) or phosphorothioates) or modified bases. Thus the invention includes mRNA, tRNA, rRNA, ribozymes, DNA, cDNA, recombinant nucleic acids, branched nucleic acids, plasmids, vectors, probes, primers, etc. Where nucleic acid of the invention takes the form of RNA, it may or may not have a 5' cap.

Nucleic acids of the invention comprise sequences, but they may also comprise non-ExPEC sequences (e.g. in nucleic acids of formula 5'-X-Y-Z-3', as defined above). This is particularly useful for primers, which may thus comprise a first sequence complementary to a nucleic acid target and a second sequence which is not complementary to the nucleic acid target. Any such non-complementary sequences in the primer are preferably 5' to the complementary sequences. Typical non-complementary sequences comprise restriction sites or promoter sequences.

Nucleic acids of the invention can be prepared in many ways e.g. by chemical synthesis (at least in part), by digesting longer nucleic acids using nucleases (e.g. restriction enzymes), by joining shorter nucleic acids (e.g. using ligases or polymerases), from genomic or cDNA libraries, etc.

Nucleic acids of the invention may be part of a vector i.e. part of a nucleic acid construct designed for transduction/transfection of one or more cell types. Vectors may be, for example, "cloning vectors" which are designed for isolation, propagation and replication of inserted nucleotides, "expression vectors" which are designed for expression of a nucleotide sequence in a host cell, "viral vectors" which is designed to result in the production of a recombinant virus or virus-like particle, or "shuttle vectors", which comprise the attributes of more than one type of vector. Preferred vectors are plasmids. A "host cell" includes an individual cell or cell culture which can be or has been a recipient of exogenous nucleic acid. Host cells include progeny of a single host cell, and the progeny may not necessarily be completely identical (in morphology or in total DNA complement) to the original parent cell due to natural, accidental, or deliberate mutation and/or change. Host cells include cells transfected or infected in vivo or in vitro with nucleic acid of the invention.

Where a nucleic acid is DNA, it will be appreciated that "U" in a RNA sequence will be replaced by "T" in the DNA. Similarly, where a nucleic acid is RNA, it will be appreciated that "T" in a DNA sequence will be replaced by "U" in the RNA.

The term "complement" or "complementary" when used in relation to nucleic acids refers to Watson-Crick base pairing. Thus the complement of C is G, the complement of G is C, the complement of A is T (or U), and the complement of T (or U) is A. It is also possible to use bases such as I (the purine inosine) e.g. to complement pyrimidines (C or T). The terms also imply a direction—the complement of 5'-ACAGT-3' is 5'-ACTGT-3' rather than 5'-TGTCA-3'.

Nucleic acids of the invention can be used, for example: to produce polypeptides; as hybridization probes for the detection of nucleic acid in biological samples; to generate additional copies of the nucleic acids; to generate ribozymes or antisense oligonucleotides; as single-stranded DNA primers or probes; or as triple-strand forming oligonucleotides.

The invention provides a process for producing nucleic acid of the invention, wherein the nucleic acid is synthesised in part or in whole using chemical means.

The invention provides vectors comprising nucleotide sequences of the invention (e.g. cloning or expression vectors) and host cells transformed with such vectors.

The invention also provides a kit comprising primers (e.g. PCR primers) for amplifying a template sequence contained within an ExPEC nucleic acid sequence, the kit comprising a first primer and a second primer, wherein the first primer is substantially complementary to said template sequence and the second primer is substantially complementary to a complement of said template sequence, wherein the parts of said primers which have substantial complementarity define the termini of the template sequence to be amplified. The first primer and/or the second primer may include a detectable label (e.g. a fluorescent label).

The invention also provides a kit comprising first and second single-stranded oligonucleotides which allow amplification of a ExPEC template nucleic acid sequence contained in a single- or double-stranded nucleic acid (or mixture thereof), wherein: (a) the first oligonucleotide comprises a primer sequence which is substantially complementary to said template nucleic acid sequence; (b) the second oligonucleotide comprises a primer sequence which is substantially complementary to the complement of said template nucleic acid sequence; (c) the first oligonucleotide and/or the second oligonucleotide comprise(s) sequence which is not complementary to said template nucleic acid; and (d) said primer sequences define the termini of the template sequence to be amplified. The non-complementary sequence(s) of feature (c) are preferably upstream of (i.e. 5' to) the primer sequences. One or both of these (c) sequences may comprise a restriction site [e.g. ref. 38] or a promoter sequence [e.g. 39]. The first oligonucleotide and/or the second oligonucleotide may include a detectable label (e.g. a fluorescent label).

The template sequence may be any part of a genome sequence (e.g. SEQ ID NO: 10274). For example, it could be a rRNA gene (e.g. Turenne et al. (2000) *J. Clin. Microbiol.* 38:513-520) or a protein-coding gene. The template sequence is preferably specific to ExPEC, and more preferably to MNEC.

The invention also provides a computer-readable medium (e.g. a floppy disk, a hard disk, a CD-ROM, a DVD etc.) and/or a computer database containing one or more of the sequences in the sequence listing. The medium preferably contains SEQ ID NO: 10274.

The invention provides a process for detecting nucleic acid of the invention, comprising the steps of: (a) contacting a nucleic probe according to the invention with a biological sample under hybridising conditions to form duplexes; and (b) detecting said duplexes.

The invention provides a process for detecting in a biological sample (e.g. blood), comprising the step of contacting nucleic acid according to the invention with the biological sample under hybridising conditions. The process may involve nucleic acid amplification (e.g. PCR, SDA, SSSR, LCR, TMA, NASBA, etc.) or hybridisation (e.g. microarrays, blots, hybridisation with a probe in solution etc.). PCR detection of ExPEC in clinical samples has been reported [e.g. see ref. 40]. Clinical assays based on nucleic acid are described in general in ref. 41.

The invention provides a process for preparing a fragment of a target sequence, wherein the fragment is prepared by extension of a nucleic acid primer. The target sequence and/or the primer are nucleic acids of the invention. The primer extension reaction may involve nucleic acid amplification (e.g. PCR, SDA, SSSR, LCR, TMA, NASBA, etc.).

Nucleic acid amplification according to the invention may be quantitative and/or real-time.

For certain embodiments of the invention, nucleic acids are preferably at least 7 nucleotides in length (e.g. 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 90, 100, 110, 120, 130, 140, 150, 160, 170, 180, 190, 200, 225, 250, 275, 300 nucleotides or longer).

For certain embodiments of the invention, nucleic acids are preferably at most 500 nucleotides in length (e.g. 450, 400, 350, 300, 250, 200, 150, 140, 130, 120, 110, 100, 90, 80, 75, 70, 65, 60, 55, 50, 45, 40, 39, 38, 37, 36, 35, 34, 33, 32, 31, 30, 29, 28, 27, 26, 25, 24, 23, 22, 21, 20, 19, 18, 17, 16, 15 nucleotides or shorter).

Primers and probes of the invention, and other nucleic acids used for hybridization, are preferably between 10 and 30 nucleotides in length (e.g. 10, 11, 12, 13, 14, 15, 16, 17, 18, 19, 20, 21, 22, 23, 24, 25, 26, 27, 28, 29, or 30 nucleotides).

Mutant Bacteria

The invention provides a *E. coli* bacterium in which expression of one or more of the genes identified herein has been knocked out. Techniques for gene knockout are well known, and knockout mutants of *E. coli* have been reported previously.

The knockout is preferably achieved using isogenic deletion of the coding region, but any other suitable technique may be used e.g. deletion or mutation of the promoter, deletion or mutation of the start codon, antisense inhibition, inhibitory RNA, etc. In the resulting bacterium, however, mRNA encoding the gene product will be absent and/or its translation will be inhibited (e.g. to less than 1% of wild-type levels).

The bacterium may contain a marker gene in place of the knocked out gene e.g. an antibiotic resistance marker.

Vesicles

Reference 42 describes the preparation of vesicles from a MNEC strain by the knockout of mltA (a murein lytic transglycosylase) or one or more of the components of the *E. coli* Tol-Pal complex [43], such as tolA, tolQ, tolB, pal and/or tolR. These vesicles can be improved by making one or more further genetic changes to the chromosome of the bacterium or through insertion of "ad-hoc" episomalic elements (e.g. expression vectors) in order to increase the amount of and/or immunoaccessibility "exposure" of protective antigens on the surface the vesicles.

One way of obtaining such improvements is to up-regulate the expression of the polypeptides protective antigens of the invention. Many different genetic strategies for increasing the expression of a target protein are well-known in the art and can be distinguished into two broad categories: one relying on modifications of the chromosome (e.g. replacement of the wild-type promoter with a stronger promoter, inactivation of natural repressor genes, etc.) to increase expression of an endogenous gene, and the other based on recombinant expression by episomalic elements (e.g. high-copy number plasmids, vectors harboring an engineered target gene, etc.) or integration of a exogenous protective target gene in the chromosome. Practical examples for each of these approaches can be found in references 44 to 50.

Another way of increasing vesicle immunogenicity and selectivity is to down-regulate the expression of immunodominant non-protective antigens or to down-regulate proteins that are homologous to proteins found in commensal strains. Further improvements can be achieved sought by reducing the potential vesicle toxicity through detoxification of the Lipid A moiety of LPS. Similar changes have been previously described to produce improved vesicles from other Gram-negative pathogens (see for example references 51 & 52).

All the above strategies can be used either alone or in combination to obtain improved vesicles for use in immunogenic compositions. The invention provides a pathogenic *Escherichia coli* bacterium (particularly a MNEC) having a knockout of mltA and/or of a component of its Tol-Pal complex, and one or more of: (i) a chromosomal gene encoding a polypeptide of the invention under the control of a promoter that provides higher expression levels of the polypeptide than the promoter that is naturally associated with the gene encoding the polypeptide; (ii) an autonomously-replicating extrachromosomal element encoding a polypeptide of the invention; and/or (iii) a genetic modification to reduce the toxicity of the Lipid A moiety of *E. coli* LPS relative to wild-type LPS.

The invention also provides vesicles obtainable by culturing such a bacterium, such as the vesicles that, during culture of the bacterium, are released into the culture medium.

Pharmaceutical Compositions

The invention provides compositions comprising: (a) polypeptide, antibody, vesicles, and/or nucleic acid of the invention; and (b) a pharmaceutically acceptable carrier. These compositions may be suitable as immunogenic compositions, for instance, or as diagnostic reagents, or as vaccines. Vaccines according to the invention may either be prophylactic (i.e. to prevent infection) or therapeutic (i.e. to treat infection), but will typically be prophylactic.

In a particular aspect, the invention provides immunogenic compositions comprising one or more outer membrane vesicles (OMVs) expressing or overexpressing one or more polypeptides encoded by: (a) a nucleotide sequence selected from the group consisting of SEQ ID NOs 511, 2453, 2455, 2677, 2691, 4595, 4747, 7003, 7051, 8167, 4627 and 5699; (b) a nucleotide sequence having at least 80% sequence identity to an amino acid sequence of (a); (c) a nucleotide sequence which is a fragment of at least 10 consecutive nucleotides from a nucleotide sequence of (a); or (d) a nucleotide sequence having at least 80% sequence identity to a nucleotide sequence of (a) and including a fragment of at least 10 consecutive nucleotides from a nucleotide sequence of (a).

In another aspect, the invention provides immunogenic compositions comprising one or more outer membrane vesicles (OMVs) expressing or overexpressing one or more polypeptides encoded by: (a) a nucleotide sequence selected from the group consisting of SEQ ID Nos 8563, 2727, 9871, 4671, 5679, 533, 3221, 3225 and 7003; (b) a nucleotide sequence having at least 80% sequence identity to an amino acid sequence of (a); (c) a nucleotide sequence which is a fragment of at least 10 consecutive nucleotides from a nucleotide sequence of (a); or (d) a nucleotide sequence having at least 80% sequence identity to a nucleotide sequence of (a) and including a fragment of at least 10 consecutive nucleotides from a nucleotide sequence of (a).

A 'pharmaceutically acceptable carrier' includes any carrier that does not itself induce the production of antibodies harmful to the individual receiving the composition. Suitable carriers are typically large, slowly metabolised macromolecules such as proteins, polysaccharides, polylactic acids, polyglycolic acids, polymeric amino acids, amino acid copolymers, sucrose, trehalose, lactose, and lipid aggregates (such as oil droplets or liposomes). Such carriers are well known to those of ordinary skill in the art. The vaccines may also contain diluents, such as water, saline, glycerol, etc. Additionally, auxiliary substances, such as wetting or emulsifying agents, pH buffering substances, and the like, may be present. Sterile pyrogen-free, phosphate-buffered physiologic saline is a typical carrier. A thorough discussion of pharmaceutically acceptable excipients is available in ref. 289.

Compositions of the invention may include an antimicrobial, particularly if packaged in a multiple dose format.

Compositions of the invention may comprise detergent e.g. a Tween (polysorbate), such as Tween 80. Detergents are generally present at low levels e.g. <0.01%.

Compositions of the invention may include sodium salts (e.g. sodium chloride) to give tonicity. A concentration of 10±2 mg/ml NaCl is typical.

Compositions of the invention will generally include a buffer. A phosphate buffer is typical.

Compositions of the invention may comprise a sugar alcohol (e.g. mannitol) or a disaccharide (e.g. sucrose or trehalose) e.g. at around 15-30 mg/ml (e.g. 25 mg/ml), particularly if they are to be lyophilised or if they include material which has been reconstituted from lyophilised material. The pH of a composition for lyophilisation may be adjusted to around 6.1 prior to lyophilisation.

Polypeptides of the invention may be administered in conjunction with other immunoregulatory agents. In particular, compositions will usually include a vaccine adjuvant. The adjuvant may be selected from one or more of the group consisting of a TH1 adjuvant and TH2 adjuvant, farther discussed below. Adjuvants which may be used in compositions of the invention include, but are not limited to:

A. Mineral-Containing Compositions

Mineral containing compositions suitable for use as adjuvants in the invention include mineral salts, such as aluminium salts and calcium salts. The invention includes mineral salts such as hydroxides (e.g. oxyhydroxides), phosphates (e.g. hydroxyphosphates, orthophosphates), sulphates, etc. [e.g. see chapters 8 & 9 of ref. 53], or mixtures of different mineral compounds (e.g. a mixture of a phosphate and a hydroxide adjuvant, optionally with an excess of the phosphate), with the compounds taking any suitable form (e.g. gel, crystalline, amorphous, etc.), and with adsorption to the salt(s) being preferred. Mineral containing compositions may also be formulated as a particle of metal salt [54].

Aluminum salts may be included in vaccines of the invention such that the dose of $Al^{3+}$ is between 0.2 and 1.0 mg per dose.

In another embodiment the adjuvant of the invention comprises both aluminum phosphate and aluminum hydroxide. In a more particular embodiment thereof, the adjuvant has a greater amount of aluminum phosphate than aluminum hydroxide, such as a ratio of 2:1, 3:1, 4:1, 5:1, 6:1, 7:1, 8:1, 9:1 or greater than 9:1, by weight aluminum phosphate to aluminum hydroxide. More particular still, aluminum salts in the vaccine are present at 0.4 to 1.0 mg per vaccine dose, or 0.4 to 0.8 mg per vaccine dose, or 0.5 to 0.7 mg per vaccine dose, or about 0.6 mg per vaccine dose.

Generally, the preferred aluminum-based adjuvant(s), or ratio of multiple aluminum-based adjuvants, such as aluminum phosphate to aluminum hydroxide is selected by optimization of electrostatic attraction between molecules such that the antigen carries an opposite charge as the adjuvant at the desired pH. For example, an aluminum phosphate adjuvant with pI ~4 electrostatically adsorbs lysozyme, but not albumin, at pH 7.4. Should albumin be the target, aluminum hydroxide adjuvant would be selected (e.g. with pH 11.4). Alternatively, pre-treatment of aluminum hydroxide with phosphate lowers its pI, making it a preferred adjuvant for more basic antigens.

A typical aluminium phosphate adjuvant is amorphous aluminium hydroxyphosphate with $PO_4/Al$ molar ratio between 0.84 and 0.92, included at 0.6 mg $Al^{3+}$/ml. Adsorption with a low dose of aluminium phosphate may be used e.g. between 50 and 100 μg $Al^{3+}$ per conjugate per dose. Where an aluminium phosphate is used and it is desired not to adsorb an antigen to the adjuvant, this is favoured by including free phosphate ions in solution (e.g. by the use of a phosphate buffer).

B. Oil Emulsions

Oil emulsion compositions suitable for use as adjuvants in the invention include squalene-water emulsions, such as MF59 (5% Squalene, 0.5% Tween 80, and 0.5% Span 85, formulated into submicron particles using a microfluidizer) [Chapter 10 of ref. 53; see also refs. 55-57 chapter 12 of ref. 58.]. MF59 is used as the adjuvant in the FLUAD™ influenza virus trivalent subunit vaccine. The emulsion advantageously includes citrate ions e.g. 10 mM sodium citrate buffer.

Particularly preferred adjuvants for use in the compositions are submicron oil-in-water emulsions. Preferred submicron oil-in-water emulsions for use herein are squalene/water emulsions, optionally containing varying amounts of MTP-PE, such as a submicron oil-in-water emulsion containing 4-5% w/v squalene, 0.25-1.0% w/v Tween 80 (polyoxyethylenesorbitan monooleate), and/or 0.25-1.0% Span 85 (sorbitan trioleate), and, optionally, N-acetylmuramyl-L-alanyl-D-isogluatminyl-L-alanine-2-(1'-2'-dipalmitoyl-sn-glycero-3-hydroxyphosphophoryloxy)-ethylamine (MTP-PE). Submicron oil-in-water emulsions, methods of making the same and immunostimulating agents, such as muramyl peptides, for use in the compositions, are described in detail in references 55 & 59-60.

An emulsion of squalene, a tocopherol, and Tween 80 can be used. The emulsion may include phosphate buffered saline. It may also include Span 85 (e.g. at 1%) and/or lecithin. These emulsions may have from 2 to 10% squalene, from 2 to 10% tocopherol and from 0.3 to 3% Tween 80, and the weight ratio of squalene:tocopherol is preferably ≤1 as this provides a more stable emulsion. One such emulsion can be made by dissolving Tween 80 in PBS to give a 2% solution, then mixing 90 ml of this solution with a mixture of (5 g of DL-α-tocopherol and 5 ml squalene), then microfluidising the mixture. The resulting emulsion may have submicron oil droplets e.g. with an average diameter of between 100 and 250 nm, preferably about 180 nm.

An emulsion of squalene, a tocopherol, and a Triton detergent (e.g. Triton X-100) can be used.

An emulsion of squalane, polysorbate 80 and poloxamer 401 ("Pluronic™ L121") can be used. The emulsion can be formulated in phosphate buffered saline, pH 7.4. This emulsion is a useful delivery vehicle for muramyl dipeptides, and has been used with threonyl-MDP in the "SAF-1" adjuvant [61] (0.05-1% Thr-MDP, 5% squalane, 2.5% Pluronic L121 and 0.2% polysorbate 80). It can also be used without the Thr-MDP, as in the "AF" adjuvant [62] (5% squalane, 1.25% Pluronic L121 and 0.2% polysorbate 80). Microfluidisation is preferred.

Complete Freund's adjuvant (CFA) and incomplete Freund's adjuvant (IFA) may also be used as adjuvants in the invention.

C. Saponin Formulations [Chapter 22 of ref. 53]

Saponin formulations may also be used as adjuvants in the invention. Saponins are a heterologous group of sterol glycosides and triterpenoid glycosides that are found in the bark, leaves, stems, roots and even flowers of a wide range of plant species. Saponins isolated from the bark of the *Quillaia saponaria* Molina tree have been widely studied as adjuvants. Saponin can also be commercially obtained from *Smilax orizata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs.

Saponin compositions have been purified using HPLC and RP-HPLC. Specific purified fractions using these techniques have been identified, including QS7, QS17, QS18, QS21, QH-A, QH-B and QH-C. Preferably, the saponin is QS21. A method of production of QS21 is disclosed in ref 63. Saponin formulations may also comprise a sterol, such as cholesterol [64].

Combinations of saponins and cholesterols can be used to form unique particles called immunostimulating complexs (ISCOMs) [chapter 23 of ref. 53]. ISCOMs typically also include a phospholipid such as phosphatidylethanolamine or phosphatidylcholine. Any known saponin can be used in ISCOMs. Preferably, the ISCOM includes one or more of QuilA, QHA and QHC. ISCOMs are farther described in refs. 64-66. Optionally, the ISCOMS may be devoid of additional detergent(s) [67].

A review of the development of saponin based adjuvants can be found in refs. 68 & 69.

D. Virosomes and Virus-Like Particles

Virosomes and virus-like particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein p1). VLPs are discussed farther in refs. 70-75. Virosomes are discussed farther in, for example, ref. 76

E. Bacterial or Microbial Derivatives

Adjuvants suitable for use in the invention include bacterial or microbial derivatives such as non-toxic derivatives of enterobacterial lipopolysaccharide (LPS), Lipid A derivatives, immunostimulatory oligonucleotides and ADP-ribosylating toxins and detoxified derivatives thereof.

Non-toxic derivatives of LPS include monophosphoryl lipid A (MPL) and 3-O-deacylated MPL (3dMPL). 3dMPL is a mixture of 3 de-O-acylated monophosphoryl lipid A with 4, 5 or 6 acylated chains. A preferred "small particle" form of 3 De-O-acylated monophosphoryl lipid A is disclosed in ref. 77. Such "small particles" of 3dMPL are small enough to be sterile filtered through a 0.22 μm membrane [77]. Other non-toxic LPS derivatives include monophosphoryl lipid A mimics, such as aminoalkyl glucosaminide phosphate derivatives e.g. RC-529 [78,79].

Lipid A derivatives include derivatives of lipid A from *Escherichia coli* such as OM-174. OM-174 is described for example in refs. 80 & 81.

Immunostimulatory oligonucleotides suitable for use as adjuvants in the invention include nucleotide sequences containing a CpG motif (a dinucleotide sequence containing an unmethylated cytosine linked by a phosphate bond to a guanosine). Double-stranded RNAs and oligonucleotides containing palindromic or poly(dG) sequences have also been shown to be immunostimulatory.

The CpG's can include nucleotide modifications/analogs such as phosphorothioate modifications and can be double-stranded or single-stranded. References 82, 83 and 84 disclose possible analog substitutions e.g. replacement of guanosine with 2'-deoxy-7-deazaguanosine. The adjuvant effect of CpG oligonucleotides is further discussed in refs. 85-90.

The CpG sequence may be directed to TLR9, such as the motif GTCGTT or TTCGTT [91]. The CpG sequence may be specific for inducing a Th1 immune response, such as a CpG-A ODN, or it may be more specific for inducing a B cell response, such a CpG-B ODN. CpG-A and CpG-B ODNs are discussed in refs. 92-94. Preferably, the CpG is a CpG-A ODN.

Preferably, the CpG oligonucleotide is constructed so that the 5' end is accessible for receptor recognition. Optionally, two CpG oligonucleotide sequences may be attached at their 3" ends to form "immunomers". See, for example, refs. 91 & 95-97.

Other immunostimulatory oligonucleotides include a double-stranded RNA, or an oligonucleotide containing a palindromic sequence, or an oligonucleotide containing a poly(dG) sequence.

Bacterial ADP-ribosylating toxins and detoxified derivatives thereof may be used as adjuvants in the invention. Preferably, the protein is derived from *E. coli* (*E. coli* heat labile enterotoxin "LT"), cholera ("CT"), or pertussis ("PT"). The use of detoxified ADP-ribosylating toxins as mucosal adjuvants is described in ref. 98 and as parenteral adjuvants in ref. 99. The toxin or toxoid is preferably in the form of a holotoxin, comprising both A and B subunits. Preferably, the A subunit contains a detoxifying mutation; preferably the B subunit is not mutated. Preferably, the adjuvant is a detoxified LT mutant such as LT-K63, LT-R72, and LT-G192. The use of ADP-ribosylating toxins and detoxified derivatives thereof, particularly LT-K63 and LT-R72, as adjuvants can be found in refs. 100-107. Numerical reference for amino acid substitutions is preferably based on the alignments of the A and B subunits of ADP-ribosylating toxins set forth in ref. 108, specifically incorporated herein by reference in its entirety.

Compounds of formula I, II or III, or salts thereof, can also be used as adjuvants:

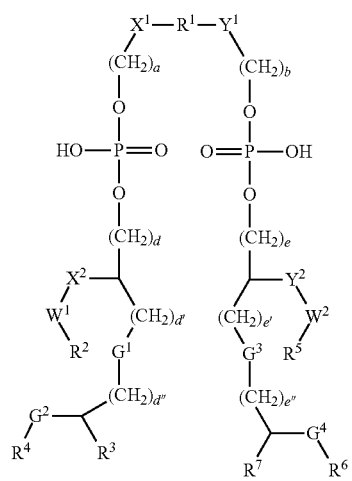

I

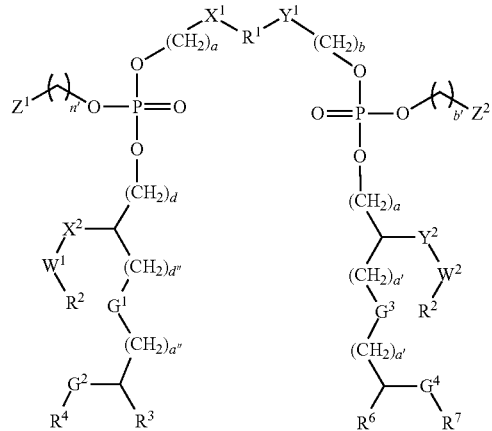

II

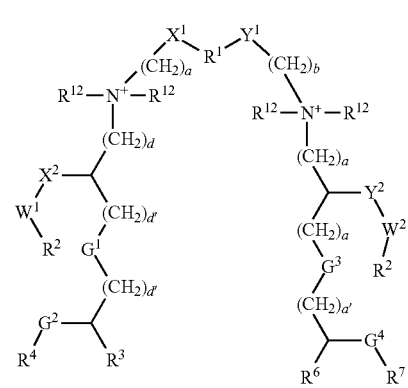

III as defined in reference 109, such as 'ER 803058', 'ER 803732', 'ER 804053', ER 804058', 'ER 804059', 'ER 804442', 'ER 804680', 'ER 804764', ER 803022 or 'ER 804057' e.g.:

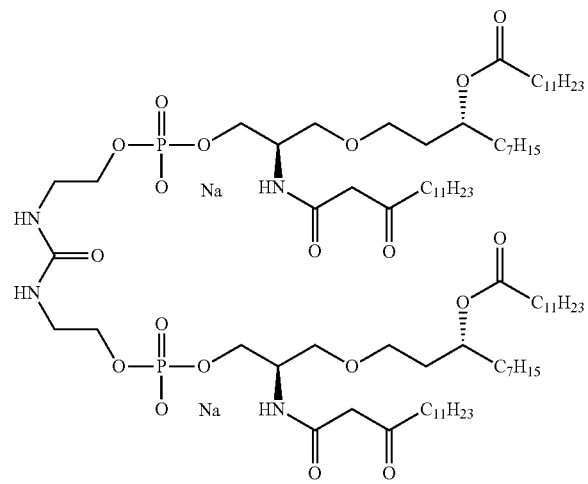

ER804057

ER-803022:

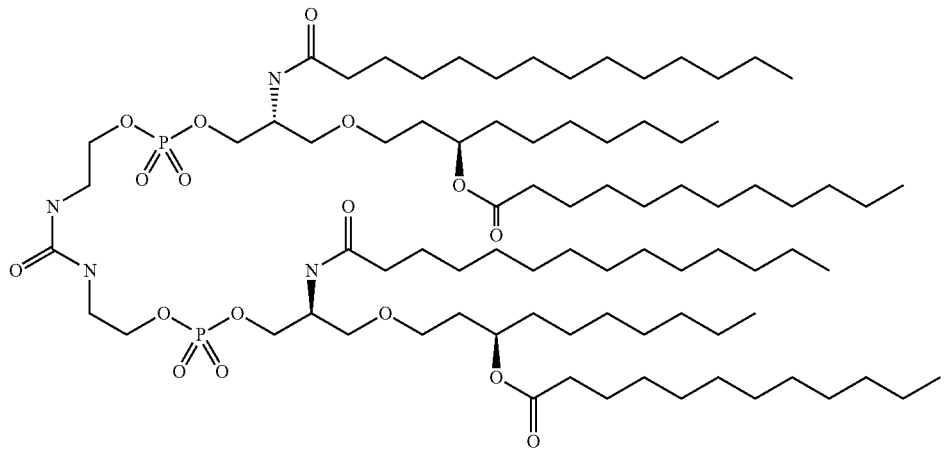

F. Human Immunomodulators

Human immunomodulators suitable for use as adjuvants in the invention include cytokines, such as interleukins (e.g. IL-1, IL-2, IL-4, IL-5, IL-6, IL-7, IL-12 [110], etc.) [111], interferons (e.g. interferon-γ), macrophage colony stimulating factor, tumor necrosis factor and macrophage inflammatory protein-1alpha (MIP-1alpha) and MIP-1beta [112].

G. Bioadhesives and Mucoadhesives

Bioadhesives and mucoadhesives may also be used as adjuvants in the invention. Suitable bioadhesives include esterified hyaluronic acid microspheres [113] or mucoadhesives such as cross-linked derivatives of poly(acrylic acid), polyvinyl alcohol, polyvinyl pyrollidone, polysaccharides and carboxymethylcellulose. Chitosan and derivatives thereof may also be used as adjuvants in the invention [114].

H. Microparticles

Microparticles may also be used as adjuvants in the invention. Microparticles (i.e. a particle of ~100 nm to ~150 μm in diameter, more preferably ~200 nm to ~30 μm in diameter, and most preferably ~500 nm to ~10 μm in diameter) formed from materials that are biodegradable and non-toxic (e.g. a poly(α-hydroxy acid), a polyhydroxybutyric acid, a polyorthoester, a polyanhydride, a polycaprolactone, etc.), with poly(lactide-co-glycolide) are preferred, optionally treated to have a negatively-charged surface (e.g. with SDS) or a positively-charged surface (e.g. with a cationic detergent, such as CTAB).

I. Liposomes (Chapters 13 & 14 of ref. 53)

Examples of liposome formulations suitable for use as adjuvants are described in refs. 115-117.

J. Polyoxyethylene Ether and Polyoxyethylene Ester Formulations

Adjuvants suitable for use in the invention include polyoxyethylene ethers and polyoxyethylene esters [118]. Such formulations further include polyoxyethylene sorbitan ester surfactants in combination with an octoxynol [119] as well as polyoxyethylene alkyl ethers or ester surfactants in combination with at least one additional non-ionic surfactant such as an octoxynol [120]. Preferred polyoxyethylene ethers are selected from the following group: polyoxyethylene-9-lauryl ether (laureth 9), polyoxyethylene-9-steoryl ether, polyoxytheylene-8-steoryl ether, polyoxyethylene-4-lauryl ether, polyoxyethylene-35-lauryl ether, and polyoxyethylene-23-lauryl ether.

K. Phosphazenes e.g. PCPP

Phosphazene adjuvants include poly[di(carboxylatophenoxy)phosphazene] ("PCPP") as described, for example, in refs. 121 and 122.

L. Muramyl Peptides

Examples of muramyl peptides suitable for use as adjuvants in the invention include N-acetyl-muramyl-L-threonyl-D-isoglutamine (thr-MDP), N-acetyl-normuramyl-L-alanyl-D-isoglutamine (nor-MDP), and N-acetylmuramyl-L-alanyl-D-isoglutaminyl-L-alanine-2-(1'-2'-dipalmitoyl-sn-glycero-3-hydroxyphosphoryloxy)-ethylamine MTP-PE).

M. Imidazoquinoline Compounds.

Imidazoquinoline adjuvants include Imiquimod ("R-837") [123,124], Resiquimod ("R-848") [125], and their analogs; and salts thereof (e.g. the hydrochloride salts). Further details about immunostimulatory imidazoquinolines can be found in references 126 to 130.

N. Thiosemicarbazone Compounds.

Examples of thiosemicarbazone compounds, as well as methods of formulating, manufacturing, and screening for compounds all suitable for use as adjuvants in the invention include those described in ref. 131. The thiosemicarbazones are particularly effective in the stimulation of human peripheral blood mononuclear cells for the production of cytokines, such as TNF-α.

O. Tryptanthrin Compounds.

Examples of tryptanthrin compounds, as well as methods of formulating, manufacturing, and screening for compounds all suitable for use as adjuvants in the invention include those described in ref. 132. The tryptanthrin compounds are particularly effective in the stimulation of human peripheral blood mononuclear cells for the production of cytokines, such as TNF-α.

P. Nucleoside Analogs

Various nucleoside analogs can be used as adjuvants, such as (a) Isatorabine (ANA-245; 7-thia-8-oxoguanosine):

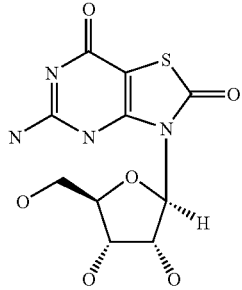 [SMILES: Nc1nc(=O)c2sc(=O)n([C@@H]3O[C@H](CO)[C@@H](O)[C@H]3O)c2[nH]1]

and prodrugs thereof; (b) ANA975; (c) ANA-025-1; (d) ANA380; (e) the compounds disclosed in references 133 to 135; (f) a compound having the formula:

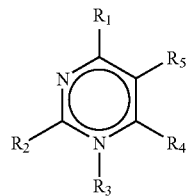

wherein:
- $R_1$ and $R_2$ are each independently H, halo, —$NR_aR_b$, —OH, $C_{1-6}$ alkoxy, substituted $C_{1-6}$ alkoxy, heterocyclyl, substituted heterocyclyl, $C_{6-10}$ aryl, substituted $C_{6-10}$ aryl, $C_{1-6}$ alkyl, or substituted $C_{1-6}$ alkyl;
- $R_3$ is absent, H, $C_{1-6}$ alkyl, substituted $C_{1-6}$ alkyl, $C_{6-10}$ aryl, substituted $C_{6-10}$ aryl, heterocyclyl, or substituted heterocyclyl;
- $R_4$ and $R_5$ are each independently H, halo, heterocyclyl, substituted heterocyclyl, —C(O)—$R_d$, $C_{1-6}$ alkyl, substituted $C_{1-6}$ alkyl, or bound together to form a 5 membered ring as in $R_{4-5}$:

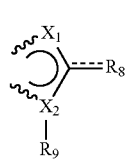

the binding being achieved at the bonds indicated by a ⌇

- $X_1$ and $X_2$ are each independently N, C, O, or S;
- $R_8$ is H, halo, —OH, $C_{1-6}$ alkyl, $C_{2-6}$ alkenyl, $C_{2-6}$ alkynyl, —OH, —$NR_aR_b$, —$(CH_2)_n$—O—$R_c$, —O—($C_{1-6}$ alkyl), —$S(O)_pR_e$, or —C(O)—$R_d$;
- $R_9$ is H, $C_{1-6}$ alkyl, substituted $C_{1-6}$ alkyl, heterocyclyl, substituted heterocyclyl or $R_{9a}$, wherein $R_{9a}$ is:

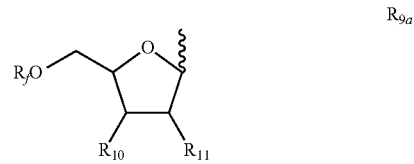

the binding being achieved at the bond indicated by a ⌇

- $R_{10}$ and $R_{11}$ are each independently H, halo, $C_{1-6}$ alkoxy, substituted $C_{1-6}$ alkoxy, —$NR_aR_b$, or —OH;
- each $R_a$ and $R_b$ is independently H, $C_{1-6}$ alkyl, substituted $C_{1-6}$ alkyl, —C(O)$R_d$, $C_{6-10}$ aryl;
- each $R_c$ is independently H, phosphate, diphosphate, triphosphate, $C_{1-6}$ alkyl, or substituted $C_{1-6}$ alkyl;
- each $R_d$ is independently H, halo, $C_{1-6}$ alkyl, substituted $C_{1-6}$ alkyl, $C_{1-6}$ alkoxy, substituted $C_{1-6}$ alkoxy, —$NH_2$, —NH($C_{1-6}$ alkyl), —NH(substituted $C_{1-6}$ alkyl), —N($C_{1-6}$ alkyl)$_2$, —N(substituted $C_{1-6}$ alkyl)$_2$, $C_{6-10}$ aryl, or heterocyclyl;
- each $R_e$ is independently H, $C_{1-6}$ alkyl, substituted $C_{1-6}$ alkyl, $C_{6-10}$ aryl, substituted $C_{6-10}$ aryl, heterocyclyl, or substituted heterocyclyl;
- each $R_f$ is independently H, $C_{1-6}$ alkyl, substituted $C_{1-6}$ alkyl, —C(O)$R_d$, phosphate, diphosphate, or triphosphate;
- each n is independently 0, 1, 2, or 3;
- each p is independently 0, 1, or 2; or or (g) a pharmaceutically acceptable salt of any of (a) to (f), a tautomer of any of (a) to (f, or a pharmaceutically acceptable salt of the tautomer.

Q. Lipids Linked to a Phosphate-Containing Acyclic Backbone

Adjuvants containing lipids linked to a phosphate-containing acyclic backbone include the TLR4 antagonist E5564 [136,137]:

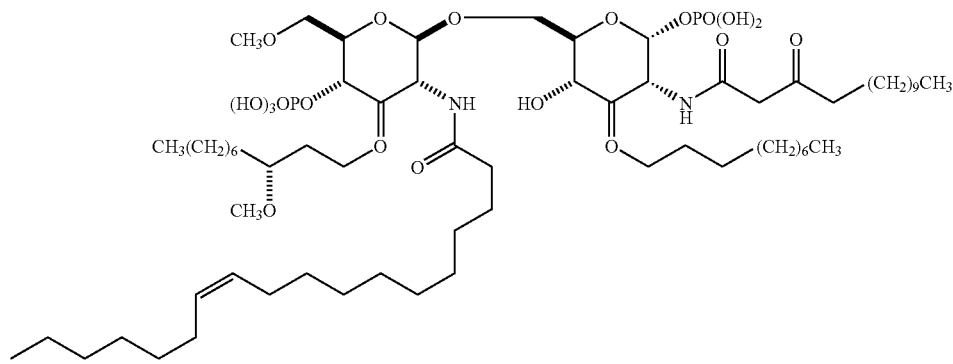

R. Small Molecule Immunopotentiators (SMIPs)

SMIPs include:

N2-methyl-1-(2-methylpropyl)-1H-imidazo[4,5-c]quinoline-2,4-diamine;
N2,N2-dimethyl-1-(2-methylpropyl)-1H-imidazo[4,5-c]quinoline-2,4-diamine;
N2-ethyl-N2-methyl-1-(2-methylpropyl)-1H-imidazo[4,5-c]quinoline-2,4-diamine;
N2-methyl-1-(2-methylpropyl)-N2-propyl-1H-imidazo[4,5-c]quinoline-2,4-diamine;
1-(2-methylpropyl)-N2-propyl-1H-imidazo[4,5-c]quinoline-2,4-diamine;
N2-butyl-1-(2-methylpropyl)-1H-imidazo[4,5-c]quinoline-2,4-diamine;
N2-butyl-N2-methyl-1-(2-methylpropyl)-1H-imidazo[4,5-c]quinoline-2,4-diamine;
N2-methyl-1-(2-methylpropyl)-N2-pentyl-1H-imidazo[4,5-c]quinoline-2,4-diamine;
N2-methyl-1-(2-methylpropyl)-N2-prop-2-enyl-1H-imidazo[4,5-c]quinoline-2,4-diamine;
1-(2-methylpropyl)-2-[(phenylmethyl)thio]-1H-imidazo[4,5-c]quinolin-4-amine;
1-(2-methylpropyl)-2-(propylthio)-1H-imidazo[4,5-c]quinolin-4-amine;
2-[[4-amino-1-(2-methylpropyl)-1H-imidazo[4,5-c]quinolin-2-yl](methyl)amino]ethanol;
2-[[4-amino-1-(2-methylpropyl)-1H-imidazo[4,5-c]quinolin-2-yl](methyl)amino]ethyl acetate;
4-amino-1-(2-methylpropyl)-1,3-dihydro-2H-imidazo[4,5-c]quinolin-2-one;
N2-butyl-1-(2-methylpropyl)-N4,N4-bis(phenylmethyl)-1H-imidazo[4,5-c]quinoline-2,4-diamine;
N2-butyl-N2-methyl-1-(2-methylpropyl)-N4,N4-bis(phenylmethyl)-1H-imidazo[4,5-c]quinoline-2,4-diamine;
N2-methyl-1-(2-methylpropyl)-N4,N4-bis(phenylmethyl)-1H-imidazo[4,5-c]quinoline-2,4-diamine;
N2,N2-dimethyl-1-(2-methylpropyl)-N4,N4-bis(phenylmethyl)-1H-imidazo[4,5-c]quinoline-2,4-diamine;
1-{4-amino-2-[methyl(propyl)amino]-1H-imidazo[4,5-c]quinolin-1-yl}-2-methylpropan-2-ol;
1-[4-amino-2-(propylamino)-1H-imidazo[4,5-c]quinolin-1-yl]-2-methylpropan-2-ol;
N4,N4-dibenzyl-1-(2-methoxy-2-methylpropyl)-N2-propyl-1H-imidazo[4,5-c]quinoline-2,4-diamine.

S. Proteosomes

One adjuvant is an outer membrane protein proteosome preparation prepared from a first Gram-negative bacterium in combination with a liposaccharide preparation derived from a second Gram-negative bacterium, wherein the outer membrane protein proteosome and liposaccharide preparations form a stable non-covalent adjuvant complex. Such complexes include "IVX-908", a complex comprised of *Neisseria meningitidis* outer membrane and lipopolysaccharides. They have been used as adjuvants for influenza vaccines [138].

T. Other Adjuvants

Other substances that act as immunostimulating agents are disclosed in chapter 7 of ref. 53. references 53 and 58. Further useful adjuvant substances include:

Methyl inosine 5'-monophosphate ("MIMP") [139].

A polyhydroxlated pyrrolizidine compound [140], such as one having formula:

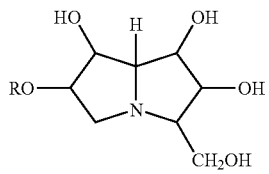

where R is selected from the group comprising hydrogen, straight or branched, unsubstituted or substituted, saturated or unsaturated acyl, alkyl (e.g. cycloalkyl), alkenyl, alkynyl and aryl groups, or a pharmaceutically acceptable salt or derivative thereof. Examples include, but are not limited to: casuarine, casuarine-6-α-D-glucopyranose, 3-epi-casuarine, 7-epi-casuarine, 3,7-diepi-casuarine, etc.

A gamma inulin [141] or derivative thereof, such as algammulin.

Compounds disclosed in reference 142.

Compounds disclosed in reference 143, including: Acylpiperazine compounds, Indoledione compounds, Tetrahydraisoquinoline (THIQ) compounds, Benzocyclodione compounds, Aminoazavinyl compounds, Aminobenzimidazole quinolinone (ABIQ) compounds [144,145], Hydrapthalamide compounds, Benzophenone compounds, Isoxazole compounds, Sterol compounds, Quinazilinone compounds, Pyrrole compounds [146], Anthraquinone compounds, Quinoxaline compounds, Triazine compounds, Pyrazalopyrimidine compounds, and Benzazole compounds [147].

Loxoribine (7-allyl-8-oxoguanosine) [148].

A formulation of a cationic lipid and a (usually neutral) co-lipid, such as aminopropyl-dimethyl-myristoleyloxy-propanaminium bromide-diphytanoylphosphatidyl-ethanolamine ("Vaxfectin™") or aminopropyl-dimethyl-bis-dodecyloxy-propanaminium bromide-dioleoylphosphatidyl-ethanolamine ("GAP-DLRIE: DOPE"). Formulations containing (±)-N-(3-aminopropyl)-N,N-dimethyl-2,3-bis(syn-9-tetradeceneyloxy)-1-propanaminium salts are preferred [149].

The invention may also comprise combinations of one or more of the adjuvants identified above. For example, the following combinations may be used as adjuvant compositions in the invention: (1) a saponin and an oil-in-water emulsion [150]; (2) a saponin (e.g. QS21)+a non-toxic LPS derivative (e.g. 3dMPL) [151]; (3) a saponin (e.g. QS21)+a non-toxic LPS derivative (e.g. 3dMPL)+a cholesterol; (4) a saponin (e.g. QS21)+3dMPL+IL-12 (optionally+a sterol) [152]; (5) combinations of 3dMPL with, for example, QS21 and/or oil-in-water emulsions [153]; (6) SAF, containing 10% squalane, 0.4% Tween 80™, 5% pluronic-block polymer L121, and thr-MDP, either microfluidized into a submicron emulsion or vortexed to generate a larger particle size emulsion. (7) Ribi™ adjuvant system (RAS), (Ribi Immunochem) containing 2% squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); (8) one or more mineral salts (such as an aluminum salt)+a non-toxic derivative of LPS (such as 3dMPL); and (9) one or more mineral salts (such as an aluminum salt)+an immunostimulatory oligonucleotide (such as a nucleotide sequence including a CpG motif).

The compositions of the invention will preferably elicit both a cell mediated immune response as well as a humoral immune response in order to effectively address a uropathogenic infection. This immune response will preferably induce long lasting (e.g. neutralising) antibodies and a cell mediated immunity that can quickly respond upon exposure to MNEC-associated antigens.

Two types of T cells, CD4 and CD8 cells, are generally thought necessary to initiate and/or enhance cell mediated immunity and humoral immunity. CD8 T cells can express a CD8 co-receptor and are commonly referred to as cytotoxic T lymphocytes (CTLs). CD8 T cells are able to recognized or interact with antigens displayed on MHC Class I molecules. CD4 T cells can express a CD4 co-receptor and are commonly referred to as T helper cells. CD4 T cells are able to recognize antigenic peptides bound to MHC class II molecules. Upon interaction with a MHC class II molecule, the CD4 cells can secrete factors such as cytokines. These secreted cytokines can activate B cells, cytotoxic T cells, macrophages, and other cells that participate in an immune response. Helper T cells or CD4+ cells can be further divided into two functionally distinct subsets: TH1 phenotype and TH2 phenotypes which differ in their cytokine and effector function.

Activated TH1 cells enhance cellular immunity (including an increase in antigen-specific CTL production) and are therefore of particular value in responding to intracellular infections. Activated TH1 cells may secrete one or more of IL-2, IFN-γ, and TNF-β. A TH1 immune response may result in local inflammatory reactions by activating macrophages, NK (natural killer) cells, and CD8 cytotoxic T cells (CTLs). A TH1 immune response may also act to expand the immune response by stimulating growth of B and T cells with IL-12. TH1 stimulated B cells may secrete IgG2a.

Activated TH2 cells enhance antibody production and are therefore of particular value in responding to extracellular infections. Activated TH2 cells may secrete one or more of IL-4, IL-5, IL-6, and IL-10. A TH2 immune response may result in the production of IgG1, IgE, IgA and memory B cells for future protection.

An enhanced immune response may include one or more of an enhanced TH1 immune response and a TH2 immune response. An enhanced TH1 immune response may include one or more of an increase in CTLs, an increase in one or more of the cytokines associated with a TH1 immune response (such as IL-2, IFN-γ, and TNF-β), an increase in activated macrophages, an increase in NK activity, or an increase in the production of IgG2a. Preferably, the enhanced TH1 immune response will include an increase in IgG2a production. An enhanced TH2 immune response may include one or more of an increase in one or more of the cytokines associated with a TH2 immune response (such as IL-4, IL-5, IL-6 and IL-10), or an increase in the production of IgG1, IgE, IgA and memory B cells. Preferably, the enhanced TH2 immune response will include an increase in IgG1 production.

A TH1 immune response may be elicited using a TH1 adjuvant. A TH1 adjuvant will generally elicit increased levels of IgG2a production relative to immunization of the antigen without adjuvant. TH1 adjuvants suitable for use in the invention may include for example saponin formulations, virosomes and virus like particles, non-toxic derivatives of enterobacterial lipopolysaccharide (LPS), immunostimulatory oligonucleotides. Immunostimulatory oligonucleotides, such as oligonucleotides containing a CpG motif, are preferred TH1 adjuvants for use in the invention.

A TH2 immune response may be elicited using a TH2 adjuvant. A TH2 adjuvant will generally elicit increased levels of IgG1 production relative to immunization of the antigen without adjuvant. TH2 adjuvants suitable for use in the invention include, for example, mineral containing compositions, oil-emulsions, and ADP-ribosylating toxins and detoxified derivatives hereof. Mineral containing compositions, such as aluminium salts are preferred TH2 adjuvants for use in the invention.

Preferably, the invention includes a composition comprising a combination of a TH1 adjuvant and a TH2 adjuvant. Preferably, such a composition elicits an enhanced TH1 and an enhanced TH2 response i.e. an increase in the production of both IgG1 and IgG2a production relative to immunization without an adjuvant. Still more preferably, the composition comprising a combination of a TH1 and a TH2 adjuvant elicits an increased TH1 and/or an increased TH2 immune response relative to immunization with a single adjuvant (i.e. relative to immunization with a TH1 adjuvant alone or immunization with a TH2 adjuvant alone).

The immune response may be one or both of a TH1 immune response and a TH2 response. Preferably, immune response provides for one or both of an enhanced TH1 response and an enhanced TH2 response.

The enhanced immune response may be one or both of a systemic and a mucosal immune response. Preferably, the immune response provides for one or both of an enhanced systemic and an enhanced mucosal immune response. Preferably the mucosal immune response is a TH2 immune response. Preferably, the mucosal immune response includes an increase in the production of IgA.

The use of an aluminium hydroxide or aluminium phosphate adjuvant is particularly preferred, and antigens are generally adsorbed to these salts. Calcium phosphate is another preferred adjuvant.

The pH of compositions of the invention is preferably between 6 and 8, preferably about 7. Stable pH may be maintained by the use of a buffer. Where a composition comprises an aluminium hydroxide salt, it is preferred to use a histidine buffer [154]. The composition may be sterile and/or pyrogen-free. Compositions of the invention may be isotonic with respect to humans.

Compositions may be presented in vials, or they may be presented in ready-filled syringes. The syringes may be supplied with or without needles. A syringe will include a single dose of the composition, whereas a vial may include a single dose or multiple doses. Injectable compositions will usually be liquid solutions or suspensions. Alternatively, they may be presented in solid form (e.g. freeze-dried) for solution or suspension in liquid vehicles prior to injection.

Compositions of the invention may be packaged in unit dose form or in multiple dose form. For multiple dose forms, vials are preferred to pre-filled syringes. Effective dosage volumes can be routinely established, but a typical human dose of the composition for injection has a volume of 0.5 ml.

Where a composition of the invention is to be prepared extemporaneously prior to use (e.g. where a component is presented in lyophilised form) and is presented as a kit, the kit may comprise two vials, or it may comprise one ready filled syringe and one vial, with the contents of the syringe being used to reactivate the contents of the vial prior to injection.

Thus the invention provides for a kit comprising a first component and a second component, wherein: the first component comprises one or more polypeptide, antibody, vesicle and/or nucleic acid of the invention; and the second component comprises one or more of the following: instructions for administering a composition to a patient, a syringe or other delivery device, an adjuvant, and/or a pharmaceutically acceptable formulating solution.

The invention also provides a delivery device (e.g. a syringe) pre-filled with the immunogenic compositions of the invention.

Immunogenic compositions used as vaccines comprise an immunologically effective amount of antigen(s), as well as any other components, as needed. By 'immunologically effective amount', it is meant that the administration of that amount to an individual, either in a single dose or as part of a series, is effective for treatment or prevention. This amount varies depending upon the health and physical condition of the individual to be treated, age, the taxonomic group of individual to be treated (e.g. non-human primate, primate, etc.), the capacity of the individual's immune system to synthesise antibodies, the degree of protection desired, the formulation of the vaccine, the treating doctor's assessment of the medical situation, and other relevant factors. It is expected that the amount will fall in a relatively broad range that can be determined through routine trials, and a typical quantity of each meningococcal saccharide antigen per dose is between 1 μg and 10 mg per antigen.

Pharmaceutical Uses

The invention also provides a method of treating a patient, comprising administering to the patient a therapeutically effective amount of a composition of the invention. The patient may either be at risk from the disease themselves or may be a pregnant woman ('maternal immunisation' [155]).

The invention provides nucleic acid, polypeptide, vesicle or antibody of the invention for use as medicaments (e.g. as immunogenic compositions or as vaccines) or as diagnostic reagents. It also provides the use of nucleic acid, polypeptide, vesicle or antibody of the invention in the manufacture of: (i) a medicament for treating or preventing disease and/or infection caused by an ExPEC bacterium; (ii) a diagnostic reagent for detecting the presence of or of antibodies raised against an ExPEC bacterium; and/or (iii) a reagent which can raise antibodies against an ExPEC bacterium. Said ExPEC bacterium can be of any serotype or strain, but are preferably MNEC bacteria e.g. K1 serotype and/or B2 MLEE type.

The invention is useful for the prevention and/or treatment of diseases such as bacteremia, meningitis, a urinary tract infection, pyelonephritis and/or cystitis. The invention is particularly useful for the treatment of sepsis and/or meningitis The patient is preferably a human. The human may be a child (e.g. aged between 0 and 18 years, or between 0-5 years), may be an adolescent (e.g. aged 15-19), an adult (e.g. aged 19-54) or may be elderly (e.g. 55 years or older). Female adolescents and adults are a preferred group of patients. A vaccine intended for children or adolescents may also be administered to adults e.g. to assess safety, dosage, immunogenicity, etc.

Other possible patient animals include dogs, which may be carriers of ExPEC [156,157].

One way of checking efficacy of therapeutic treatment involves monitoring infection after administration of the composition of the invention. One way of checking efficacy of prophylactic treatment involves monitoring immune responses against an administered polypeptide after administration. Immunogenicity of compositions of the invention can be determined by administering them to test subjects (e.g. children 12-16 months age, or animal models e.g. a murine model) and then determining standard parameters including ELISA titres (GMT) of IgG. These immune responses will generally be determined around 4 weeks after administration of the composition, and compared to values determined before administration of the composition. Where more than one dose of the composition is administered, more than one post-administration determination may be made. Efficacy may also be assessed using adult mice models of sepsis, mouse models of UTI, and passive protection from meningitis in infant rats.

Administration of polypeptide antigens is a preferred method of treatment for inducing immunity. Administration of antibodies of the invention is another preferred method of treatment. This method of passive immunisation is particularly useful for newborn children or for pregnant women. This method will typically use monoclonal antibodies, which will be humanised or fully human.

Compositions of the invention will generally be administered directly to a patient. Direct delivery may be accomplished by parenteral injection (e.g. subcutaneously, intraperitoneally, intravenously, intramuscularly, or to the interstitial space of a tissue), or by rectal, oral (e.g. tablet, spray), vaginal, topical, transdermal, transcutaneous, intranasal, sublingual, ocular, aural, pulmonary or other mucosal administration. Intramuscular administration to the thigh or the upper arm is preferred. Injection may be via a needle (e.g. a hypodermic needle), but needle-free injection may alternatively be used. A typical intramuscular dose is 0.5 ml.

The invention may be used to elicit systemic and/or mucosal immunity. Preferably the enhanced systemic and/or mucosal immunity is reflected in an enhanced TH1 and/or TH2 immune response. Preferably, the enhanced immune response includes an increase in the production of IgG1 and/or IgG2a and/or IgA.

Dosage treatment can be a single dose schedule or a multiple dose schedule. Multiple doses may be used in a primary immunisation schedule and/or in a booster immunisation schedule. A primary dose schedule may be followed by a booster dose schedule. In a multiple dose schedule the various doses may be given by the same or different routes e.g. a parenteral prime and mucosal boost, a mucosal prime and parenteral boost, etc. Suitable timing between priming doses (e.g. between 4-16 weeks), and between priming and boosting, can be routinely determined. For example, a primary course of vaccination may include 1-10 separate doses, followed by other doses given at subsequent time intervals required to maintain and/or reinforce an immune response, for example, at 1-4 months for a second dose, and if needed, a subsequent dose or doses after several months.

Bacterial infections affect various areas of the body and so compositions may be prepared in various forms. For example, the compositions may be prepared as injectables, either as liquid solutions or suspensions. Solid forms suitable for solution in, or suspension in, liquid vehicles prior to injection can also be prepared (e.g. a lyophilised or a spray-freeze dried composition). The composition may be prepared for topical administration e.g. as an ointment, cream or powder. The composition be prepared for oral administration e.g. as a tablet or capsule, as a spray, or as a syrup (optionally flavoured). The composition may be prepared for pulmonary administration e.g. as an inhaler, using a fine powder or a spray. The composition may be prepared as a suppository or pessary. The composition may be prepared for nasal, aural or ocular administration e.g. as spray, drops, gel or powder [e.g. refs 158 & 159]. The composition may be in kit form, designed such that a combined composition is reconstituted just prior to administration to a patient. Such kits may comprise one or more antigens in liquid form and one or more lyophilised antigens.

Compositions of the invention may be administered to patients at substantially the same time as (e.g. during the same medical consultation or visit to a healthcare professional) other vaccines e.g. at substantially the same time as a measles vaccine, a mumps vaccine, a rubella vaccine, a MMR vaccine, a varicella vaccine, a MMRV vaccine, a diphtheria vaccine, a tetanus vaccine, a pertussis vaccine, a DTP vaccine, a conjugated *H. influenzae* type b vaccine, a human papillomavirus vaccine, an inactivated poliovirus vaccine, a hepatitis B virus vaccine, a pneumococcal conjugate vaccine, a meningococcal conjugate vaccine, etc. Similarly they may be administered to patients at substantially the same time as (e.g. during the same medical consultation or visit to a healthcare professional) an antibiotic, and in particular an antibiotic compound active against MNEC.

Further Antigenic Components of Compositions of the Invention

The invention also provides a composition comprising a polypeptide or the invention and one or more of the following further antigens:

a saccharide antigen from *N. meningitidis* serogroup A, C, W135 and/or Y (preferably all four), such as the oligosaccharide disclosed in ref. 160 from serogroup C [see also ref. 161] or the oligosaccharides of ref. 162.

an antigen from *N. meningitidis* serogroup B such as those disclosed in refs. 163-171, etc.

a saccharide antigen from *Streptococcus pneumoniae* [e.g. 172, 173, 174].

an antigen from hepatitis A virus, such as inactivated virus [e.g. 175, 176].

an antigen from hepatitis B virus, such as the surface and/or core antigens [e.g. 176, 177].

a diphtheria antigen, such as a diphtheria toxoid [e.g. chapter 3 of ref. 178] e.g. the $CRM_{197}$ mutant [e.g. 179].

an antigen from hepatitis C virus [e.g. 180].

an antigen from HIV [181]

a tetanus antigen, such as a tetanus toxoid [e.g. chapter 4 of ref. 178].

an antigen from *Bordetella pertussis*, such as pertussis holotoxin (PT) and filamentous haemagglutinin (FHA) from *B. pertussis*, optionally also in combination with pertactin and/or agglutinogens 2 and 3 [e.g. refs. 182 & 183].

a saccharide antigen from *Haemophilus influenzae* B [e.g. 161].

polio antigen(s) [e.g. 184, 185] such as IPV.

measles, mumps and/or rubella antigens [e.g. chapters 9, 10 & 11 of ref. 178].

varicella antigens.

influenza antigen(s) [e.g. chapter 19 of ref. 178], such as the haemagglutinin and/or neuraminidase surface proteins. Influenza antigens may be derived from interpandemic (annual) flu strains. Influenza antigens may be derived from strains with the potential to cause a pandemic outbreak (i.e., influenza strains with new haemagglutinin compared to the haemagglutinin in currently circulating strains, or influenza strains which are pathogenic in avian subjects and have the potential to be transmitted horizontally in the human population, or influenza strains which are pathogenic to humans). Influenza antigens may be derived from viruses grown in eggs or cell culture.

an antigen from *Moraxella catarrhalis* [e.g. 186].

a saccharide antigen from *Streptococcus agalactiae* (group B streptococcus).

an protein antigen from *Streptococcus agalactiae* (group B streptococcus) [e.g. 187, 188].

an antigen from *N. gonorrhoeae* [e.g. 189-192].

an antigen from *Chlamydia pneumoniae* [e.g. refs. 193 to 199] or a combination of antigens from *C. pneumoniae* [e.g. 200].

an antigen from *Chlamydia trachomatis*, or a combination of antigens from *C. trachomatis* [e.g. 201].

an antigen from *Porphyromonas gingivalis* [e.g. 202].

rabies antigen(s) [e.g. 203] such as lyophilised inactivated virus [e.g. 204, RabAvert™].

antigen(s) from a paramyxovirus such as respiratory syncytial virus (RSV [205, 206]) and/or parainfluenza virus (PIV3 [207]).

an antigen from *Bacillus anthracis* [e.g. 208, 209, 210].

an antigen from *Streptococcus pyogenes* (group A streptococcus) [e.g. 188, 211, 212].

an antigen from *Staphylococcus aureus* [e.g. 213].

an antigen from a virus in the flaviviridae family (genus *flavivirus*), such as from yellow fever virus, Japanese encephalitis virus, four serotypes of Dengue viruses, tick-borne encephalitis virus, West Nile virus.

a pestivirus antigen, such as from classical porcine fever virus, bovine viral diarrhoea virus, and/or border disease virus.

a parvovirus antigen e.g. from parvovirus B19.

a human papilloma virus (HPV) antigen [214]

The composition may comprise one or more of these further antigens.

Preferred Gonococcal antigens include one or more of ngs13 (OmpA), OmpH, ngs576 (peptidyl-prolyl cis/trans isomerase (PPIase) protein), ngs41 and ngs117.

Preferred HPV antigens include one or more of HPV 16, HPV 18, HPV 6 and HPV 11.

Preferred *Chlamydia trachomatis* antigens include one or more of: CT045, CT089, CT242, CT316, CT381. CT396, CT398, CT444, CT467, CT547, CT587, CT823, CT761 and specific combinations of these antigens as disclosed in WO 05/002619.

Preferred *Chlamydia pneumoniae* antigens include one or more of: CPn0324, Cpn0301, Cpn0482, Cpn0503, Cpn0525, Cpn0558, Cpn0584, Cpn0800, Cpn0979, Cpn0498, Cpn0300, Cpn0042, Cpn0013, Cpn450, Cpn0661, Cpn0557, Cpn0904, Clpn0795, Cpn0186 and Cpn0604 and specific combinations of these antigens as disclosed in WO 05/084306.

Preferred GBS antigens include one or more of GBS80, GBS 104, GBS 59, GBS 67, GBS 322 and GBS 276.

In another embodiment, antigens of the invention are combined with one or more additional, non-*E. coli* antigens suitable for use in a vaccine designed to protect females against genitourinary and/or sexually transmitted diseases. For example, the antigens may be combined with an antigen derived from the group consisting of *Streptococcus agalactiae, Chlamydia trachomatis, Neisseria gonorrhoeae*, papillomavirus and herpes simplex virus. Where human papillomavirus antigens are used, they may be from one or more of HPV 16, HPV 18, HPV 6 and/or HPV 11.

In another embodiment, the antigen combinations of the invention are combined with one or more additional, non-ExPEC antigens suitable for use in a vaccine designed to protect elderly or immunocompromised individuals. For example, the antigen combinations may be combined with an antigen derived from the group consisting of *Enterococcus faecalis, Staphylococcus aureus, Staphylococcus epidermis, Pseudomonas aeruginosa, Legionella pneumophila, Listeria monocytogenes, Neisseria meningitidies*, influenza, and parainfluenza virus ('PIV').

Toxic protein antigens may be detoxified where necessary (e.g. detoxification of pertussis toxin by chemical and/or genetic means [183]).

Where a dipptheria antigen is included in the composition it is preferred also to include tetanus antigen and pertussis antigens. Similarly, where a tetanus antigen is included it is preferred also to include diphtheria and pertussis antigens. Similarly, where a pertussis antigen is included it is preferred also to include diphtheria and tetanus antigens. DTP combinations are thus preferred.

Saccharide antigens are preferably in the form of conjugates. Carrier proteins for the conjugates include bacterial toxins (such as diphtheria toxoid or tetanus toxoid), the *N. meningitidis* outer membrane protein [215], synthetic peptides [216,217], heat shock proteins [218,219], pertussis proteins [220,221], protein D from *H. influenzae* [222,223], cytokines [224], lymphokines [224], *H. influenzae* proteins, hormones [224], growth factors [224], toxin A or B from *C. difficile* [225], iron-uptake proteins [226], artificial proteins comprising multiple human CD4+ T cell epitopes from various pathogen-derived antigens [227] such as the N19 protein [228], pneumococcal surface protein PspA [229], pneumolysin [230], etc. A preferred carrier protein is CRM197 protein [231].

Antigens in the composition will typically be present at a concentration of at least 1 µg/ml each. In general, the concentration of any given antigen will be sufficient to elicit an immune response against that antigen.

Antigens are preferably adsorbed to an aluminium salt.

Nucleic Acid Immunisation

The immunogenic compositions described above include polypeptide antigens from MNEC. As an alternative to using proteins antigens in the immunogenic compositions of the invention, nucleic acid (preferably DNA e.g. in the form of a plasmid) encoding the antigen may be used, to give compositions, methods and uses based on nucleic acid immunisation. Nucleic acid immunisation is now a developed field (e.g. see references 232 to 239 etc.), and has been applied to many vaccines.

The nucleic acid encoding the immunogen is expressed in vivo after delivery to a patient and the expressed immunogen then stimulates the immune system. The active ingredient will typically take the form of a nucleic acid vector comprising: (i) a promoter; (ii) a sequence encoding the immunogen, operably linked to the promoter; and optionally (iii) a selectable marker. Preferred vectors may further comprise (iv) an origin of replication; and (v) a transcription terminator downstream of and operably linked to (ii). In general, (i) & (v) will be eukaryotic and (iii) & (iv) will be prokaryotic.

Preferred promoters are viral promoters e.g. from cytomegalovirus (CMV). The vector may also include transcriptional regulatory sequences (e.g. enhancers) in addition to the promoter and which interact functionally with the promoter. Preferred vectors include the immediate-early CMV enhancer/promoter, and more preferred vectors also include CMV intron A. The promoter is operably linked to a downstream sequence encoding an immunogen, such that expression of the immunogen-encoding sequence is under the promoter's control.

Where a marker is used, it preferably functions in a microbial host (e.g. in a prokaryote, in a bacteria, in a yeast). The marker is preferably a prokaryotic selectable marker (e.g. transcribed under the control of a prokaryotic promoter). For convenience, typical markers are antibiotic resistance genes.

The vector of the invention is preferably an autonomously replicating episomal or extrachromosomal vector, such as a plasmid.

The vector of the invention preferably comprises an origin of replication. It is preferred that the origin of replication is active in prokaryotes but not in eukaryotes.

Preferred vectors thus include a prokaryotic marker for selection of the vector, a prokaryotic origin of replication, but a eukaryotic promoter for driving transcription of the immunogen-encoding sequence. The vectors will therefore (a) be amplified and selected in prokaryotic hosts without polypeptide expression, but (b) be expressed in eukaryotic hosts without being amplified. This arrangement is ideal for nucleic acid immunization vectors.

The vector of the invention may comprise a eukaryotic transcriptional terminator sequence downstream of the coding sequence. This can enhance transcription levels. Where the coding sequence does not have its own, the vector of the invention preferably comprises a polyadenylation sequence. A preferred polyadenylation sequence is from bovine growth hormone.

The vector of the invention may comprise a multiple cloning site.

In addition to sequences encoding the immunogen and a marker, the vector may comprise a second eukaryotic coding sequence. The vector may also comprise an IRES upstream of said second sequence in order to permit translation of a second eukaryotic polypeptide from the same transcript as the immunogen. Alternatively, the immunogen-coding sequence may be downstream of an IRES.

The vector of the invention may comprise unmethylated CpG motifs e.g. unmethylated DNA sequences which have in common a cytosine preceding a guanosine, flanked by two 5' purines and two 3' pyrimidines. In their unmethylated form these DNA motifs have been demonstrated to be potent stimulators of several types of immune cell.

Vectors may be delivered in a targeted way. Receptor-mediated DNA therapy techniques are described in, for example, references 240 to 245. Therapeutic compositions containing a nucleic acid are administered in a range of about 100 ng to about 200 mg of DNA for local administration in a gene therapy protocol. Concentration ranges of about 500 ng to about 50 mg, about 1 µg to about 2 mg, about 5 µg to about 500 µg, and about 20 µg to about 100 µg of DNA can also be used during a gene therapy protocol. Factors such as method of action (e.g. for enhancing or inhibiting levels of the encoded gene product) and efficacy of transformation and expression are considerations which will affect the dosage required for ultimate efficacy. Where greater expression is desired over a larger area of tissue, larger amounts of vector or the same amounts re-administered in a successive protocol of administrations, or several administrations to different adjacent or close tissue portions may be required to effect a positive therapeutic outcome. In all cases, routine experimentation in clinical trials will determine specific ranges for optimal therapeutic effect.

Vectors can be delivered using gene delivery vehicles. The gene delivery vehicle can be of viral or non-viral origin (see generally references 246 to 249).

Viral-based vectors for delivery of a desired nucleic acid and expression in a desired cell are well known in the art. Exemplary viral-based vehicles include, but are not limited to, recombinant retroviruses (e.g. references 250 to 260), alphavirus-based vectors (e.g. Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532); hybrids or chimeras of these viruses may also be used), poxvirus vectors (e.g. vaccinia, fowlpox, canarypox, modified vaccinia Ankara, etc.), adenovirus vectors, and adeno-associated virus (AAV) vectors (e.g. see refs. 261 to 266). Administration of DNA linked to killed adenovirus [267] can also be employed.

Non-viral delivery vehicles and methods can also be employed, including, but not limited to, polycationic condensed DNA linked or unlinked to killed adenovirus alone [e.g. 267], ligand-linked DNA [268], eukaryotic cell delivery vehicles cells [e.g. refs. 269 to 273] and nucleic charge neutralization or fusion with cell membranes. Naked DNA can also be employed. Exemplary naked DNA introduction methods are described in refs. 274 and 275. Liposomes (e.g. immunoliposomes) that can act as gene delivery vehicles are described in refs. 276 to 280. Additional approaches are described in references 281 & 282.

Further non-viral delivery suitable for use includes mechanical delivery systems such as the approach described in ref. 282. Moreover, the coding sequence and the product of expression of such can be delivered through deposition of photopolymerized hydrogel materials or use of ionizing radiation [e.g. refs. 283 & 284]. Other conventional methods for gene delivery that can be used for delivery of the coding sequence include, for example, use of hand-held gene transfer particle gun [285] or use of ionizing radiation for activating transferred genes [283 & 286].

Delivery DNA using PLG {poly(lactide-co-glycolide)} microparticles is a particularly preferred method e.g. by adsorption to the microparticles, which are optionally treated to have a negatively-charged surface (e.g. treated with SDS) or a positively-charged surface (e.g. treated with a cationic detergent, such as CTAB).

General

The term "comprising" encompasses "including" as well as "consisting" e.g. a composition "comprising" X may consist exclusively of X or may include something additional e.g. X+Y.

The term "about" in relatation to numerical value x means, for example, x±10%.

The word "substantially" does not exclude "completely" e.g. a composition which is "substantially free" from Y may be completely free from Y. Where necessary, the word "substantially" may be omitted from the definition of the invention.

The N-terminus residues in the amino acid sequences in the sequence listing are generally given as the amino acid encoded by the first codon in the corresponding nucleotide sequence. Where the first codon is not ATG (e.g. SEQ ID NOs: 1, 7, 19, 39, 43, 49, 51, 55, 63, 73, 119, 127, 129, 137, 143, 145, 147, 149, 155, 159, 165, 173, 181, 183, 205, 209, 219, 221, 229, 235, 247, 263, 269, 271, 297, 303, 325, 327, 341, 345, 359, 363, 373, 395, 401, 413, 443, 447, 453, 459, 463, 465, 469, 473, 477, 479, 495, 505, 507, 517, 527, 533, 535, 537, 539, 549, 569, 575, 579, 581, 583, 587, 591, 593, 599, 613, 621, 635, 637, 643, 655, 661, 665, 669, 671, 681, 683, 687, 693, 707, 709, 721, 723, 729, 743, 757, 763, 765, 769, 781, 791, 793, 813, 817, 823, 837, 839, 855, 861, 865, 881, 885, 897, 907, 909, 911, 917, 921, 941, 949, 957, 965, 975, 977, 979, 981, 983, 989, 993, 997, 1001, 1005, 1011, 1015, 1017, 1019, 1027, 1029, 1033, 1037, 1043, 1051, 1053, 1073, 1087, 1097, 1101, 1103, 1107, 1113, 1115, 1117, 1121, 1123, 1135, 1143, 1147, 1149, 1175, 1181, 1227, 1263, 1271, 1287, 1295, 1305, 1307, 1311, 1317, 1323, 1331, 1341, 1345, 1349, 1351, 1355, 1359, 1363, 1373, 1375, 1383, 1399, 1411, 1415, 1417, 1423, 1433, 1451, 1477, 1483, 1485, 1493, 1495, 1501, 1503, 1511, 1519, 1521, 1525, 1529, 1553, 1559, 1579, 1585, 1603, 1609, 1611, 1619, 1621, 1623, 1629, 1631, 1643, 1653, 1669, 1675, 1677, 1687, 1693, 1705, 1713, 1717, 1727, 1739, 1751, 1763, 1769, 1785, 1789, 1799, 1801, 1817, 1819, 1825, 1827, 1829, 1831, 1833, 1839, 1857, 1867, 1911, 1919, 1925, 1929, 1939, 1947, 1955, 1957, 1979, 1981, 1985, 1989, 1993, 1995, 2003, 2005, 2009, 2027, 2035, 2037, 2047, 2049, 2059, 2063, 2079, 2093, 2123, 2135, 2139, 2141, 2163, 2165, 2173, 2177, 2189, 2195, 2197, 2203, 2209, 2211, 2241, 2247, 2275, 2291, 2321, 2327, 2357, 2361, 2373, 2377, 2379, 2397, 2399, 2405, 2433, 2437, 2443, 2447, 2451, 2455, 2457, 2487, 2491, 2503, 2505, 2507, 2513, 2515, 2521, 2541, 2545, 2549, 2553, 2565, 2577, 2579, 2591, 2613, 2623, 2629, 2631, 2633, 2635, 2639, 2641, 2649, 2657, 2659, 2661, 2663, 2665, 2667, 2669, 2671, 2681, 2687, 2689, 2699, 2701, 2705, 2713, 2719, 2721, 2729, 2735, 2743, 2745, 2759, 2781, 2785, 2787, 2789, 2795, 2801, 2809, 2813, 2815, 2823, 2825, 2845, 2847, 2869, 2885, 2891, 2897, 2905, 2907, 2911, 2913, 2915, 2925, 2939, 2945, 2947, 2975, 2993, 3015, 3043, 3055, 3061, 3063, 3075, 3107, 3117, 3127, 3131, 3175, 3179, 3191, 3193, 3207, 3209, 3213, 3221, 3229, 3243, 3253, 3259, 3261, 3267, 3283, 3289, 3307, 3313, 3331, 3337, 3339, 3353, 3357, 3361, 3367, 3379, 3381, 3383, 3411, 3419, 3429, 3433, 3435, 3437, 3445, 3449, 3453, 3471, 3491, 3501, 3507, 3515, 3559, 3563, 3571, 3573, 3577, 3579, 3583, 3595, 3607, 3619, 3621, 3623, 3625, 3629, 3633, 3635, 3637, 3663, 3671, 3679, 3685, 3687, 3699, 3701, 3707, 3713, 3721, 3723, 3739, 3741, 3743, 3759, 3763, 3777, 3797, 3807, 3811, 3821, 2829, 3833, 3855, 3857, 3863, 3865, 3867, 3869, 3873, 3881, 3891, 3893, 3901, 3919, 3925, 3931, 3937, 3949, 3951, 3955, 3959, 3969, 3973, 3981, 3991, 4003, 4013, 4029, 4033, 4049, 4057, 4069, 4071, 4077, 4081, 4089, 4107, 4131, 4139, 4171, 4193, 4195, 4199, 4201, 4223, 4225, 4245, 4249, 4273, 4279, 4281, 4287, 4293, 4301, 4319, 4321, 4327, 4337, 4351, 4353, 4361, 4363, 4365, 4369, 4377, 4379, 4387, 4395, 4403, 4411, 4417, 4423, 4429, 4443, 4463, 4479, 4483, 4485, 4493, 4495, 4523, 4527, 4529, 4541, 4549, 4553, 4563, 4577, 4583, 4585, 4595, 4619, 4635, 4651, 4677, 4683, 4685, 4699, 4703, 4709, 4711, 4719, 4751, 4753, 4761, 4789, 4803, 4805, 4819, 4829, 4833, 4837, 4839, 4847, 4851, 4857, 4863, 4869, 4887, 4891, 4893, 4909, 4925, 4927, 4931, 4935, 4939, 4943, 4949, 4957, 4963, 4965, 4973, 5019, 5033, 5063, 5073, 5081, 5083, 5085, 5089, 5093, 5113, 5167, 5179, 5183, 5193, 5209, 5211, 5213, 5227, 5231, 5237, 5245, 5273, 5281, 5283, 5297, 5299, 5301, 5305, 5309, 5329, 5333, 5347, 5353, 5365, 5367, 5369, 5385, 5389, 5401, 5435, 5437, 5439, 5453, 5465, 5475, 5515, 5517, 5525, 5543, 5545, 5559, 5571, 5605, 5611, 5619, 5639, 5651, 5655, 5665, 5685, 5701, 5715, 5761, 5769, 5771, 5775, 5781, 5793, 5795, 5801, 5817, 5819, 5831, 5855, 5861, 5865, 5873, 5887, 5889, 5909, 5911, 5927, 5945, 5949, 5957, 5959, 5965, 5973, 5987, 5997, 6003, 6013, 6015, 6023, 6025, 6027, 6037, 6063, 6091, 6093, 6095, 6097, 6111, 6117, 6119, 6135, 6143, 6147, 6165, 6177, 6187, 6189, 6191, 6195, 6197, 6199, 6203, 6223, 6227, 6229, 6237, 6245, 6247, 6249, 6253, 6255, 6259, 6267, 6297, 6305, 6311, 6317, 6345, 6361, 6389, 6419, 6421, 6435, 6457, 6461, 6463, 6467, 6471, 6487, 6499, 6535, 6553, 6559, 6561, 6565, 6617, 6631, 6633, 6643, 6677, 6699, 6707, 6733, 6745, 6781, 6783, 6789, 6799, 6813, 6843, 6847, 6851, 6861, 6885, 6893, 6899, 6901, 6905, 6915, 6917, 6919, 6933, 6941, 6943, 6957, 6961, 6967, 6973, 6985, 6993, 6995, 7021, 7023, 7045, 7047, 7051, 7063, 7065, 7069, 7077, 7085, 7089, 7091, 7097, 7099, 7107, 7113, 7123, 7129, 7131, 7167, 7191, 7199, 7219, 7223, 7241, 7247, 7263, 7277, 7289, 7309, 7339, 7345, 7383, 7401, 7409, 7411, 7413, 7429, 7439, 7443, 7455, 7459, 7461, 7465, 7477, 7489, 7497, 7499, 7513, 7523, 7525, 7527, 7533, 7549, 7555, 7557, 7567, 7581, 7601, 7611, 7615, 7617, 7623, 7633, 7641, 7651, 7653, 7659, 7665, 7687, 7693, 7701, 7709, 7723, 7727, 7779, 7789, 7797, 7809, 7849, 7859, 7869, 7877, 7885, 7891, 7893, 7905, 7907, 7917, 7929, 7933, 7937, 7943, 7945, 7951, 7953, 7969, 7971, 8015, 8017, 8027, 8055, 8059, 8061, 8069, 8107, 8137, 8145, 8149, 8151, 8153, 8171, 8179, 8217, 8219, 8231, 8239, 8245, 8247, 8261, 8269, 8301, 8313, 8341, 8365, 8371, 8381, 8387, 8393, 8421, 8447, 8453, 8455, 8457, 8461, 8465, 8471, 8493, 8501, 8505, 8515, 8523, 8531, 8545, 8575, 8579, 8581, 8617, 8645, 8647, 8655, 8667, 8677, 8679, 8683, 8689, 8691, 8697, 8709, 8715, 8721, 8727, 8731, 8739, 8745, 8775, 8793, 8797, 8807, 8815, 8823, 8827, 8833, 8859, 8863, 8869, 8889, 8899, 8901, 8909, 8913, 8915, 8929, 8933, 8935, 8949, 8951, 8955, 8967, 8993, 8995, 8997, 9003, 9009, 9013, 9019, 9033, 9037, 9061, 9065, 9067, 9079, 9101, 9103, 9123, 9153, 9157, 9163, 9185, 9189, 9197, 9201, 9223, 9225, 9227, 9241, 9243, 9247, 9273, 9275, 9281, 9297, 9313, 9321, 9331, 9339, 9369, 9383, 9385, 9387, 9409, 9413, 9435, 9449, 9469, 9471, 9491, 9495, 9497, 9499, 9503, 9527, 9529, 9545, 9547, 9557, 9559, 9565, 9577, 9589, 9599, 9601, 9603, 9605, 9607, 9621, 9633, 9635, 9653, 9655, 9663, 9681, 9701, 9705, 9717, 9731, 9747, 9765, 9797, 9807, 9809, 9811, 9831, 9851, 9853, 9855, 9875, 9899, 9915, 9929, 9931, 9939, 9941, 9945, 9949, 9953, 9959, 9989), it will be understood that it will be translated as methionine when the codon functions as a start codon, but will be translated as the indicated non-Met amino acid when the sequence is at the C-terminus of a fusion partner. The invention specifically discloses and encompasses each of the amino acid sequences of the sequence listing having a N-terminus methionine residue (e.g. a formyl-methionine residue) in place of any indicated non-Met residue (e.g. for SEQ ID NOS: 236, 662, 758, 770, 782, 792, 838, 918, 1182, 1312, 1374, 1632, 2064, 2378, 2400, 2456, 2516, 2636, 2670, 2682, 2688, 2744, 3384, 3702, 3714, 4058, 4678, 4704, 4804, 4806, 4848, 6026, 6112, 7022, 7242, 7710, 8582, 9682). It also specifically discloses and encompasses each of the amino acid sequences of the sequence listing starting at any internal methionine residues in the sequences.

As indicated in the above text, nucleic acids and polypeptides of the invention may include sequences that:
(a) are identical (i.e. 100% identical) to the sequences disclosed in the sequence listing;
(b) share sequence identity with the sequences disclosed in the sequence listing;
(c) have 1, 2, 3, 4, 5, 6, 7, 8, 9 or 10 single nucleotide or amino acid alterations (deletions, insertions, substitutions), which may be at separate locations or may be contiguous, as compared to the sequences of (a) or (b); and
(d) when aligned with a particular sequence from the sequence listing using a pairwise alignment algorithm, a moving window of x monomers (amino acids or nucleotides) moving from start (N-terminus or 5') to end (C-terminus of 3'), such that for an alignment that extends to p monomers (where p>x) there are p−x+1 such windows, each window has at least x•y identical aligned monomers, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x•y is not an integer then it is rounded up to the nearest integer. The preferred pairwise alignment algorithm is the Needleman-Wunsch global alignment algorithm [287], using default parameters (e.g. with Gap opening penalty=10.0, and with Gap extension penalty=0.5, using the EBLOSUM62 scoring matrix). This algorithm is conveniently implemented in the needle tool in the EMBOSS package [288].

The nucleic acids and polypeptides of the invention may additionally have further sequences to the N-terminus/5' and/or C-terminus/3' of these sequences (a) to (d).

The practice of the present invention will employ, unless otherwise indicated, conventional methods of chemistry, biochemistry, molecular biology, immunology and pharmacology, within the skill of the art. Such techniques are explained fully in the literature. See, e.g., references 289-296, etc.

EXPERIMENTAL

Below are examples of specific embodiments or modes for carrying out the present invention. The examples are offered for illustrative purposes only, and are not intended to limit the scope of the present invention in any way.

Efforts have been made to ensure accuracy with respect to numbers used (e.g., amounts, temperatures, etc.), but some experimental error and deviation should, of course, be allowed for.

MODES FOR CARRYING OUT THE INVENTION

MNEC Strain IHE3034

IHE3034 is a known *E. coli* strain of the MNEC pathotype. Table 1 of reference 297 reports that IHE3034 is classified as O18:K1:H7/9 serotype, and falls into ECOR group B2. Known virulence-associated genes on horizontally transferred DNA elements are sfaII, ibeA, iro, kps (group II), fyuA and malX. It also carries the cdt gene cluster coding for the cytolethal distending toxin.

Sequencing of *E. coli* K1 strain IHE3034 led to 283 contigs. These are given as SEQ ID NOs 9991 to 10273, arranged in descending order of length.

Analysis of the genome sequence of *E. coli* K1 strain IHE3034 has identified 4995 open reading frames (ORFs), which are referred to by the nomenclature ORFnnnnn, where nnnnn is a number between 00001 and 04995. Sequences for these ORFs are given as SEQ ID NOs: 1 to 9990, with odd-numbered SEQ ID NOs being DNA sequences, and even-numbered IDs being amino acid sequences. The nnnnn numbering can be converted to the SEQ ID NO: numbering of the sequence listing as follows: for an amino acid sequence, SEQ ID NO:=nnnnn×2; for a nucleotide sequence, SEQ ID NO:=[nnnnn×2]−1. Thus ORF01234 is found as SEQ ID NOs: 2467 & 2468, as shown in Table 1.

Initial functional annotation of the 4995 ORFs is given in Table 1.

Table 3 shows the ORFs which have low homology with commensal strain ORFs (1194 in total). These ORFs are preferred for giving specificity to pathological *E. coli* strains vs. commensal strains, both in relation to nucleic acid testing and in relation to immunological cross-reactivity. Potential pathogenicity islands are located in the ranges ORF00028-70, ORF000330-353, ORF00655-687, ORF00883-910, ORF01031-1058, ORF1078-1119, ORF1186-1228, ORF01313-1376, ORF01479-1514, ORF01523-1543, ORF01550-1578, ORF01810-1865, ORF02295-02315, ORF02351-2375, ORF02382-2405, ORF02436-2472, ORF02788-02816, ORF02844-2891, ORF03011-3056, ORF03340-3365, ORF03499-3522, ORF04416-4439, ORF04661-4679, ORF04915-4930, and ORF04946-4966.

Based on various criteria applied by the inventors, a subset of 142 of the 4995 ORFs (2.8%) has been selected for immunogenic use. These 142 ORFs are listed in Table 2. The criteria for selection of the subset include, but are not limited to: low homology with ORFs from commensal *E. coli* strains; length>100 aa; and suitable cellular localisation (shown at bottom of Table 2).

The genes encoding these 142 proteins are cloned, expressed in bacteria (e.g. in a non-pathogenic laboratory *E. coli* host, or in a *Bacillus* such as *B. subtilis* or *B. megaterium*), purified, and then are used to immunise test animals (e.g. mice). The serum raised in the mice are then analysed in Western blot, ELISA and FACS assays, and are further tested in both in vitro and in vivo experiments. Suitable in vitro experiments include testing the ability of antibodies to induce complement-mediated bacterial killing and/or opsonophagocytosis activity, to block binding of MNEC strains (or the purified antigen) to human epithelial cells or other cell lines, and/or to inhibit adhesion/invasion of *E. coli* bacteria (e.g. K1 strain) to brain microvascular endothelial cells (BMEC). Suitable in vivo experiments for testing efficacy against bacteremia and meningitis include active and/or passive systemic immunisations and challenge in 5-day-old rats challenged with *E. coli* K1 strain, and immunisation and intraperitoneal infection of adult mice with MNEC strains.

The importance of the proteins to the bacterial life-cycle can be tested by creating isogenic knockout mutants. The mutants can also be used to ensure that sera raised by an antigen are specific for that antigen. Microarrays are used to study expression patterns. Conservation and/or variability is assessed by sequencing the genes from multiple different ExPEC strains.

Assays were carried out in order to select predicted surface-exposed proteins, which are specific for MNEC strains and absent in non-pathogenic strains (commensal and laboratory strains). Once selected these proteins are expressed and purified and used to immunize mice.

It is known from reference 43 that a mutation in any of the tol-pal genes of *E. coli* results in the formation of vesicles containing native outer membrane proteins. By comparing the proteins present in vesicles of MNEC strains and non-pathogenic strains it is possible to select a small group of proteins that could be used as potential antigens.

Lambda Red-Mediated Gene Manipulation in Commensal and Pathogenic *E. Coli*

This method is a rapid PCR-based method used to inactivate the tolR gene from the wild-type *E. coli* strains [298]. Briefly, the first step consists in amplifying independently the upstream and downstream regions of the target gene (tolR) and the resistance marker cassette. The two PCR products obtained in step 1 are mixed with the amplification producer of the AB cassette at equimolar concentrations and submitted to a second round of PCR (a three way PCR) to generate a resistance marker cassette flanked by upstream and downstream 500 bp (or more) regions homologous to the target gene. In the third step, large amounts (1 µg) of the desired linear DNA are electroporated into lamda-red competent cells.

Vesicle Preparation

1. Vesicle Preparation by Precipitation with TCA

LB media was inoculated with bacteria grown on plates and incubated overnight at 37° C. under gentle shaking. The culture was used to inoculate 200 ml of LB at OD600 0.1. Bacteria were grown to OD600 0.4 (or as specified). Culture was centrifuged for 10 minutes at 4000×g and the supernatant was filtered through a 0.22 mm filter to remove residual bacteria.

The same experiments were also performed under iron limiting conditions by adding Dipyridyl (0.25 mM) to the LB media.

Precipitation was performed by adding to the culture supernatant 10% final of a solution at 100% (w/v) TCA, 0.4% (w/v) deoxycholate. The precipitation was allowed to proceed for 30 minutes at 4° C. Precipitate was recovered by 10 minutes centrifugation at 20000×g at 4° C. The pellet was washed once with 10% TCA (w/v) and twice with absolute ethanol. The pellet was dried with speed vac, and stored at −20° C.

The wild type and mutated strains were subjected to SDS polyacrylamide gel electrophoresis from which it could be observed that there were many more bands in the supernatant of the mutated strains than the wildtype strains. Randomly picked bands demonstrated that all the proteins in the supernatant were membrane proteins.

2. Vesicle Preparation by Ultracentrifugation

Culture supernatant was ultracentrifuged at 200000×g for 2 hours at 4° C. The pellet was washed with PBS, resuspended in PBS, and stored at −20° C.

3. Guanidinium Denaturation of the Vesicles

Prior to the guanidinium denaturation, Vesicles were precipitated with ethanol. 10 µg of OMV in PBS were precipitate by adding cold absolute ethanol to 90% final. Precipitation was allowed to proceed for 20 minutes at −20° C. Precipitate was recovered by 10 minutes centrifugation at 13000×g. Pellet was resuspended with 50 ml, 6M guanidinium, 15 mM DTT, 200 mM Tris-HCl, pH 8.0.

Denaturation was allowed to proceed for 60 minutes at 60° C. Prior to digestion, solution was diluted 1/8 with a solution of 1.5M Tris pH 8.0 and 5 mg of trypsin were added to the diluted solution. Digestion was allowed to proceed overnight at 37° C. Reaction was stopped by adding 0.1% final of formic acid. Peptides were extracted using Oasis extraction cartridges. Peptides were analyzed by LC coupled MS-MS.

4. Surface Digestion 5 mg of trypsin were added to 10 mg of vesicles in PBS and incubated at 37° C. for 3 hours. Reaction was stopped by adding 0.1% final of formic acid. Peptides were recovered by filtration through a 30 Kda cut-off filter and extracted with Oasis extraction cartridge. Peptides were analyzed with LC coupled MSMS.

Vesicle Analysis

Protein Quantification

Proteins were quantified with the Bradford method, using the BSA as standard.

SDS-Page

Samples were analyzed with a sodium dodecyl sulfate (SDS) 4-12% polyacrylamide gel, using a Mini-Protean II electrophoresis apparatus. Samples were suspended in SDS sample buffer (0.06 M Tris-HCl pH 6.8, 10% (v/v) glycerol, 2% (w/v) SDS, 5% (v/v) 2-mercaptoethanol, 10 mg/ml bromophenol blue) and heated to 100° C. for 5 min before SDS-polyacrylamide gel electrophoreis. After the run, gels were stained with Coomassie Blue MALDI-TOF Mass Spectrometry.

Protein bands or spots were excised from gels, washed with 50 mM ammonium bicarbonate/acetonitrile (50/50, v/v), and dried with a Speed-Vac centrifuge (Savant). The dried spots were digested at 37° C. for 2 h by adding 7 to 10 ml of a solution containing 5 mM ammonium bicarbonate, 0.012 mg of sequencing-grade trypsin. After digestion 0.6 ml were loaded on a matrix pre-spotted target and air-dried. Spots were washed with 0.6 ml of a solution of 70% ethanol, 0.1% trifluoracetic acid. Mass spectra were acquired on an ultraflex MALDI TOF mass spectrometer. Spectra were externally calibrated by using a combination of standards pre-spotted on the target. Protein identification was carried out by both automatic and manual comparisons of experimentally generated monoisotopic peaks of peptides in the mass range of 700 to 3,000 Da with computer-generated fingerprints, using the Mascot program.

Bi-Dimensional Electrophoresis 200 mg of vesicles were resuspended in an Immobiline re-swelling solution (7M urea, 2M thiourea, 2% (w/v) CHAPS (2% w/v) ASB14, 2% (v/v) IPG buffer pH 3-10 NL, 2 mM TBP, 65 mM DTT), and adsorbed overnight on 7 cm Immobiline DryStrips (pH 3-10 NL). Proteins were then separated by 2D electrophoresis. The first dimension was run using a IPGphor Isoelectric Focusing Unit, applying sequentially 150 V for 35 minutes, 500 V for 35 minutes, 1,000 V for 30 minutes, 2,600 V for 10 minutes, 3,500 V for 15 minutes, 4,200 V for 15 minutes, and finally 5,000 V to reach 10 kVh. For the second dimension, the strips were equilibrated by two 10 minute-incubations in 4 M urea, 2 M thiourea, 30% glycerol, 2% SDS, 5 mM TBP, 50 Mm Tris HCl pH 8.8, 2.5% acrylamide, Bromo phenol Blue 0.2%: Proteins were then separated on linear 4-12% precasted polyacrylamide gels.

Gels were stained with colloidal Coomassie Blue and scanned with a Personal Densitometer SI. Images were analyzed with Image Master 2D Elite software.

Nano-LC/MS/MS

Peptides were separated by nano-LC on a CapLC HPLC system connected to a Q-TOF Micro ESI mass spectrometer equipped with a nanospray source. Samples were loaded onto an Atlantis C18 NanoEase column (100 µm i.d.×100 mm), through a C18 trap column (300 µm i.d.×5 mm). Peptides were eluted with a 50-min gradient from 2% to 60% of 95% ACN, in a solution of 0.1% formic acid at a flow rate of 400 nl/minute. The eluted peptides were subjected to an automated data-dependent acquisition program, using the MassLynx software, version 4.0, where a MS survey scan was used to automatically select multi-charged peptides over the m/z range of 400-2,000 for further MS/MS fragmentation. Up to three different components where subjected to MS/MS fragmentation at the same time. After data acquisition, the individual MS/MS spectra were combined, smoothed and centroided by MassLynx. Search and identification of peptides were performed in batch mode with a licensed version of MASCOT. The MASCOT search parameters were: (1) species: ExPEC (2) allowed number of missed cleavages (only for trypsin digestion): 6; (3) variable post-translational modifications: methionine oxidation; (4) peptide tolerance: ±500 ppm; (5) MS/MS tolerance: ±0.3 Da and (6): peptide charge: from +1 to +4. As for the previous platform, only significant hits as defined by MASCOT probability analysis were considered. The score thresholds for acceptance of protein identifications from at least one peptide were set by MASCOT as 18 for trypsin digestion and 36 for proteinase K digestion.

Results

As a result of the above analyses, 10 further preferred antigens were identified. Namely orf03526 (SEQ ID No: 7051+7052), orf01339 (SEQ ID No: 2677+2678), orf00256 (SEQ ID No: 511+512), orf01346 (SEQ ID No: 2691+2692), orf04084 (SEQ ID No: 8167+8168), orf02374 (SEQ ID No: 4747+4748), orf03502 (SEQ ID No: 7003+7004), orf02298 (SEQ ID No: 4595+4596), orf01228 (SEQ ID No: 2455+2456), orf01227 (SEQ ID No: 2453+2454), orf02314 (SEQ ID NO: 4627+4628) and orf02850 (SEQ ID NO: 5699+5700). These are listed in Table 4 where the identities of these proteins to proteins in the UPEC strain CFT073 are also given. Further preferred antigens are those which display greater than 60% identity to preferred antigens from the CFT073 strain which were identified using the same methods as above. These preferred antigens are orf04282 (SEQ ID No: 8563+8564), orf01364 (SEQ ID No: 2727+2728), orf04936 (SEQ ID No: 9871+9872), orf02336 (SEQ ID No: 4671+4672), orf02840 (SEQ ID No: 5679+5680), orf00267 (SEQ ID No: 533+534), orf01611 (SEQ ID No: 3221+3222), orf01613 (SEQ ID No: 3225+3226) and orf03502 (SEQ ID No: 7003+7004).

Antigen Analysis

Mouse Model of Systemic Infection

To screen a large number of antigens selected by comparative genome analysis between pathogenic and non pathogenic *E. coli* strains, a protection model based on a classical virulence assay has been established.

The experimental model (immunization and infection) uses 5 week old-CD1 outbreed mice which are challenged with intraperitoneal inoculation of virulent IHE3034 *E. coli* strain. The challenge dose has been experimentally determined as the amount of bacteria able to kill 80% of adult mice within 72 hours and corresponds to $1\times10^7$ cfU/mouse for the IHE3034 strain.

Two proteins, described as virulence factors and potential protective antigens were used as positive controls. These proteins are the IbeA [299] and the IroN (SEQ ID No:2691, 2692 and refs 300,301). The recombinant proteins were expressed and used in the immunization assays.

Immunization Protocol

Mice are immunized three times by subcutaneous injection of 150 µl of protein solution using freund's adjuvants as shown in the table below:

|  | Control mice: | Immunized mice: |
|---|---|---|
| Day 0 | 75 µl of saline solution<br>75 µl of complete freund's adjuvant | 75 µl of protein solution (20 µg)<br>75 µl of complete freund's adjuvant |
| Day 21 | 75 µl of saline solution<br>75 µl of incomplete freund's adjuvant | 75 µl of protein solution (20 µg)<br>75 µl of incomplete freund's adjuvant |
| Day 35 | 75 µl of saline solution<br>75 µl of incomplete freund's adjuvant | 75 µl of protein solution (20 µg)<br>75 µl of incomplete freund's adjuvant |

Blood samples are collected the day before the first immunization (preimmune serum), at day 34 and 48 (day before challenge). Sera from immunized animals are tested by western blot and ELISA to determine the antibodies titer.

Challenge

At day 48 *E. coli* IHE3034 strain is streaked on LB agar plate from frozen stock and incubated overnight (ON) at 37° C. in incubator. At Day 49 the ON plate-culture is used to inoculate 50 ml of LB medium to have an $O.D._{600}=0.1$, and grown for 1.5 hours at 37° C. under agitation until the bacteria culture reaches an $O.D._{600}=0.6$ corresponding to $5\times10^8$ cfu/ml for the IHE3034 strain. The culture is diluted in physiological solution until the concentration of bacteria is $1\times10^8$/ml (typically 2 ml of bacterial culture is diluted in 8 ml of physiological solution) and plated using a standard plate count method to verify the inoculum. 100 µl of the cell suspension containing $1\times10^7$ IHE3034 bacteria is injected intraperitoneally, using a 1 ml syringe, to control and immunized mice. The number of deaths in each animal group at 24, 48 and 72 hours after infection are recorded.

The protection due to vaccination is evaluated by comparison of the survival in the vaccinated group and the survival in control group of mice at 72 hours from the challenge. Percentage of survival relative to controls is calculated using the formula:

$$\frac{\text{rate of survival in vaccine group} - \text{rate of survival in control group}}{\text{rate of survival in control group}}$$

Results

Figure 3:
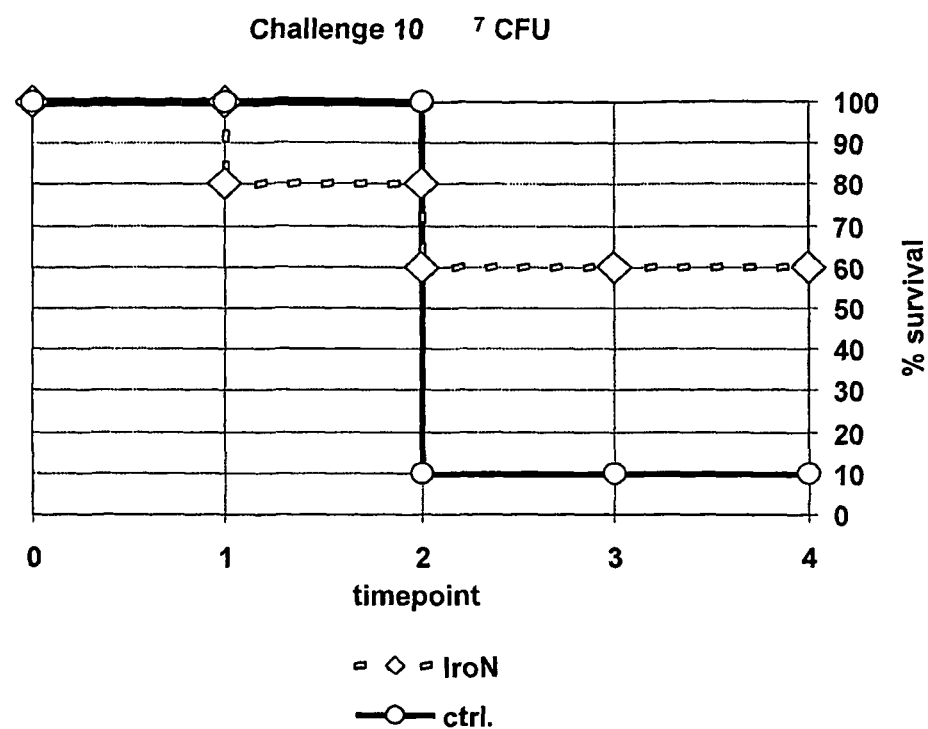
FIG. 3 shows the % survival of mice after challenge with IHE3034 following immunization with IroN or a control (top) and the serum anti-IroN Ig titer (bottom).
Figure 3:
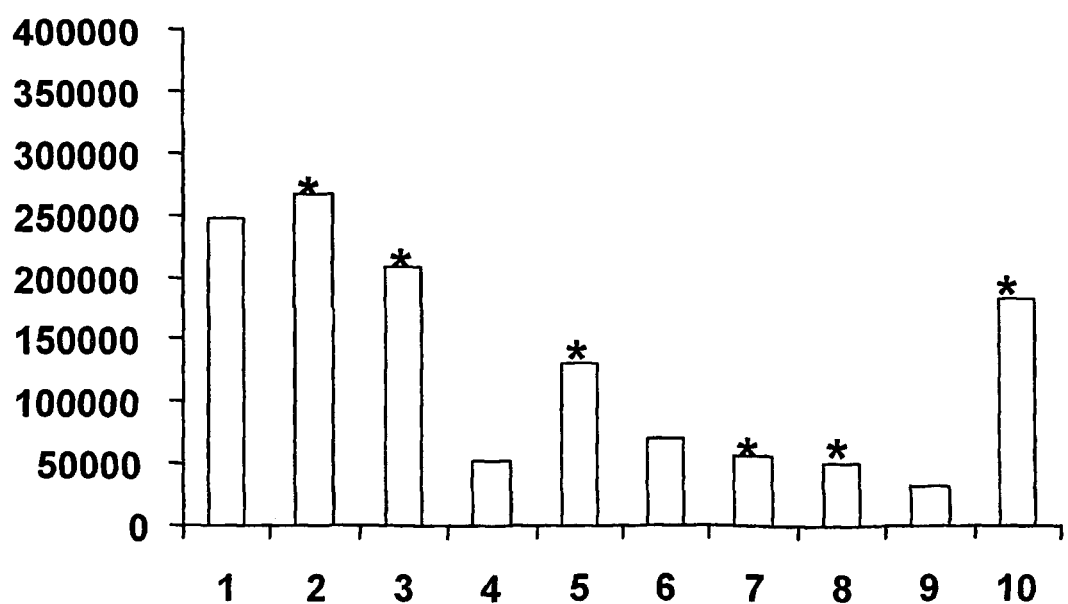
Figure 4:
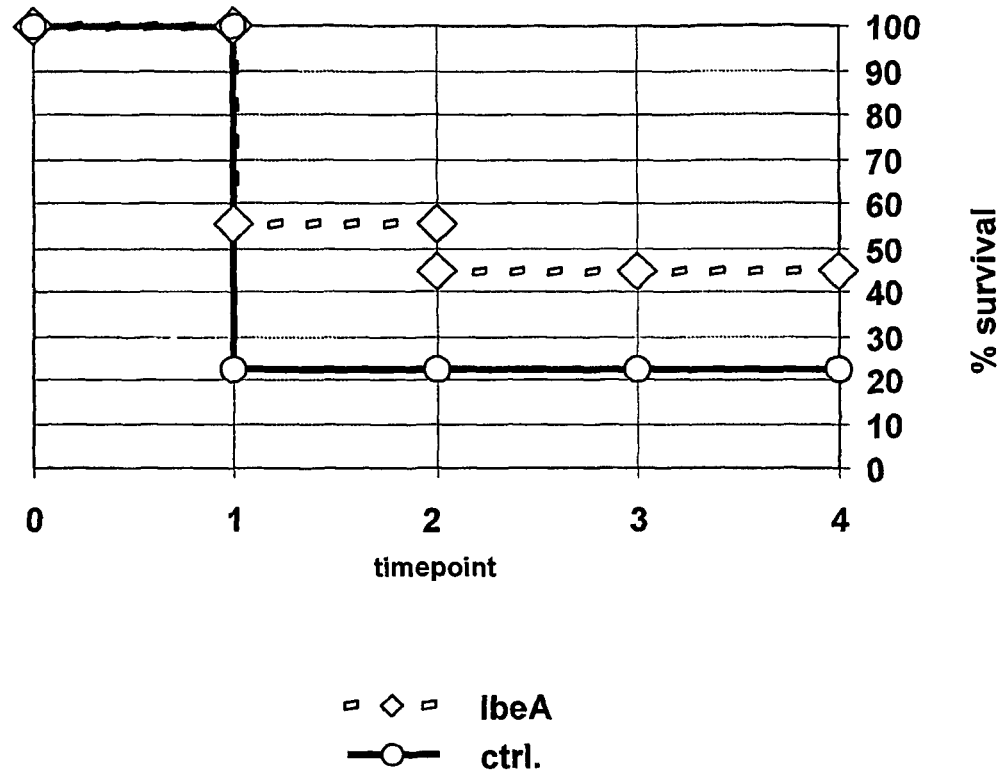
FIG. 4 is similar to FIG. 3, but for IbeA rather than IroN.
Figure 4:
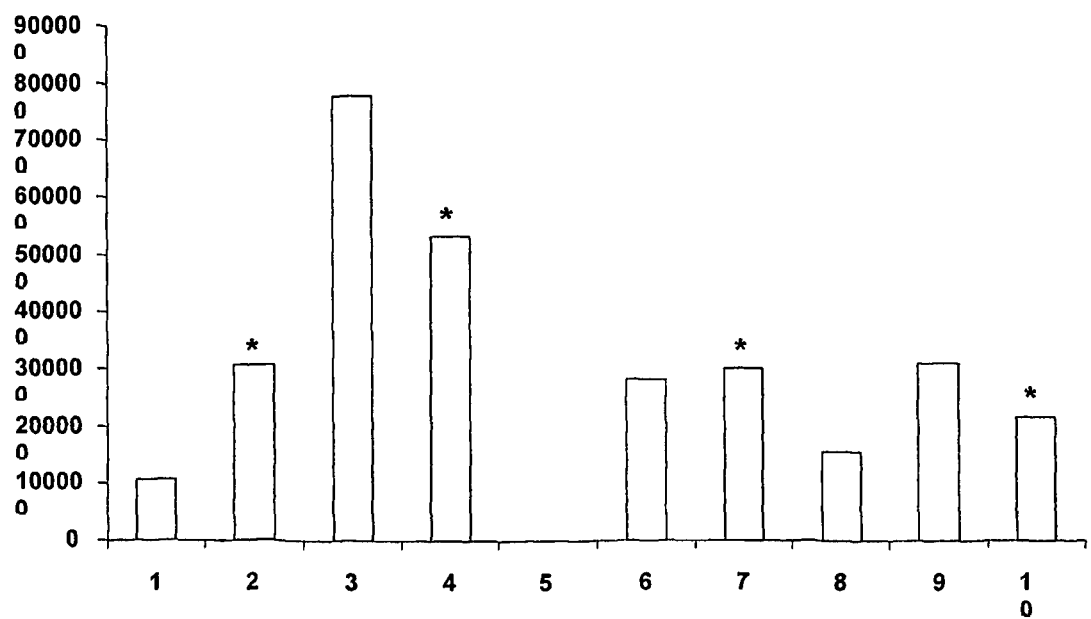

Immunization was carried out as above with positive controls IroN and IbeA. As can be seen in FIGS. 3 and 4 the % survival of the mice after challenge with IHE3034 is increased following immunization with either IroN or IbeA.

Immunization was then carried out with heat-inactivated IHE3034. As can be seen in FIG. 1, the % survival of the mice after challenge with IHE3034 is increased following immunization with heat-inactivated IHE3034.

Figure 2:
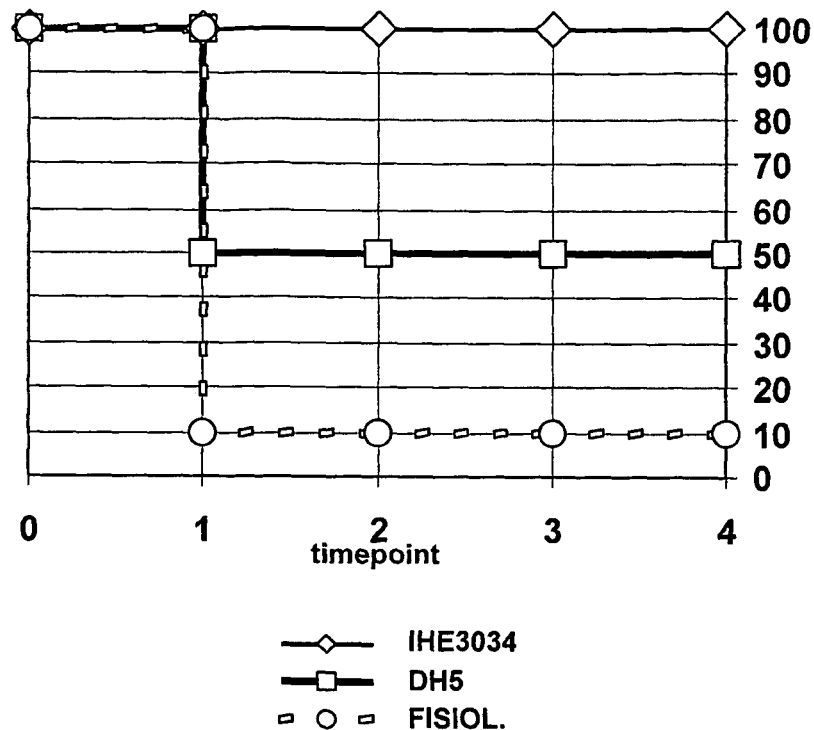
FIG. 2 shows the % survival of mice after challenge with IHE3034 following immunization either with heat-inactivated bacteria (top) or with vesicles (bottom) from ΔToIR mutants. Immunogens were prepared from the IHE3034 strain or from a control strain (DH5).
Figure 2:
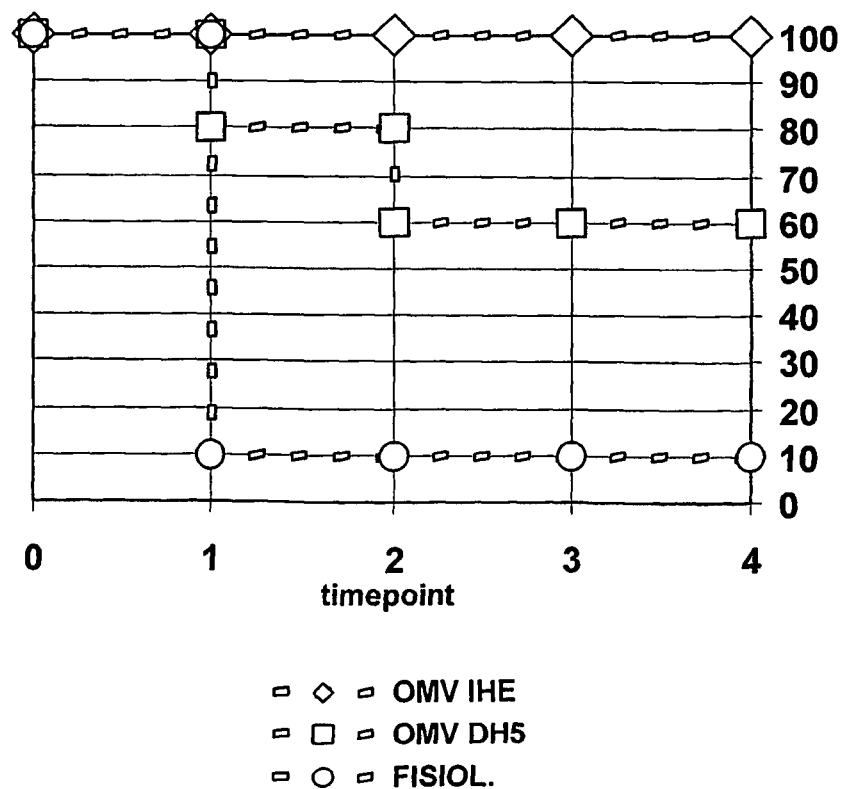

Immunization was also carried out with vesicles from IHE3034 ΔTol-R. As can be seen in FIG. 2, the % survival of the mice after challenge with IHE3034 is increased following immunization with IHE3034 ΔTol-R.

Immunisation Studies

Antigens are selected for combining to give a composition of the invention. BALB/c mice are divided into nine groups and immunized as follows:

| Group | Immunizing Composition | Route of Delivery |
|---|---|---|
| 1 | Mixture of antigens (10-20 μg protein/each) + CFA (Complete Freund's Adjuvant) | Intra-peritoneal or intra-nasal or subcutaneous |
| 2 | Mixture of antigens (5 μg/each) + Al-hydroxide (200 μg) | Intra-peritoneal or intra-nasal or subcutaneous |
| 3 | Mixture of antigens (10-20 μg protein/each) + CpG (10 ug) | Intra-peritoneal or intra-nasal or subcutaneous |
| 4 | Mixture of antigens (10-20 μg protein/each) + Al-hydroxide (200 μg) + CpG (10 μg) | Intra-peritoneal or intra-nasal or subcutaneous |
| 5 | CFA | Intra-peritoneal or intra-nasal or subcutaneous |
| 6 | Mixture of antigens (10-20 μg protein/each) + LTK63 (5 μg) | Intra-peritoneal or Intranasal or subcutaneous |
| 7 | Al-hydroxide (200 μg) + CpG (10 μg) | Intra-peritoneal or intra-nasal or subcutaneous |
| 8 | CpG (10 μg) | Intra-peritoneal or intra-nasal or subcutaneous |
| 9 | LTK63 (5 μg) | Intra-peritoneal or intra-nasal or subcutaneous |

Mice are immunized at two-week intervals. Two to three weeks after the last immunization, all mice are challenged with the appropriate MNEC strain. When mucosal immunization (e.g. intranasal) is used, the animal model is also challenged mucosally to test the protective effect of the mucosal immunogen. Immediately prior to challenge, mice are bled to determine antibody titre to the antigens that were administered.

For the mouse challenge, virulent bacteria will be grown in appropriate media. Bacteria are harvested by centrifugation, re-suspended, and serially diluted for the challenge inoculum. BALB/c mice are challenged and observed daily for 30 days post-exposure.

Total IgG and IgG1/IgG2A subtypes can be measured in mouse sera resulting from the different immunization regimens by using an ELISA assay on whole bacteria and on purified recombinant proteins. Furthermore, assessment of antigen-specific CD4+ and CD8+Th-cells in spleen cells and/or PBMC isolated from immunized mice can be carried out by multi-parametric FACS analysis, to evaluate the cytokine expression profiles of antigen-specific T-cells. In particular production of IFN-γ and IL-5 can be measured after in vitro stimulation of T cells with purified antigens. In addition, splenocytes and/or PBMC from mice immunized with each antigen/vaccine formulation may be collected 10-12 days after the last immunization dose and stimulated with MNEC bacteria. After 4 hours of stimulation, Brefeldin A is added to the cells for the following 12 hours, to block cytokine secretion. Afterwards cells are fixed and stained with antibodies to detect MNEC-specific T cells expressing IFN-γ and IL-5.

T cells can be isolated from peripheral blood lymphocytes (PBLs) by a variety of procedures known to those skilled in the art. For example, T cell populations can be "enriched" from a population of PBLs through the removal of accessory and B cells. In particular, T cell enrichment can be accomplished by the elimination of non-T cells using anti-MHC class II monoclonal antibodies. Similarly, other antibodies can be used to deplete specific populations of non-T cells. For example, anti-Ig antibody molecules can be used to deplete B cells and anti-MacI antibody molecules can be used to deplete macrophages.

T cells can be further fractionated into a number of different subpopulations by techniques known to those skilled in the art. Two major subpopulations can be isolated based on their differential expression of the cell surface markers CD4 and CD8. For example, following the enrichment of T cells as described above, CD4+ cells can be enriched using antibodies specific for CD4. The antibodies may be coupled to a solid support such as magnetic beads. Conversely, CD8+ cells can be enriched through the use of antibodies specific for CD4 (to remove CD4+ cells), or can be-isolated by the use of CD8 antibodies coupled to a solid support. CD4 lymphocytes from MNEC-infected patients can be expanded ex vivo, before or after transduction.

Following purification of T cells, the purified T cells are pre-stimulated with various cytokines including but not limited to rIL-2, IL-10, IL-12, and IL-15, which promote growth and activation of lymphocytes.

MNBC-specific T cells, may be activated by the above described immunogenic polypeptides. MNEC-specific T cells can be CD8+ or CD4+. MNEC-specific CD8+ T cells can be cytotoxic T lymphocytes (CTL) which can kill MNEC-infected cells that display any of the above described polypeptides or fragments thereof complexed with an MHC class I molecule. Chlamydia-specific CD8+ T cells can be detected by, for example, $^{51}$Cr release assays. $^{51}$Cr release assays measure the ability of MNEC-specific CD8+ T cells to lyse target cells displaying one or more of these epitopes. MNEC-specific CD8+ T cells which express antiviral agents, such as IFN γ, are also contemplated herein and can also be detected by immunological methods, preferably by intracellular staining for IFN-γ or alike cytokines after in vitro stimulation with one or more of the above described MNE polypeptides. MNEC-specific CD4+ T cells can be detected by a lymphoproliferation assay. Lymphoproliferation assays measure the ability of MNEC-specific CD4+ T cells to proliferate in response to one or more of the above described polypeptides.

It will be understood that the invention has been described by way of example only and modifications may be made whilst remaining within the scope and spirit of the invention.

TABLE 1

Annotation of ORF00001 to ORF04995

| ORFnnnnn | SEQ ID NOs | Annotation |
|---|---|---|
| ORF00001 | 1 & 2 | Phosphoglycerol transferase I |
| ORF00002 | 3 & 4 | primosomal operon 17.5K protein (mdob-dnac intergenic region) |
| ORF00003 | 5 & 6 | DNA replication protein dnaC |
| ORF00004 | 7 & 8 | Primosomal protein I |
| ORF00005 | 9 & 10 | probable integral membrane protein Cj1165c, putative |
| ORF00006 | 11 & 12 | probable integral membrane protein Cj1166c, putative |
| ORF00007 | 13 & 14 | transcriptional regulator, LuxR family domain protein |
| ORF00008 | 15 & 16 | Transcriptional activator protein bglJ |
| ORF00009 | 17 & 18 | Ferric iron reductase protein fhuF [1.6.99.—] |
| ORF00010 | 19 & 20 | Protein of unknown function (DUF1435) family |
| ORF00011 | 21 & 22 | conserved hypothetical protein |
| ORF00012 | 23 & 24 | Ribosomal RNA small subunit methyltransferase C (AE005668) [2.1.1.52] |
| ORF00013 | 25 & 26 | DNA polymerase III, psi subunit (holD) [2.7.7.7] |
| ORF00014 | 27 & 28 | ribosomal-protein-alanine acetyltransferase (rimI) [2.3.1.128] |
| ORF00015 | 29 & 30 | HAD superfamily (subfamily IA) hydrolase, TIGR02254 |
| ORF00016 | 31 & 32 | site-specific recombinase, phage integrase family |
| ORF00017 | 33 & 34 | hypothetical protein |
| ORF00018 | 35 & 36 | conserved hypothetical protein |
| ORF00019 | 37 & 38 | Hypothetical nin region protein (cysD) |
| ORF00020 | 39 & 40 | hypothetical protein |
| ORF00021 | 41 & 42 | conserved hypothetical protein |
| ORF00022 | 43 & 44 | Sb36 |
| ORF00023 | 45 & 46 | Sb36 |
| ORF00024 | 47 & 48 | hypothetical protein |
| ORF00025 | 49 & 50 | hypothetical protein |
| ORF00026 | 51 & 52 | conserved hypothetical protein |
| ORF00027 | 53 & 54 | repressor |
| ORF00028 | 55 & 56 | Sb40 |
| ORF00029 | 57 & 58 | immunity region |
| ORF00030 | 59 & 60 | conserved hypothetical protein |
| ORF00031 | 61 & 62 | replication protein |
| ORF00032 | 63 & 64 | hypothetical protein |
| ORF00033 | 65 & 66 | phage N-6-adenine-methyltransferase [2.1.1.72] |
| ORF00034 | 67 & 68 | LexA repressor |
| ORF00035 | 69 & 70 | crossover junction endodeoxyribonuclease [3.1.22.—] |
| ORF00036 | 71 & 72 | Sb46 |
| ORF00037 | 73 & 74 | Protein of unknown function (DUF1277) superfamily |
| ORF00038 | 75 & 76 | Antitermination protein Q homolog from lambdoid prophage |
| ORF00039 | 77 & 78 | lysis protein S.b1556 |
| ORF00040 | 79 & 80 | endolysin (lysozyme) [3.2.1.17] |
| ORF00041 | 81 & 82 | Bacteriophage lysis protein |
| ORF00042 | 83 & 84 | hypothetical protein |
| ORF00043 | 85 & 86 | Gifsy-2 prophage protein |
| ORF00044 | 87 & 88 | Phage terminase large subunit (GpA) |
| ORF00045 | 89 & 90 | conserved hypothetical protein |
| ORF00046 | 91 & 92 | phage portal protein, lambda family |
| ORF00047 | 93 & 94 | Gifsy-2 prophage resembles Clp protease |
| ORF00048 | 95 & 96 | conserved hypothetical protein |
| ORF00049 | 97 & 98 | Gifsy-2 prophage ATP-binding sugar transporter-like protein |
| ORF00050 | 99 & 100 | Gifsy 1 prophage: similar to minor tail protein Z |
| ORF00051 | 101 & 102 | Phage minor tail protein U |
| ORF00052 | 103 & 104 | putative tail component of prophage CP-933K |
| ORF00053 | 105 & 106 | phage minor tail protein G |
| ORF00054 | 107 & 108 | phage tail assembly protein T |
| ORF00055 | 109 & 110 | Gifsy-1 prophage protein |
| ORF00056 | 111 & 112 | Phage minor tail protein |
| ORF00057 | 113 & 114 | phage minor tail protein L |
| ORF00058 | 115 & 116 | Putative tail fiber component K of prophage |
| ORF00059 | 117 & 118 | Putative tail fiber component K of prophage |
| ORF00060 | 119 & 120 | Gifsy-1 prophage protein |
| ORF00061 | 121 & 122 | Gifsy-1 prophage protein |
| ORF00062 | 123 & 124 | host specificity protein (partial) |
| ORF00063 | 125 & 126 | Lom |
| ORF00064 | 127 & 128 | conserved hypothetical protein |
| ORF00065 | 129 & 130 | hypothetical protein |
| ORF00066 | 131 & 132 | conserved hypothetical protein |
| ORF00067 | 133 & 134 | conserved hypothetical protein |
| ORF00068 | 135 & 136 | conserved hypothetical protein |
| ORF00069 | 137 & 138 | maturase-related protein |
| ORF00070 | 139 & 140 | DinI-like protein Z3916-ECs3483 (AF175466) |
| ORF00071 | 141 & 142 | peptide chain release factor 3 (prfC) |
| ORF00072 | 143 & 144 | Osmotically inducible protein Y precursor |
| ORF00073 | 145 & 146 | Protein of unknown function (DUF1328) family |
| ORF00074 | 147 & 148 | unnamed protein product |
| ORF00075 | 149 & 150 | Mg-dependent DNase |
| ORF00076 | 151 & 152 | pyruvate formate lyase activating enzyme (act) [1.97.1.4] |

TABLE 1-continued

Annotation of ORF00001 to ORF04995

| ORFnnnnn | SEQ ID NOs | Annotation |
|---|---|---|
| ORF00077 | 153 & 154 | Protein |
| ORF00078 | 155 & 156 | conserved hypothetical protein |
| ORF00079 | 157 & 158 | deoxyribose-phosphate aldolase (deoC) [4.1.2.4] |
| ORF00080 | 159 & 160 | Thymidine phosphorylase (TDRPASE) |
| ORF00081 | 161 & 162 | phosphopentomutase (deoB) [5.4.2.7] |
| ORF00082 | 163 & 164 | purine nucleoside phosphorylase (deoD) [2.4.2.1] |
| ORF00083 | 165 & 166 | conserved hypothetical protein |
| ORF00084 | 167 & 168 | lipoate-protein ligase A [6.3.4.—] |
| ORF00085 | 169 & 170 | Protein smp precursor |
| ORF00086 | 171 & 172 | phosphoserine phosphatase (serB) [3.1.3.3] |
| ORF00087 | 173 & 174 | DNA repair protein RadA (radA) |
| ORF00088 | 175 & 176 | nicotinamide-nucleotide adenylyltransferase [2.7.7.1] |
| ORF00089 | 177 & 178 | conserved hypothetical protein |
| ORF00090 | 179 & 180 | Helix-turn-helix motif |
| ORF00091 | 181 & 182 | ABC transporter ATP-binding protein yjjK (atp_bind) |
| ORF00092 | 183 & 184 | soluble lytic murein transglycosylase [3.2.1.—] |
| ORF00093 | 185 & 186 | trp operon repressor (trpR) |
| ORF00094 | 187 & 188 | conserved hypothetical protein TIGR00258 |
| ORF00095 | 189 & 190 | phosphoglycerate mutase family protein, putative [5.4.2.1] |
| ORF00096 | 191 & 192 | Right origin-binding protein |
| ORF00097 | 193 & 194 | CreA protein |
| ORF00098 | 195 & 196 | Transcriptional Regulatory protein creB |
| ORF00099 | 197 & 198 | Sensor protein creC [2.7.3.—] |
| ORF00100 | 199 & 200 | Inner membrane protein creD (AE005671) |
| ORF00101 | 201 & 202 | Aerobic respiration control protein arcA (Dye resistance protein) (arcA) |
| ORF00102 | 203 & 204 | RNA methyltransferase, TrmH family, group 1 |
| ORF00103 | 205 & 206 | aspartokinase I, homoserine dehydrogenase I |
| ORF00104 | 207 & 208 | homoserine kinase (thrB) [2.7.1.39] |
| ORF00105 | 209 & 210 | threonine synthase (thrC) [4.2.3.1] |
| ORF00106 | 211 & 212 | unnamed protein product; ORF_ID: o101#5 |
| ORF00107 | 213 & 214 | conserved hypothetical protein |
| ORF00108 | 215 & 216 | UPF0246 protein yaaA |
| ORF00109 | 217 & 218 | unnamed protein product (ORF8) |
| ORF00110 | 219 & 220 | transaldolase (tal) [2.2.1.2] |
| ORF00111 | 221 & 222 | Molybdopterin biosynthesis mog protein |
| ORF00112 | 223 & 224 | gpr1-fun34-yaaH family protein |
| ORF00113 | 225 & 226 | unnamed protein product; ORF4 |
| ORF00114 | 227 & 228 | conserved hypothetical protein |
| ORF00115 | 229 & 230 | hypothetical protein |
| ORF00116 | 231 & 232 | chaperone protein DnaK (dnaK) |
| ORF00117 | 233 & 234 | chaperone protein DnaJ (dnaJ) |
| ORF00118 | 235 & 236 | gef protein-related protein |
| ORF00119 | 237 & 238 | Putative conserved protein |
| ORF00120 | 239 & 240 | Sulfatase, putative |
| ORF00121 | 241 & 242 | conserved hypothetical protein |
| ORF00122 | 243 & 244 | Na+-H+ antiporter NhaA (nhaA) |
| ORF00123 | 245 & 246 | Transcriptional activator protein nhaR |
| ORF00124 | 247 & 248 | riboflavin biosynthesis protein RibF (ribF) [2.7.1.26 2.7.7.2] |
| ORF00125 | 249 & 250 | isoleucyl-tRNA synthetase (ileS) [6.1.1.5] |
| ORF00126 | 251 & 252 | lipoprotein signal peptidase (lspA) [3.4.23.36] |
| ORF00127 | 253 & 254 | 5.2.1.8 [5.2.1.8] |
| ORF00128 | 255 & 256 | 4-hydroxy-3-methylbut-2-enyl diphosphate reductase (ispH) [1.17.1.2] |
| ORF00129 | 257 & 258 | inosine-uridine preferring nucleoside hydrolase [3.2.—.—] |
| ORF00130 | 259 & 260 | hyopthetical protein DUF805 |
| ORF00131 | 261 & 262 | dihydrodipicolinate reductase (dapB) [1.3.1.26] |
| ORF00132 | 263 & 264 | carbamoyl-phosphate synthase, small subunit (carA) [6.3.5.5] |
| ORF00133 | 265 & 266 | carbamoyl-phosphate synthase, large subunit (carB) [6.3.5.5] |
| ORF00134 | 267 & 268 | Transposase |
| ORF00135 | 269 & 270 | Transcriptional activatory protein caiF |
| ORF00136 | 271 & 272 | Carnitine operon protein caiE |
| ORF00137 | 273 & 274 | echA1 [5.—.—.—] |
| ORF00138 | 275 & 276 | caiC (fadD) [6.3.2.—] |
| ORF00139 | 277 & 278 | CAIB-BAIF family protein, putative [2.8.3.—] |
| ORF00140 | 279 & 280 | Crotonobetainyl-CoA dehydrogenase (Crotonobetainyl-CoAreductase) (acd) [1.3.99.—] |
| ORF00141 | 281 & 282 | L-carnitine-gamma-butyrobetaine antiporter |
| ORF00142 | 283 & 284 | electron transfer flavoprotein, beta subunit, putative |
| ORF00143 | 285 & 286 | electron transfer flavoprotein, alpha subunit, putative |
| ORF00144 | 287 & 288 | FixC protein [1.5.5.—] |
| ORF00145 | 289 & 290 | Ferredoxin-like protein |
| ORF00146 | 291 & 292 | sugar transporter, putative |
| ORF00147 | 293 & 294 | Glutathione-regulated potassium-efflux system ancillary protein kefF (QUINONE) [1.6.99.2] |
| ORF00148 | 295 & 296 | Glutathione-regulated potassium-efflux system protein kefC (K(+)-H(+)antiporter) |
| ORF00149 | 297 & 298 | dihydrofolate reductase (folA) [1.5.1.3] |
| ORF00150 | 299 & 300 | CcdB antidote CcdA |

TABLE 1-continued

Annotation of ORF00001 to ORF04995

| ORFnnnnn | SEQ ID NOs | Annotation |
|---|---|---|
| ORF00151 | 301 & 302 | CcdB-like protein |
| ORF00152 | 303 & 304 | CcdB-like protein |
| ORF00153 | 305 & 306 | bis(5'-nucleosyl)-tetraphosphatase (symmetrical) [3.6.1.41] |
| ORF00154 | 307 & 308 | Protein apaG (AJ012295) |
| ORF00155 | 309 & 310 | dimethyladenosine transferase (ksgA) [2.1.1.—] |
| ORF00156 | 311 & 312 | 4-hydroxythreonine-4-phosphate dehydrogenase (pdxA) [1.1.1.262] |
| ORF00157 | 313 & 314 | Survival protein surA precursor (Peptidyl-prolyl cis-trans isomerasesurA) (PPIase) (Rotamase C) (PPIase) [5.2.1.8] |
| ORF00158 | 315 & 316 | Organic solvent tolerance protein precursor |
| ORF00159 | 317 & 318 | Organic solvent tolerance protein precursor |
| ORF00160 | 319 & 320 | DnaJ-like protein djlA (AE005182) |
| ORF00161 | 321 & 322 | ribosomal large subunit pseudouridine synthase A |
| ORF00162 | 323 & 324 | RNA polymerase associated protein (hepA) [3.6.1.—] |
| ORF00163 | 325 & 326 | hypothetical protein |
| ORF00164 | 327 & 328 | DNA polymerase II |
| ORF00165 | 329 & 330 | L-ribulose-5-phosphate 4-epimerase (araD) [5.1.3.4] |
| ORF00166 | 331 & 332 | L-arabinose isomerase (araA) [5.3.1.4] |
| ORF00167 | 333 & 334 | L-ribulokinase (araB) [2.7.1.16] |
| ORF00168 | 335 & 336 | transcriptional regulator, AraC family |
| ORF00169 | 337 & 338 | conserved hypothetical protein |
| ORF00170 | 339 & 340 | DedA family integral membrane protein |
| ORF00171 | 341 & 342 | thiamine ABC transporter, ATP-binding protein |
| ORF00172 | 343 & 344 | thiamine-thiamine pyrophosphate ABC transporter, permease protein (thiP) |
| ORF00173 | 345 & 346 | thiamin-thiamin pyrophosphate ABC transporter, thiamin-thiamin pyrophospate-binding protein (thiB) |
| ORF00174 | 347 & 348 | Bacterial extracellular solute-binding proteins, family 5 family |
| ORF00175 | 349 & 350 | 3-isopropylmalate dehydratase, small subunit (leuD) [4.2.1.33] |
| ORF00176 | 351 & 352 | 3-isopropylmalate dehydratase, large subunit (leuC) [4.2.1.33] |
| ORF00177 | 353 & 354 | 3-isopropylmalate dehydrogenase (leuB) [1.1.1.85] |
| ORF00178 | 355 & 356 | 2-isopropylmalate synthase (leuA) [2.3.3.13] |
| ORF00179 | 357 & 358 | LeuO protein. |
| ORF00180 | 359 & 360 | acetolactate synthase, large subunit, biosynthetic type (ilvB) [2.2.1.6] |
| ORF00181 | 361 & 362 | acetolactate synthase, small subunit (ilvN) [2.2.1.6] |
| ORF00182 | 363 & 364 | transcriptional repressor of fru operon and others |
| ORF00183 | 365 & 366 | mraZ protein (mraZ) |
| ORF00184 | 367 & 368 | S-adenosyl-methyltransferase MraW (mraW) [2.1.1.—] |
| ORF00185 | 369 & 370 | Cell division protein ftsL |
| ORF00186 | 371 & 372 | Peptidoglycan synthetase ftsI precursor (PBP) [2.4.1.129] |
| ORF00187 | 373 & 374 | UDP-N-acetylmuramoylalanyl-D-glutamate--2,6-diaminopimelate ligase |
| ORF00188 | 375 & 376 | UDP-N-acetylmuramoylalanyl-D-glutamyl-2,6-diaminopimelate--D-alanyl-D-alanyl ligase (murF) [6.3.2.10] |
| ORF00189 | 377 & 378 | phospho-N-acetylmuramoyl-pentapeptide-transferase (mraY) [2.7.8.13] |
| ORF00190 | 379 & 380 | UDP-N-acetylmuramoylalanine--D-glutamate ligase (murD) [6.3.2.9] |
| ORF00191 | 381 & 382 | Cell division protein ftsW |
| ORF00192 | 383 & 384 | undecaprenyldiphospho-muramoylpentapeptide beta-N-acetylglucosaminyltransferase (murG) [2.4.1.227] |
| ORF00193 | 385 & 386 | UDP-N-acetylmuramate--alanine ligase (murC) [6.3.2.8] |
| ORF00194 | 387 & 388 | D-alanine--D-alanine ligase B (ddlB) [6.3.2.4] |
| ORF00195 | 389 & 390 | Acetolactate synthase isozyme III large subunit [4.1.3.18] |
| ORF00196 | 391 & 392 | acetolactate synthase, small subunit (ilvN) [2.2.1.6] |
| ORF00197 | 393 & 394 | fructose repressor (catabolite repressor-activator) |
| ORF00198 | 395 & 396 | fructose repressor (catabolite repressor-activator) |
| ORF00199 | 397 & 398 | Acetolactate synthase isozyme III large subunit [4.1.3.18] |
| ORF00200 | 399 & 400 | acetolactate synthase, small subunit (ilvN) [2.2.1.6] |
| ORF00201 | 401 & 402 | fructose repressor (catabolite repressor-activator) |
| ORF00202 | 403 & 404 | D-alanine-D-alanine ligase B (ddlB) [6.3.2.4] |
| ORF00203 | 405 & 406 | cell division protein ftsQ |
| ORF00204 | 407 & 408 | cell division protein FtsA (ftsA) |
| ORF00205 | 409 & 410 | Cell division protein ftsZ |
| ORF00206 | 411 & 412 | UDP-3-0-acyl N-acetylglucosamine deacetylase (lpxC) [3.5.1.—] |
| ORF00207 | 413 & 414 | Secretion monitor precursor |
| ORF00208 | 415 & 416 | secA protein |
| ORF00209 | 417 & 418 | preprotein translocase, SecA subunit (secA) |
| ORF00210 | 419 & 420 | Mutator mutT protein (mutT) [3.6.1.—] |
| ORF00211 | 421 & 422 | UPF0243 zinc-binding protein yacG-related protein |
| ORF00212 | 423 & 424 | Hypothetical UPF0289 protein yacF |
| ORF00213 | 425 & 426 | dephospho-CoA kinase (coaE) [2.7.1.24] |
| ORF00214 | 427 & 428 | guanosine monophosphate reductase (guaC) [1.7.1.7] |
| ORF00215 | 429 & 430 | Protein transport protein hofC (MTB) |
| ORF00216 | 431 & 432 | Protein transport protein hofB (MTB) |
| ORF00217 | 433 & 434 | Prepilin peptidase dependent protein D precursor |
| ORF00218 | 435 & 436 | nicotinate-nucleotide pyrophosphorylase (nadC) [2.4.2.19] |
| ORF00219 | 437 & 438 | AmpD protein (ampD) |
| ORF00220 | 439 & 440 | regulates ampC |
| ORF00221 | 441 & 442 | Aromatic amino acid transport protein aroP (General aromatic aminoacid permease) |

TABLE 1-continued

Annotation of ORF00001 to ORF04995

| ORFnnnnn | SEQ ID NOs | Annotation |
|---|---|---|
| ORF00222 | 443 & 444 | uropathogenic specific protein |
| ORF00223 | 445 & 446 | unnamed protein product; 9 bp deletion at the 3' end OrfU2 |
| ORF00224 | 447 & 448 | uropathogenic specific protein (partial) [3.1.—.—] |
| ORF00225 | 449 & 450 | unnamed protein product; OrfU3 |
| ORF00226 | 451 & 452 | unnamed protein product; OrfU1 |
| ORF00227 | 453 & 454 | Pyruvate dehydrogenase complex repressor |
| ORF00228 | 455 & 456 | Pyruvate dehydrogenase E1 component (aceE) [1.2.4.1] |
| ORF00229 | 457 & 458 | pyruvate dehydrogenase complex dihydrolipoamide acetyltransferase (aceF) [2.3.1.12] |
| ORF00230 | 459 & 460 | dihydrolipoamide dehydrogenase (lpdA) [1.8.1.4] |
| ORF00231 | 461 & 462 | conserved hypothetical protein |
| ORF00232 | 463 & 464 | hypothetical protein |
| ORF00233 | 465 & 466 | hypothetical protein |
| ORF00234 | 467 & 468 | aconitate hydratase 2 (acnB) [4.2.1.3] |
| ORF00235 | 469 & 470 | S-adenosylmethionine decarboxylase proenzyme |
| ORF00236 | 471 & 472 | spermidine synthase (speE) [2.5.1.16] |
| ORF00237 | 473 & 474 | yacC |
| ORF00238 | 475 & 476 | Blue copper oxidase cueO precursor |
| ORF00239 | 477 & 478 | Glucose dehydrogenase |
| ORF00240 | 479 & 480 | hypoxanthine phosphoribosyltransferase (hpt) [2.4.2.8] |
| ORF00241 | 481 & 482 | Protein yadF [4.2.1.1] |
| ORF00242 | 483 & 484 | ABC transporter ATP-binding protein |
| ORF00243 | 485 & 486 | ABC transporter integral membrane protein STY0195 (membrane) |
| ORF00244 | 487 & 488 | Fructose-specific phosphotransferase system component homolog. (PTS) [2.7.1.69] |
| ORF00245 | 489 & 490 | Polysaccharide deacetylase domain protein |
| ORF00246 | 491 & 492 | aspartate 1-decarboxylase (panD) [4.1.1.11] |
| ORF00247 | 493 & 494 | transposase |
| ORF00248 | 495 & 496 | pantoate--beta-alanine ligase (panC) [6.3.2.1] |
| ORF00249 | 497 & 498 | 3-methyl-2-oxobutanoate hydroxymethyltransferase (panB) [2.1.2.11] |
| ORF00250 | 499 & 500 | Hypothetical fimbrial-like protein yadC precursor |
| ORF00251 | 501 & 502 | Protein yadK |
| ORF00252 | 503 & 504 | Fimbrial protein subfamily |
| ORF00253 | 505 & 506 | hypothetical protein |
| ORF00254 | 507 & 508 | Outer membrane usher protein htrE precursor |
| ORF00255 | 509 & 510 | Chaperone protein ecpD precursor |
| ORF00256 | 511 & 512 | pilin chaperone ecpD2 |
| ORF00257 | 513 & 514 | 2-amino-4-hydroxy-6-hydroxymethyldihydropteridine pyrophosphokinase (folK) [2.7.6.3] |
| ORF00258 | 515 & 516 | Poly(A) polymerase (PAP) (Plasmid copy number protein) (PAP) [2.7.7.19] |
| ORF00259 | 517 & 518 | poly(A) polymerase (PAP) |
| ORF00260 | 519 & 520 | glutamate-tRNA ligase homolog yadB |
| ORF00261 | 521 & 522 | dnaK suppressor protein |
| ORF00262 | 523 & 524 | sugar fermentation stimulation protein (sfsA) |
| ORF00263 | 525 & 526 | 2-5 RNA ligase |
| ORF00264 | 527 & 528 | ATP-dependent helicase HrpB (hrpB) |
| ORF00265 | 529 & 530 | peptidoglycan synthetase penicillin-binding protein 1B |
| ORF00266 | 531 & 532 | penicillin-binding protein 1B (mrcB) |
| ORF00267 | 533 & 534 | Ferrichrome-iron receptor precursor (Ferric hydroxamate uptake)(Ferric hydroxamate receptor) |
| ORF00268 | 535 & 536 | Ferrichrome transport ATP-binding protein fhuC |
| ORF00269 | 537 & 538 | Ferrichrome-binding periplasmic protein precursor |
| ORF00270 | 539 & 540 | Ferrichrome transport system permease protein fhuB (membrane) |
| ORF00271 | 541 & 542 | glutamate-1-semialdehyde-2,1-aminomutase (hemL) [5.4.3.8] |
| ORF00272 | 543 & 544 | H(+)-Cl(−) exchange transporter clcA |
| ORF00273 | 545 & 546 | HesB family protein |
| ORF00274 | 547 & 548 | predicted membrane protein |
| ORF00275 | 549 & 550 | Vitamin B12 transport protein btuF precursor (PBP) |
| ORF00276 | 551 & 552 | MTA-SAH nucleosidase |
| ORF00277 | 553 & 554 | deoxyguanosinetriphosphate triphosphohydrolase, putative subfamily [3.1.5.1] |
| ORF00278 | 555 & 556 | htrA product [3.4.21.—] |
| ORF00279 | 557 & 558 | Carbohydrate diacid regulator |
| ORF00280 | 559 & 560 | Hypothetical UPF0325 protein yaeH |
| ORF00281 | 561 & 562 | 2,3,4,5-tetrahydropyridine-2,6-dicarboxylate N-succinyltransferase (dapD) [2.3.1.117] |
| ORF00282 | 563 & 564 | protein-P-II uridylyltransferase (glnD) [2.7.7.59] |
| ORF00283 | 565 & 566 | methionine aminopeptidase, type I (map) [3.4.11.18] |
| ORF00284 | 567 & 568 | conserved hypothetical protein |
| ORF00285 | 569 & 570 | 30S ribosomal protein S2 |
| ORF00286 | 571 & 572 | translation elongation factor Ts (tsf) |
| ORF00287 | 573 & 574 | uridylate kinase (pyrH) [2.7.4.—] |
| ORF00288 | 575 & 576 | ribosome recycling factor (frr) |
| ORF00289 | 577 & 578 | 1-deoxy-D-xylulose 5-phosphate reductoisomerase (dxr) [1.1.1.267] |
| ORF00290 | 579 & 580 | undecaprenyl diphosphate synthase (uppS) [2.5.1.31] |
| ORF00291 | 581 & 582 | phosphatidate cytidylyltransferase (cdsA) [2.7.7.41] |
| ORF00292 | 583 & 584 | membrane-associated zinc metalloprotease, putative |
| ORF00293 | 585 & 586 | outer membrane protein precursor yaeT (D15) |

TABLE 1-continued

Annotation of ORF00001 to ORF04995

| ORFnnnnn | SEQ ID NOs | Annotation |
|---|---|---|
| ORF00294 | 587 & 588 | histone-like protein, located in outer membrane or |
| ORF00295 | 589 & 590 | UDP-3-O-[3-hydroxymyristoyl] glucosamine N-acyltransferase (lpxD) [2.3.1.—] |
| ORF00296 | 591 & 592 | (3R)-hydroxymyristol acyl carrier protein dehydratase [4.2.1.—] |
| ORF00297 | 593 & 594 | acyl-[acyl-carrier-protein]--UDP-N-acetylglucosamine O-acyltransferase (lpxA) [2.3.1.129] |
| ORF00298 | 595 & 596 | lipid-A-disaccharide synthase (lpxB) [2.4.1.182] |
| ORF00299 | 597 & 598 | ribonuclease HII (rnhB) [3.1.26.4] |
| ORF00300 | 599 & 600 | DNA polymerase III alpha subunit (dnaE) [2.7.7.7] |
| ORF00301 | 601 & 602 | acetyl-CoA carboxylase, carboxyl transferase, alpha subunit (accA) [6.4.1.2] |
| ORF00302 | 603 & 604 | Lysine decarboxylase, constitutive (ldc) [4.1.1.18] |
| ORF00303 | 605 & 606 | Lysine decarboxylase, constitutive (ldc) [4.1.1.18] |
| ORF00304 | 607 & 608 | lactoylglutathione lyase |
| ORF00305 | 609 & 610 | cell cycle protein (Ile) |
| ORF00306 | 611 & 612 | Rof protein |
| ORF00307 | 613 & 614 | putative cytoplasmic protein |
| ORF00308 | 615 & 616 | YaeQ protein |
| ORF00309 | 617 & 618 | Peptidyl-tRNA hydrolase domain, putative |
| ORF00310 | 619 & 620 | Copper homeostasis protein cutF precursor (lipoprotein) |
| ORF00311 | 621 & 622 | yaeF protein |
| ORF00312 | 623 & 624 | prolyl-tRNA synthetase (proS) [6.1.1.15] |
| ORF00313 | 625 & 626 | UPF0066 protein rcsF (orf3) |
| ORF00314 | 627 & 628 | Protein rcsF |
| ORF00315 | 629 & 630 | D-methionine-binding lipoprotein metQ precursor (hlpA) |
| ORF00316 | 631 & 632 | D-methionine transport system permease protein metI (membrane) |
| ORF00317 | 633 & 634 | D-methionine ABC transporter, ATP-binding protein (metN) |
| ORF00318 | 635 & 636 | unnamed protein product |
| ORF00319 | 637 & 638 | hypothetical protein |
| ORF00320 | 639 & 640 | 2,5-diketo-D-gluconic acid reductase B (orf267) [1.1.1.274] |
| ORF00321 | 641 & 642 | unnamed protein product; Highly similar to LysR-family transcriptional regulator, YafC protein of Escherichia coli (orf304) |
| ORF00322 | 643 & 644 | unnamed protein product |
| ORF00323 | 645 & 646 | methlytransferase, UbiE-COQ5 family |
| ORF00324 | 647 & 648 | Membrane-bound lytic murein transglycosylase D precursor(Murein hydrolase D) (Regulatory protein dniR) [3.2.1.—] |
| ORF00325 | 649 & 650 | hydroxyacylglutathione hydrolase [3.1.2.6] |
| ORF00326 | 651 & 652 | hypothetical protein |
| ORF00327 | 653 & 654 | conserved hypothetical protein |
| ORF00328 | 655 & 656 | RNase HI, degrades RNA of DNA-RNA hybrids |
| ORF00329 | 657 & 658 | DNA polymerase III, epsilon subunit (dnaQ) [2.7.7.7] |
| ORF00330 | 659 & 660 | Hypothetical lipoprotein yafT precursor |
| ORF00331 | 661 & 662 | Aec32 |
| ORF00332 | 663 & 664 | Aec31 |
| ORF00333 | 665 & 666 | Aec30 |
| ORF00334 | 667 & 668 | Aec29 |
| ORF00335 | 669 & 670 | hypothetical protein |
| ORF00336 | 671 & 672 | Aec28 |
| ORF00337 | 673 & 674 | Aec27 |
| ORF00338 | 675 & 676 | Aec26 |
| ORF00339 | 677 & 678 | Aec25 |
| ORF00340 | 679 & 680 | Aec24 |
| ORF00341 | 681 & 682 | Aec23 |
| ORF00342 | 683 & 684 | hypothetical protein |
| ORF00343 | 685 & 686 | Aec22 |
| ORF00344 | 687 & 688 | Aec20 |
| ORF00345 | 689 & 690 | Aec19 |
| ORF00346 | 691 & 692 | Aec18 |
| ORF00347 | 693 & 694 | Aec17 |
| ORF00348 | 695 & 696 | Aec16 |
| ORF00349 | 697 & 698 | Aec15 (AF044503) |
| ORF00350 | 699 & 700 | Aec14 |
| ORF00351 | 701 & 702 | Aec13 |
| ORF00352 | 703 & 704 | Transposase (IS4 family) |
| ORF00353 | 705 & 706 | Aec7 |
| ORF00354 | 707 & 708 | possible hydrolase |
| ORF00355 | 709 & 710 | hypothetical protein |
| ORF00356 | 711 & 712 | Inhibitor of vertebrate lysozyme precursor |
| ORF00357 | 713 & 714 | Acyl-CoA dehydrogenase (EC 1.3.99.—). [1.3.99.—] |
| ORF00358 | 715 & 716 | Phosphoheptose isomerase (gmhA) [5.—.—.—] |
| ORF00359 | 717 & 718 | Bacterial protein of unknown function (DUF949) superfamily |
| ORF00360 | 719 & 720 | Predicted glutamine amidotransferase |
| ORF00361 | 721 & 722 | conserved hypothetical protein |
| ORF00362 | 723 & 724 | Hypothetical lipoprotein yafL precursor |
| ORF00363 | 725 & 726 | Protein of unknown function (DUF1568) domain protein |
| ORF00364 | 727 & 728 | FhiA protein |
| ORF00365 | 729 & 730 | MbhA protein |
| ORF00366 | 731 & 732 | DNA polymerase IV (Pol IV) [2.7.7.7] |

TABLE 1-continued

Annotation of ORF00001 to ORF04995

| ORFnnnnn | SEQ ID NOs | Annotation |
|---|---|---|
| ORF00367 | 733 & 734 | prevent-host-death family protein |
| ORF00368 | 735 & 736 | unnamed protein product |
| ORF00369 | 737 & 738 | Hypothetical acetyltransferase yafP [2.3.1.—] |
| ORF00370 | 739 & 740 | uncharacterized conserved protein, RtcB-UPF0027 family CAC3383 |
| ORF00371 | 741 & 742 | Peptide chain release factor homolog (RF) |
| ORF00372 | 743 & 744 | aminoacyl-histidine dipeptidase PepD |
| ORF00373 | 745 & 746 | Xanthine-guanine phosphoribosyltransferase (XGPRT) [2.4.2.22] |
| ORF00374 | 747 & 748 | Hydrolases of the alpha-beta superfamily |
| ORF00375 | 749 & 750 | Curlin genes transcriptional activatory protein |
| ORF00376 | 751 & 752 | Outer membrane pore protein E precursor |
| ORF00377 | 753 & 754 | glutamate 5-kinase (proB) [2.7.2.11] |
| ORF00378 | 755 & 756 | gamma-glutamyl phosphate reductase (proA) [1.2.1.41] |
| ORF00379 | 757 & 758 | HTH-type transcriptional regulator prsX |
| ORF00380 | 759 & 760 | Haemoglobin protease |
| ORF00381 | 761 & 762 | InsA |
| ORF00382 | 763 & 764 | InsB |
| ORF00383 | 765 & 766 | conserved hypothetical protein |
| ORF00384 | 767 & 768 | YagU |
| ORF00385 | 769 & 770 | Uncharacterised protein family (UPF0153) superfamily |
| ORF00386 | 771 & 772 | conserved hypothetical protein |
| ORF00387 | 773 & 774 | conserved hypothetical protein |
| ORF00388 | 775 & 776 | conserved hypothetical protein |
| ORF00389 | 777 & 778 | conserved hypothetical protein |
| ORF00390 | 779 & 780 | MatB precursor |
| ORF00391 | 781 & 782 | transcriptional regulator, LuxR family domain protein |
| ORF00392 | 783 & 784 | ribosomal protein L36 (rpmJ) |
| ORF00393 | 785 & 786 | tail protein |
| ORF00394 | 787 & 788 | Sb24 |
| ORF00395 | 789 & 790 | tail fiber assembly protein |
| ORF00396 | 791 & 792 | T4-exclusion protein gpIBEGd |
| ORF00397 | 793 & 794 | hypothetical protein |
| ORF00398 | 795 & 796 | hypothetical protein |
| ORF00399 | 797 & 798 | NADH-dependent flavin oxidoreductase, Oye family [1.—.—.—] |
| ORF00400 | 799 & 800 | dienelactone hydrolase domain protein (AE000230) |
| ORF00401 | 801 & 802 | transcription regulator, LysR family Atu5241 |
| ORF00402 | 803 & 804 | transcriptional regulator (LysR family) |
| ORF00403 | 805 & 806 | oxidoreductase, aldo-keto reductase family |
| ORF00404 | 807 & 808 | 2,5-diketo-D-gluconic acid reductase A [1.1.1.—] |
| ORF00405 | 809 & 810 | Putative adhesin |
| ORF00406 | 811 & 812 | Hypothetical transcriptional regulator ykgA |
| ORF00407 | 813 & 814 | 2,5-diketo-D-gluconic acid reductase A |
| ORF00408 | 815 & 816 | MC21 |
| ORF00409 | 817 & 818 | Protein of unknown function (DUF1471) superfamily |
| ORF00410 | 819 & 820 | pyridine nucleotide-disulfide oxidoreductase [1.16.1.1] |
| ORF00411 | 821 & 822 | Hypothetical transcriptional regulator ykgD |
| ORF00412 | 823 & 824 | Cysteine-rich domain protein |
| ORF00413 | 825 & 826 | iron-sulfur cluster binding protein |
| ORF00414 | 827 & 828 | Uncharacterized ACR, YkgG family COG1556 family |
| ORF00415 | 829 & 830 | hypothetical protein |
| ORF00416 | 831 & 832 | outer membrane autotransporter barrel domain protein |
| ORF00417 | 833 & 834 | conserved hypothetical protein |
| ORF00418 | 835 & 836 | conserved hypothetical protein |
| ORF00419 | 837 & 838 | Type 1 fimbriae Regulatory protein fimB |
| ORF00420 | 839 & 840 | choline dehydrogenase (betA) [1.1.99.1] |
| ORF00421 | 841 & 842 | betaine aldehyde dehydrogenase (betB) [1.2.1.8] |
| ORF00422 | 843 & 844 | Regulatory protein betI (U73857) |
| ORF00423 | 845 & 846 | High-affinity choline transport protein |
| ORF00424 | 847 & 848 | EAL domain protein |
| ORF00425 | 849 & 850 | allS |
| ORF00426 | 851 & 852 | glutathione-regulated potassium-efflux system protein |
| ORF00427 | 853 & 854 | ankyrin repeat domain protein |
| ORF00428 | 855 & 856 | conserved hypothetical protein |
| ORF00429 | 857 & 858 | YahF-FdrA-like protein |
| ORF00430 | 859 & 860 | YahG-YlbE-like protein |
| ORF00431 | 861 & 862 | Carbamate kinase-like protein yahI [2.7.2.2] |
| ORF00432 | 863 & 864 | Cytosine deaminase |
| ORF00433 | 865 & 866 | Protein of unknown function (DUF984) superfamily |
| ORF00434 | 867 & 868 | ABC transporter, substrate binding protein [sugar] (AE005211) |
| ORF00435 | 869 & 870 | ribose ABC transporter (ATP-binding protein) |
| ORF00436 | 871 & 872 | ribose ABC transporter, permease protein, putative |
| ORF00437 | 873 & 874 | ABC sugar transporter, permease subunit (permease) |
| ORF00438 | 875 & 876 | oxidoreductase, zinc-binding [1.1.1.2] |
| ORF00439 | 877 & 878 | RhtC-like transporter STY0397 (RhtC) |
| ORF00440 | 879 & 880 | Protein of unknown function (DUF1471) superfamily |
| ORF00441 | 881 & 882 | propionate catabolism operon regulatory protein PrpR (prpR) |
| ORF00442 | 883 & 884 | hypothetical protein |

TABLE 1-continued

Annotation of ORF00001 to ORF04995

| ORFnnnnn | SEQ ID NOs | Annotation |
|---|---|---|
| ORF00443 | 885 & 886 | regulator for prp operon |
| ORF00444 | 887 & 888 | hypothetical protein |
| ORF00445 | 889 & 890 | methylisocitrate lyase (prpB) [4.1.3.30] |
| ORF00446 | 891 & 892 | 2-methylcitrate synthase (Methylcitrate synthase)(Citrate synthase 2) [2.3.3.5] |
| ORF00447 | 893 & 894 | 2-methylcitrate dehydratase (prpD) [4.2.1.79] |
| ORF00448 | 895 & 896 | propionate--CoA ligase (prpE) [6.2.1.17] |
| ORF00449 | 897 & 898 | cytosine transporter, putative |
| ORF00450 | 899 & 900 | Cytosine deaminase |
| ORF00451 | 901 & 902 | Galactoside O-acetyltransferase [2.3.1.18] |
| ORF00452 | 903 & 904 | Lactose permease (Lactose-proton symport) |
| ORF00453 | 905 & 906 | Beta-galactosidase (lacZ) [3.2.1.23] |
| ORF00454 | 907 & 908 | transcriptional regulator, lacI family domain protein, putative |
| ORF00455 | 909 & 910 | Arac-family transcriptional regulator |
| ORF00456 | 911 & 912 | nucleoprotein-polynucleotide-associated enzyme |
| ORF00457 | 913 & 914 | carboxylesterase [3.1.1.1] |
| ORF00458 | 915 & 916 | alcohol dehydrogenase [similarity] (adhC) [1.—.—.—] |
| ORF00459 | 917 & 918 | putative alpha helix chain |
| ORF00460 | 919 & 920 | conserved hypothetical protein |
| ORF00461 | 921 & 922 | Sugar phosphate nucleotydyl transferase |
| ORF00462 | 923 & 924 | glucosaminyltransferase |
| ORF00463 | 925 & 926 | Putative conserved protein |
| ORF00464 | 927 & 928 | taurine ABC transporter, periplasmic binding protein (tauA) |
| ORF00465 | 929 & 930 | taurine ABC transporter, ATP-binding protein (cmpC) |
| ORF00466 | 931 & 932 | Taurine transport system permease protein tauC |
| ORF00467 | 933 & 934 | alpha-ketoglutarate-dependent taurine dioxygenase [1.—.—.—] |
| ORF00468 | 935 & 936 | delta-aminolevulinic acid dehydratase (hemB) [4.2.1.24] |
| ORF00469 | 937 & 938 | puative autotransporter-virulence factor STY0405 (partial) |
| ORF00470 | 939 & 940 | conserved hypothetical protein |
| ORF00471 | 941 & 942 | beta-lactamase |
| ORF00472 | 943 & 944 | SbmA protein |
| ORF00473 | 945 & 946 | lipoprotein, putative |
| ORF00474 | 947 & 948 | conserved hypothetical protein |
| ORF00475 | 949 & 950 | conserved hypothetical protein |
| ORF00476 | 951 & 952 | D-alanine--D-alanine ligase A (D-alanylalanine synthetaseA) (D-Ala-D-Ala ligase A) [6.3.2.4] |
| ORF00477 | 953 & 954 | conserved hypothetical protein |
| ORF00478 | 955 & 956 | LD01705p |
| ORF00479 | 957 & 958 | Alkaline phosphatase precursor |
| ORF00480 | 959 & 960 | induced by phosphate starvation |
| ORF00481 | 961 & 962 | AdrA protein (GGDEF) |
| ORF00482 | 963 & 964 | pyrroline-5-carboxylate reductase (proC) [1.5.1.2] |
| ORF00483 | 965 & 966 | YaiI-YqxD family protein family |
| ORF00484 | 967 & 968 | shikimate kinase (aroK) [2.7.1.71] |
| ORF00485 | 969 & 970 | conserved hypothetical protein |
| ORF00486 | 971 & 972 | AroM protein |
| ORF00487 | 973 & 974 | uncharacterized protein conserved in bacteria |
| ORF00488 | 975 & 976 | conserved hypothetical protein |
| ORF00489 | 977 & 978 | conserved hypothetical protein |
| ORF00490 | 979 & 980 | Recombination associated protein rdgC |
| ORF00491 | 981 & 982 | possible NAGC-like transcriptional regulator |
| ORF00492 | 983 & 984 | major facilitator family transporter |
| ORF00493 | 985 & 986 | Exonuclease sbcC (P-loop) [3.1.15.—] |
| ORF00494 | 987 & 988 | exonuclease SbcD (SbcD) [3.1.—.—] |
| ORF00495 | 989 & 990 | conserved hypothetical protein |
| ORF00496 | 991 & 992 | phosphate regulon transcriptional regulatory protein PhoB (phoB) |
| ORF00497 | 993 & 994 | Phosphate regulon sensor protein phoR |
| ORF00498 | 995 & 996 | hypothetical protein |
| ORF00499 | 997 & 998 | conserved hypothetical protein |
| ORF00500 | 999 & 1000 | branched-chain amino acid transport system II carrier protein (brnQ) |
| ORF00501 | 1001 & 1002 | Proline-specific permease proY |
| ORF00502 | 1003 & 1004 | maltodextrin glucosidase [3.2.1.20] |
| ORF00503 | 1005 & 1006 | Protein of unknown function, DUF479 superfamily |
| ORF00504 | 1007 & 1008 | S-adenosylmethionine:tRNA ribosyltransferase-isomerase (queA) [5.—.—.—] |
| ORF00505 | 1009 & 1010 | queuine tRNA-ribosyltransferase (tgt) [2.4.2.29] |
| ORF00506 | 1011 & 1012 | preprotein translocase, YajC subunit, putative |
| ORF00507 | 1013 & 1014 | Protein-export membrane protein secD |
| ORF00508 | 1015 & 1016 | protein-export membrane protein secF |
| ORF00509 | 1017 & 1018 | HNH endonuclease domain protein |
| ORF00510 | 1019 & 1020 | Nucleoside-specific channel-forming protein tsx precursor |
| ORF00511 | 1021 & 1022 | yajI protein |
| ORF00512 | 1023 & 1024 | conserved hypothetical protein TIGR00244 |
| ORF00513 | 1025 & 1026 | riboflavin biosynthesis protein RibD (ribD) [3.5.4.26 1.1.1.193] |
| ORF00514 | 1027 & 1028 | 6,7-dimethyl-8-ribityllumazine synthase |
| ORF00515 | 1029 & 1030 | transcription antitermination factor NusB (nusB) |
| ORF00516 | 1031 & 1032 | thiamine-monophosphate kinase (thiL) [2.7.4.16] |
| ORF00517 | 1033 & 1034 | Phosphatidylglycerophosphatase A |

TABLE 1-continued

Annotation of ORF00001 to ORF04995

| ORFnnnnn | SEQ ID NOs | Annotation |
|---|---|---|
| ORF00518 | 1035 & 1036 | probable oxidoreductase yajO [1.—.—.—] |
| ORF00519 | 1037 & 1038 | 1-deoxy-D-xylulose-5-phosphate synthase (dxs) [2.2.1.7] |
| ORF00520 | 1039 & 1040 | Geranyltranstransferase (Farnesyl-diphosphate synthase)(FPP synthase) (ispA) [2.5.1.10] |
| ORF00521 | 1041 & 1042 | exodeoxyribonuclease VII, small subunit (xseB) [3.1.11.6] |
| ORF00522 | 1043 & 1044 | hypothetical protein |
| ORF00523 | 1045 & 1046 | Thiamine biosynthesis protein thiI (thiI) |
| ORF00524 | 1047 & 1048 | 4-methyl-5(B-hydroxyethyl)-thiazole monophosphate biosynthesis enzyme (ThiJ) |
| ORF00525 | 1049 & 1050 | 2-dehydropantoate 2-reductase (panE) [1.1.1.169] |
| ORF00526 | 1051 & 1052 | Protein yajQ |
| ORF00527 | 1053 & 1054 | Hypothetical transport protein yajR |
| ORF00528 | 1055 & 1056 | protoheme IX farnesyltransferase (cyoE) [2.5.1.—] |
| ORF00529 | 1057 & 1058 | cytochrome o ubiquinol oxidase C subunit [1.10.3.—] |
| ORF00530 | 1059 & 1060 | Cytochrome c oxidase subunit III |
| ORF00531 | 1061 & 1062 | Ubiquinol oxidase polypeptide I (Cytochrome o subunit 1)(Oxidase BO(3) subunit 1) (Cytochrome o ubiquinol oxidase subunit 1)(Ubiquinol oxidase chain A) [1.10.3.—] |
| ORF00532 | 1063 & 1064 | Ubiquinol oxidase polypeptide II precursor (Cytochrome osubunit 2) (Oxidase BO(3) subunit 2) (Cytochrome o ubiquinol oxidasesubunit 2) (Ubiquinol oxidase chain B) [1.10.3.—] |
| ORF00533 | 1065 & 1066 | beta-lactamase induction signal transducer AmpG |
| ORF00534 | 1067 & 1068 | AmpG-signal transducer |
| ORF00535 | 1069 & 1070 | putative polymerase-proteinase |
| ORF00536 | 1071 & 1072 | BolA protein |
| ORF00537 | 1073 & 1074 | conserved hypothetical protein |
| ORF00538 | 1075 & 1076 | Trigger factor (TF) (tig) |
| ORF00539 | 1077 & 1078 | conserved hypothetical protein |
| ORF00540 | 1079 & 1080 | trigger factor (tig) [5.2.1.8] |
| ORF00541 | 1081 & 1082 | ATP-dependent Clp protease, proteolytic subunit ClpP (clpP) [3.4.21.92] |
| ORF00542 | 1083 & 1084 | ATP-dependent Clp protease, ATP-binding subunit ClpX (clpX) |
| ORF00543 | 1085 & 1086 | ATP-dependent protease La (lon) [3.4.21.53] |
| ORF00544 | 1087 & 1088 | DNA-binding protein HU-beta, NS1 (HU) |
| ORF00545 | 1089 & 1090 | Peptidyl-prolyl cis-trans isomerase D (PPlase D)(Rotamase D) [5.2.1.8] |
| ORF00546 | 1091 & 1092 | DNA uptake protein |
| ORF00547 | 1093 & 1094 | Predicted thioesterase |
| ORF00548 | 1095 & 1096 | exsB protein |
| ORF00549 | 1097 & 1098 | conserved hypothetical protein |
| ORF00550 | 1099 & 1100 | Cof protein |
| ORF00551 | 1101 & 1102 | transcriptional regulator, AsnC family |
| ORF00552 | 1103 & 1104 | Multidrug resistance-like ATP-binding protein mdlA (atp) |
| ORF00553 | 1105 & 1106 | multidrug resistance-like ATP-binding protein Mdl |
| ORF00554 | 1107 & 1108 | glutamine synthetase activity regulation protein |
| ORF00555 | 1109 & 1110 | ammonium transporter (amt) |
| ORF00556 | 1111 & 1112 | acyl-CoA thioesterase II (tesB) [3.1.2.—] |
| ORF00557 | 1113 & 1114 | hypothetical protein |
| ORF00558 | 1115 & 1116 | glycoprotein-polysaccharide metabolism |
| ORF00559 | 1117 & 1118 | predicted methylated DNA-protein cysteine methyltransferase |
| ORF00560 | 1119 & 1120 | Protein of unknown function (DUF1428) superfamily |
| ORF00561 | 1121 & 1122 | EAL domain protein |
| ORF00562 | 1123 & 1124 | conserved hypothetical protein |
| ORF00563 | 1125 & 1126 | Maltose O-acetyltransferase [2.3.1.79] |
| ORF00564 | 1127 & 1128 | hypothetical protein |
| ORF00565 | 1129 & 1130 | Hha protein |
| ORF00566 | 1131 & 1132 | YmoB |
| ORF00567 | 1133 & 1134 | Acriflavine resistance protein B |
| ORF00568 | 1135 & 1136 | Acriflavine resistance protein A precursor |
| ORF00569 | 1137 & 1138 | HTH-type transcriptional regulator acrR (Potential acrAB operonrepressor) (acrEF) |
| ORF00570 | 1139 & 1140 | Potassium efflux system kefA |
| ORF00571 | 1141 & 1142 | conserved hypothetical protein |
| ORF00572 | 1143 & 1144 | primosomal replication protein N |
| ORF00573 | 1145 & 1146 | Protein of unknown function (DUF454) family |
| ORF00574 | 1147 & 1148 | hypothetical protein |
| ORF00575 | 1149 & 1150 | adenine phosphoribosyltransferase (apt) [2.4.2.7] |
| ORF00576 | 1151 & 1152 | DNA polymerase III, subunits gamma and tau, programmed (dnaX) [2.7.7.7] |
| ORF00577 | 1153 & 1154 | conserved hypothetical protein TIGR00103 |
| ORF00578 | 1155 & 1156 | recombination protein RecR (recR) |
| ORF00579 | 1157 & 1158 | Chaperone protein htpG (Heat shock protein htpG) (High temperatureprotein G) (Heat shock protein C62.5) (htpG) |
| ORF00580 | 1159 & 1160 | Adenylate kinase |
| ORF00581 | 1161 & 1162 | ferrochelatase (hemH) [4.99.1.1] |
| ORF00582 | 1163 & 1164 | Acetyl esterase [3.1.1.—] |
| ORF00583 | 1165 & 1166 | Inosine-guanosine kinase [2.7.1.73] |
| ORF00584 | 1167 & 1168 | RosB |
| ORF00585 | 1169 & 1170 | fosmidomycin resistance protein (CAMPs) |
| ORF00586 | 1171 & 1172 | Protein ushA precursor [Includes: UDP-sugar hydrolase(UDP-sugar diphosphatase) (UDP-sugar pyrophosphatase); 5'-nucleotidase(EC 3.1.3.5) (5'-NT)] (5-NT) [3.6.1.45] |

TABLE 1-continued

Annotation of ORF00001 to ORF04995

| ORFnnnnn | SEQ ID NOs | Annotation |
| --- | --- | --- |
| ORF00587 | 1173 & 1174 | hypothetical protein |
| ORF00588 | 1175 & 1176 | hypothetical protein |
| ORF00589 | 1177 & 1178 | ybaK-ebsC protein (ybaK) |
| ORF00590 | 1179 & 1180 | GumN protein superfamily |
| ORF00591 | 1181 & 1182 | probable killer protein VCA0391 |
| ORF00592 | 1183 & 1184 | unnamed protein product; Some similarities with virulence associated protein A (vapA) |
| ORF00593 | 1185 & 1186 | Copper-transporting P-type ATPase [3.6.1.—] |
| ORF00594 | 1187 & 1188 | K-3-type glutaminase [3.5.1.2] |
| ORF00595 | 1189 & 1190 | amino acid permease family protein, putative |
| ORF00596 | 1191 & 1192 | Cu(I)-responsive transcriptional regulator (cueR) |
| ORF00597 | 1193 & 1194 | hypothetical protein |
| ORF00598 | 1195 & 1196 | lipoprotein, putative |
| ORF00599 | 1197 & 1198 | adhesin-invasin-like protein |
| ORF00600 | 1199 & 1200 | conserved hypothetical protein |
| ORF00601 | 1201 & 1202 | membrane protein |
| ORF00602 | 1203 & 1204 | band 7-Mec-2 family protein |
| ORF00603 | 1205 & 1206 | ABC transporter, ATP-binding protein |
| ORF00604 | 1207 & 1208 | membrane protein, putative |
| ORF00605 | 1209 & 1210 | ybbN protein |
| ORF00606 | 1211 & 1212 | oxidoreductase, short-chain dehydrogenase-reductase family (SDR) [1.—.—.—] |
| ORF00607 | 1213 & 1214 | acyl-coA thioesterase I precursor [3.1.2.—] |
| ORF00608 | 1215 & 1216 | ABC transporter, ATP-binding protein |
| ORF00609 | 1217 & 1218 | permease, putative domain protein |
| ORF00610 | 1219 & 1220 | YbbB |
| ORF00611 | 1221 & 1222 | allS |
| ORF00612 | 1223 & 1224 | Ureidoglycolate hydrolase (allA) [3.5.3.19] |
| ORF00613 | 1225 & 1226 | Negative regulator of allantoin and glyoxylate utilization operons(Transcriptional regulator allR) |
| ORF00614 | 1227 & 1228 | glyoxylate carboligase (gcl) [4.1.1.47] |
| ORF00615 | 1229 & 1230 | Hydroxypyruvate isomerase [5.3.1.22] |
| ORF00616 | 1231 & 1232 | 2-hydroxy-3-oxopropionate reductase [1.1.1.60] |
| ORF00617 | 1233 & 1234 | cytosine-purine-uracil-thiamine-allantoin permease family protein, putative |
| ORF00618 | 1235 & 1236 | Allantoinase [3.5.2.5] |
| ORF00619 | 1237 & 1238 | Putative purine permease ybbY |
| ORF00620 | 1239 & 1240 | Glycerate kinase 1 |
| ORF00621 | 1241 & 1242 | GlxB6 |
| ORF00622 | 1243 & 1244 | Allantoate amidohydrolase (partial) |
| ORF00623 | 1245 & 1246 | Ureidoglycolate dehydrogenase [1.1.1.154] |
| ORF00624 | 1247 & 1248 | Protein fdrA |
| ORF00625 | 1249 & 1250 | conserved hypothetical protein |
| ORF00626 | 1251 & 1252 | Protein of unknown function (DUF1116) superfamily |
| ORF00627 | 1253 & 1254 | conserved hypothetical protein |
| ORF00628 | 1255 & 1256 | carbamate kinase (arcC) [2.7.2.2] |
| ORF00629 | 1257 & 1258 | phosphoribosylaminoimidazole carboxylase, ATPase subunit (purK) [4.1.1.21] |
| ORF00630 | 1259 & 1260 | phosphoribosylaminoimidazole carboxylase, catalytic subunit (purE) [4.1.1.21] |
| ORF00631 | 1261 & 1262 | conserved hypothetical protein |
| ORF00632 | 1263 & 1264 | UDP-2,3-diacylglucosamine hydrolase (lpxH) [3.6.1.—] |
| ORF00633 | 1265 & 1266 | peptidyl-prolyl cis-trans isomerase B (ppiB) [5.2.1.8] |
| ORF00634 | 1267 & 1268 | cysteinyl-tRNA synthetase (cysS) [6.1.1.16] |
| ORF00635 | 1269 & 1270 | Predicted membrane-bound metal-dependent hydrolase (DUF457) family |
| ORF00636 | 1271 & 1272 | Uncharacterized ACR-related protein |
| ORF00637 | 1273 & 1274 | 5,10-methylene-tetrahydrofolate dehydrogenase (folD) [1.5.1.5] |
| ORF00638 | 1275 & 1276 | Prophage DLP12 integrase (Prophage QSR' integrase) |
| ORF00639 | 1277 & 1278 | conserved hypothetical protein |
| ORF00640 | 1279 & 1280 | Gp37 |
| ORF00641 | 1281 & 1282 | conserved hypothetical protein |
| ORF00642 | 1283 & 1284 | Sb36 |
| ORF00643 | 1285 & 1286 | conserved hypothetical protein |
| ORF00644 | 1287 & 1288 | unknown protein encoded by prophage CP-933N |
| ORF00645 | 1289 & 1290 | antitermination protein Q |
| ORF00646 | 1291 & 1292 | unknown protein encoded by prophage CP-933O |
| ORF00647 | 1293 & 1294 | DNA adenine-methylase |
| ORF00648 | 1295 & 1296 | lysis protein |
| ORF00649 | 1297 & 1298 | conserved hypothetical protein |
| ORF00650 | 1299 & 1300 | Protein of unknown function (DUF1327) superfamily |
| ORF00651 | 1301 & 1302 | Lysozyme (Lysis protein) (Muramidase) (Endolysin) [3.2.1.17] |
| ORF00652 | 1303 & 1304 | lipoprotein Rz1 precursor-related protein |
| ORF00653 | 1305 & 1306 | Bacteriophage lysis protein |
| ORF00654 | 1307 & 1308 | Bor protein homolog from lambdoid prophage DLP12 |
| ORF00655 | 1309 & 1310 | hypothetical protein |
| ORF00656 | 1311 & 1312 | Partial tonB-like membrane protein encoded within prophage |
| ORF00657 | 1313 & 1314 | conserved hypothetical protein |
| ORF00658 | 1315 & 1316 | Terminase small subunit (DNA packaging protein NU1) (fragment) |
| ORF00659 | 1317 & 1318 | Phage terminase large subunit (GpA) |
| ORF00660 | 1319 & 1320 | gpW |

TABLE 1-continued

Annotation of ORF00001 to ORF04995

| ORFnnnnn | SEQ ID NOs | Annotation |
|---|---|---|
| ORF00661 | 1321 & 1322 | phage portal protein, lambda family |
| ORF00662 | 1323 & 1324 | head-tail preconnector protein GP5 |
| ORF00663 | 1325 & 1326 | Bacteriophage lambda head decoration protein D |
| ORF00664 | 1327 & 1328 | Phage major capsid protein E |
| ORF00665 | 1329 & 1330 | DNA packaging protein FI |
| ORF00666 | 1331 & 1332 | Phage Head-Tail Attachment |
| ORF00667 | 1333 & 1334 | Prophage minor tail protein Z (GPZ) |
| ORF00668 | 1335 & 1336 | Phage minor tail protein U |
| ORF00669 | 1337 & 1338 | Major tail protein V |
| ORF00670 | 1339 & 1340 | phage minor tail protein G |
| ORF00671 | 1341 & 1342 | minor tail protein |
| ORF00672 | 1343 & 1344 | tail length tape measure protein precursor |
| ORF00673 | 1345 & 1346 | phage tail tape measure protein, lambda family |
| ORF00674 | 1347 & 1348 | phage minor tail protein L |
| ORF00675 | 1349 & 1350 | Putative tail fiber component K of prophage |
| ORF00676 | 1351 & 1352 | Bacteriophage lambda tail assembly protein I |
| ORF00677 | 1353 & 1354 | host specificity protein (partial) |
| ORF00678 | 1355 & 1356 | host specificity protein (partial) |
| ORF00679 | 1357 & 1358 | Lom |
| ORF00680 | 1359 & 1360 | conserved hypothetical protein |
| ORF00681 | 1361 & 1362 | conserved hypothetical protein |
| ORF00682 | 1363 & 1364 | conserved hypothetical protein |
| ORF00683 | 1365 & 1366 | conserved hypothetical protein |
| ORF00684 | 1367 & 1368 | Tail fiber assembly protein homolog from lambdoid prophage |
| ORF00685 | 1369 & 1370 | proteinase, putative |
| ORF00686 | 1371 & 1372 | Protease VII precursor (Omptin) (Outer membrane protein3B) (Protease A) (SopA) [3.4.21.87] |
| ORF00687 | 1373 & 1374 | Prophage DLP12 integrase (Prophage QSR' integrase) |
| ORF00688 | 1375 & 1376 | Tail fiber assembly protein homolog from lambdoid |
| ORF00689 | 1377 & 1378 | Protease VII precursor (Omptin) (Outer membrane protein3B) (Protease A) (SopA) [3.4.21.87] |
| ORF00690 | 1379 & 1380 | conserved hypothetical protein |
| ORF00690 | 1381 & 1382 | Bacteriophage N4 adsorption protein A precursor |
| ORF00692 | 1383 & 1384 | bacteriophage N4 adsorption protein NfrB |
| ORF00693 | 1385 & 1386 | hypothetical protein |
| ORF00694 | 1387 & 1388 | Sensor kinase cusS [2.7.3.—] |
| ORF00695 | 1389 & 1390 | Transcriptional regulatory protein cusR |
| ORF00696 | 1391 & 1392 | Cation efflux system protein cusC precursor |
| ORF00697 | 1393 & 1394 | Cation efflux system protein cusF precursor |
| ORF00698 | 1395 & 1396 | Cation efflux system protein cusB precursor |
| ORF00699 | 1397 & 1398 | Cation efflux system protein cusA (CzcA) |
| ORF00700 | 1399 & 1400 | Phenylalanine-specific permease |
| ORF00701 | 1401 & 1402 | putative transport |
| ORF00702 | 1403 & 1404 | Oxygen-insensitive NAD(P)H nitroreductase [1.—.—.—] |
| ORF00703 | 1405 & 1406 | Uncharacterized protein conserved in bacteria |
| ORF00704 | 1407 & 1408 | Protein of unknown function (DUF1158) superfamily |
| ORF00705 | 1409 & 1410 | Glutamate-cysteine ligase family 2, putative |
| ORF00706 | 1411 & 1412 | 4-phosphopantetheinyl transferase entD |
| ORF00707 | 1413 & 1414 | ferrienterobactin receptor precursor |
| ORF00708 | 1415 & 1416 | conserved hypothetical protein |
| ORF00709 | 1417 & 1418 | Enterochelin esterase |
| ORF00710 | 1419 & 1420 | mbtH protein-related protein |
| ORF00711 | 1421 & 1422 | enterobactin synthetase component F [2.7.7.—] |
| ORF00712 | 1423 & 1424 | Ferric enterobactin transport protein fepE (enterochelin) |
| ORF00713 | 1425 & 1426 | ferric exochelin uptake (fxuB) |
| ORF00714 | 1427 & 1428 | ferric exochelin uptake (fxuA) |
| ORF00715 | 1429 & 1430 | ferric exochelin uptake (fxuC) |
| ORF00716 | 1431 & 1432 | membrane protein, putative |
| ORF00717 | 1433 & 1434 | ferric enterobactin (enterochelin) binding protein; periplasmic component |
| ORF00718 | 1435 & 1436 | isochorismate synthase [5.4.99.6] |
| ORF00719 | 1437 & 1438 | 2,3-dihydroxybenzoate-AMP ligase [2.7.7.58] |
| ORF00720 | 1439 & 1440 | Isochorismatase (Isochorismate lyase) (2,3 dihydro-2,3dihydroxybenzoate synthase) (Enterobactin synthetase component B)(Enterochelin synthase B) (EntB) [3.3.2.1] |
| ORF00721 | 1441 & 1442 | oxidoreductase, short-chain dehydrogenase-reductase family [1.3.1.28] |
| ORF00722 | 1443 & 1444 | Hypothetical UPF0152 protein ybdB (p15) |
| ORF00723 | 1445 & 1446 | Carbon starvation protein A |
| ORF00724 | 1447 & 1448 | Uncharacterized small protein |
| ORF00725 | 1449 & 1450 | glycerol dehydrogenase [1.1.—.—] |
| ORF00726 | 1451 & 1452 | aminotransferase, class I [2.6.1.—] |
| ORF00727 | 1453 & 1454 | unnamed protein product; ORF_ID: o166#4 |
| ORF00728 | 1455 & 1456 | conserved hypothetical protein |
| ORF00729 | 1457 & 1458 | Hypothetical transcriptional regulator ybdO (orf2) |
| ORF00730 | 1459 & 1460 | Thiol:disulfide interchange protein dsbG precursor |
| ORF00731 | 1461 & 1462 | alkyl hydroperoxide reductase c22 protein [1.6.4.—] |
| ORF00732 | 1463 & 1464 | alkyl hydroperoxide reductase F52A protein [1.6.4.—] |

TABLE 1-continued

Annotation of ORF00001 to ORF04995

| ORFnnnnn | SEQ ID NOs | Annotation |
|---|---|---|
| ORF00733 | 1465 & 1466 | Universal stress protein G |
| ORF00734 | 1467 & 1468 | Regulator of nucleoside diphosphate kinase |
| ORF00735 | 1469 & 1470 | Ribonuclease I precursor [3.1.27.6] |
| ORF00736 | 1471 & 1472 | Citrate carrier-transporter (antiport) |
| ORF00737 | 1473 & 1474 | triphosphoribosyl-dephospho-CoA synthase (citG) [2.7.8.25] |
| ORF00738 | 1475 & 1476 | Apo-citrate lyase phosphoribosyl-dephospho-CoA transferase (citX) [2.7.7.—] |
| ORF00739 | 1477 & 1478 | citrate lyase, alpha subunit (citF) [2.8.3.10] |
| ORF00740 | 1479 & 1480 | citrate lyase, beta subunit (citE) [4.1.3.6] |
| ORF00741 | 1481 & 1482 | citrate lyase acyl carrier protein (citD) |
| ORF00742 | 1483 & 1484 | citrate lyase ligase (citC) [6.2.1.22] |
| ORF00743 | 1485 & 1486 | Sensor kinase dpiB |
| ORF00744 | 1487 & 1488 | Transcriptional regulatory protein dpiA (Destabilizer of plasmidinheritance) |
| ORF00745 | 1489 & 1490 | transport of dicarboxylates |
| ORF00746 | 1491 & 1492 | CrcA protein |
| ORF00747 | 1493 & 1494 | Cold shock-like protein cspE |
| ORF00748 | 1495 & 1496 | crcB protein (crcB) |
| ORF00749 | 1497 & 1498 | nitrilase |
| ORF00750 | 1499 & 1500 | Sec-independent protein translocase protein tatA (YIGT) |
| ORF00751 | 1501 & 1502 | lipoic acid synthetase (lipA) |
| ORF00752 | 1503 & 1504 | lipoate-protein ligase B (lipB) |
| ORF00753 | 1505 & 1506 | UPF0250 protein |
| ORF00754 | 1507 & 1508 | penicillin-binding protein 5 (PBP) [3.4.16.4] |
| ORF00755 | 1509 & 1510 | Rare lipoprotein A precursor (rlpA) |
| ORF00756 | 1511 & 1512 | conserved hypothetical protein |
| ORF00757 | 1513 & 1514 | rod shape-determining protein RodA (rodA) |
| ORF00758 | 1515 & 1516 | Penicillin-binding protein 2 (PBP-2)(PBP) |
| ORF00759 | 1517 & 1518 | Penicillin-binding protein 2 (PBP-2) (PBP) |
| ORF00760 | 1519 & 1520 | conserved hypothetical protein TIGR00246 |
| ORF00761 | 1521 & 1522 | unnamed protein product |
| ORF00762 | 1523 & 1524 | phosphoglycerate mutase family protein, putative [3.1.3.73] |
| ORF00763 | 1525 & 1526 | nicotinate (nicotinamide) nucleotide adenylyltransferase (nadD) [2.7.7.18] |
| ORF00764 | 1527 & 1528 | DNA polymerase III, delta subunit (holA) [2.7.7.7] |
| ORF00765 | 1529 & 1530 | a minor lipoprotein |
| ORF00766 | 1531 & 1532 | leucyl-tRNA synthetase (leuS) [6.1.1.4] |
| ORF00767 | 1533 & 1534 | Methyl-accepting chemotaxis protein |
| ORF00768 | 1535 & 1536 | Inosine-uridine nucleoside N-ribohydrolase (AL355920) |
| ORF00769 | 1537 & 1538 | Glutamate-aspartate transport ATP-binding protein gltL |
| ORF00770 | 1539 & 1540 | Glutamate-aspartate transport system permease protein gltK (membrane) |
| ORF00771 | 1541 & 1542 | Glutamate-aspartate transport system permease protein gltJ |
| ORF00772 | 1543 & 1544 | glutamate-aspartate ABC transporter, periplasmic glutamate-aspartate-binding protein, truncation |
| ORF00773 | 1545 & 1546 | Rhomboid family family |
| ORF00774 | 1547 & 1548 | Apolipoprotein N-acyltransferase (ALP N-acyltransferase)(Copper homeostasis protein cutE) [2.3.1.—] |
| ORF00775 | 1549 & 1550 | Magnesium and cobalt efflux protein corC (tlyC) |
| ORF00776 | 1551 & 1552 | predicted metal-dependent hydrolase |
| ORF00777 | 1553 & 1554 | PhoH-like protein |
| ORF00778 | 1555 & 1556 | tRNA-i(6)A37 thiotransferase enzyme MiaB (miaB) |
| ORF00779 | 1557 & 1558 | 2-octaprenyl-3-methyl-6-methoxy-1,4-benzoquinol hydroxylase |
| ORF00780 | 1559 & 1560 | Asparagine synthetase B [glutamine-hydrolyzing] |
| ORF00781 | 1561 & 1562 | nagD protein, degenerate |
| ORF00782 | 1563 & 1564 | N-acetylglucosamine repressor |
| ORF00783 | 1565 & 1566 | N-acetylglucosamine-6-phosphate deacetylase (nagA) [3.5.1.25] |
| ORF00784 | 1567 & 1568 | glucosamine-6-phosphate isomerase (nagB) [3.5.99.6] |
| ORF00785 | 1569 & 1570 | PTS system, N-acetylglucosamine-specific IIABC component (EII-Nag) [2.7.1.69] |
| ORF00786 | 1571 & 1572 | membrane protein, putative |
| ORF00787 | 1573 & 1574 | hypothetical protein |
| ORF00788 | 1575 & 1576 | Hypthetical protein |
| ORF00789 | 1577 & 1578 | Hypthetical protein |
| ORF00790 | 1579 & 1580 | TerC protein |
| ORF00791 | 1581 & 1582 | TerC protein |
| ORF00792 | 1583 & 1584 | dihydrodipicolinate synthase (AE004999) [4.2.1.52] |
| ORF00793 | 1585 & 1586 | Putative alcohol dehydrogenase (U59485) |
| ORF00794 | 1587 & 1588 | Putative inner membrane protein |
| ORF00795 | 1589 & 1590 | 4-hydroxythreonine-4-phosphate dehydrogenase (pdxA) [1.1.1.262] |
| ORF00796 | 1591 & 1592 | Transcriptional regulator of sugar metabolism, putative |
| ORF00797 | 1593 & 1594 | glutaminyl-tRNA synthetase (glnS) [6.1.1.18] |
| ORF00798 | 1595 & 1596 | hypothetical protein |
| ORF00799 | 1597 & 1598 | unnamed protein product; ORF_ID: o172#6 |
| ORF00800 | 1599 & 1600 | Hypothetical lipoprotein ybfN precursor |
| ORF00801 | 1601 & 1602 | Ferric uptake regulation protein (Ferric uptake regulator) |
| ORF00802 | 1603 & 1604 | Flavodoxin 1 |
| ORF00803 | 1605 & 1606 | urea amidolyase-related protein |
| ORF00804 | 1607 & 1608 | urea amidolyase-related protein |
| ORF00805 | 1609 & 1610 | SeqA protein |
| ORF00806 | 1611 & 1612 | phosphoglucomutase, alpha-D-glucose phosphate-specific (pgm) [5.4.2.2] |

TABLE 1-continued

Annotation of ORF00001 to ORF04995

| ORFnnnnn | SEQ ID NOs | Annotation |
| --- | --- | --- |
| ORF00807 | 1613 & 1614 | Putrescine-ornithine antiporter (Putrescine transport protein) (potE) |
| ORF00808 | 1615 & 1616 | Ornithine decarboxylase, inducible (speF) [4.1.1.17] |
| ORF00809 | 1617 & 1618 | conserved hypothetical protein |
| ORF00810 | 1619 & 1620 | hypothetical protein |
| ORF00811 | 1621 & 1622 | kdpE |
| ORF00812 | 1623 & 1624 | sensor histidine kinase KdpD, putative |
| ORF00813 | 1625 & 1626 | K+-transporting ATPase, C subunit (kdpC) [3.6.3.12] |
| ORF00814 | 1627 & 1628 | K+-transporting ATPase, B subunit (kdpB) [3.6.3.12] |
| ORF00815 | 1629 & 1630 | K+-transporting ATPase, A subunit (kdpA) [3.6.3.12] |
| ORF00816 | 1631 & 1632 | K+-transporting ATPase, F subunit (kdpF) [3.6.3.12] |
| ORF00817 | 1633 & 1634 | conserved hypothetical protein |
| ORF00818 | 1635 & 1636 | uncharacterized conserved protein (orf169) |
| ORF00819 | 1637 & 1638 | Deoxyribodipyrimidine photolyase [4.1.99.3] |
| ORF00820 | 1639 & 1640 | PTR2-family transport protein STY0750 |
| ORF00821 | 1641 & 1642 | conserved hypothetical protein TIGR00486 |
| ORF00822 | 1643 & 1644 | conserved hypothetical protein TIGR00370 |
| ORF00823 | 1645 & 1646 | urea amidolyase-related protein |
| ORF00824 | 1647 & 1648 | LamB-YcsF family protein (lamB) |
| ORF00825 | 1649 & 1650 | formamidopyrimidine-DNA glycosylase, putative [3.2.—.—] |
| ORF00826 | 1651 & 1652 | membrane protein, putative |
| ORF00827 | 1653 & 1654 | ybgO protein |
| ORF00828 | 1655 & 1656 | citrate synthase I (gltA) [2.3.3.1] |
| ORF00829 | 1657 & 1658 | succinate dehydrogenase cytochrome b-556 subunit (AF007569) |
| ORF00830 | 1659 & 1660 | Succinate dehydrogenase hydrophobic membrane anchor protein (sdhD) [1.3.99.1] |
| ORF00831 | 1661 & 1662 | succinate dehydrogenase, flavoprotein subunit (sdhA) |
| ORF00832 | 1663 & 1664 | succinate dehydrogenase, iron sulfur protein [1.3.99.1] |
| ORF00833 | 1665 & 1666 | 2-oxoglutarate dehydrogenase, E1 component (sucA) [1.2.4.2] |
| ORF00834 | 1667 & 1668 | 2-oxoglutarate dehydrogenase, E2 component, dihydrolipoamide succinyltransferase (sucB) [2.3.1.61] |
| ORF00835 | 1669 & 1670 | Dihydrolipoamide succinyltransferase component of 2-oxoglutarate dehydrogenase complex [2.3.1.61] |
| ORF00836 | 1671 & 1672 | Succinyl-CoA synthetase beta chain (SCS-beta) (sucC) [6.2.1.5] |
| ORF00837 | 1673 & 1674 | succinyl-CoA synthetase, alpha subunit (sucD) [6.2.1.5] |
| ORF00838 | 1675 & 1676 | uncharacterized protein, probably surface-located |
| ORF00839 | 1677 & 1678 | hypothetical protein |
| ORF00840 | 1679 & 1680 | cytochrome d ubiquinol oxidase chain I [similarity] [1.10.3.—] |
| ORF00841 | 1681 & 1682 | cytochrome d ubiquinol oxidase, subunit II (cydB) [1.10.3.—] |
| ORF00842 | 1683 & 1684 | cyd operon protein YbgT-related protein |
| ORF00843 | 1685 & 1686 | cyd operon protein YbgE |
| ORF00844 | 1687 & 1688 | Predicted thioesterase |
| ORF00845 | 1689 & 1690 | TolQ protein |
| ORF00846 | 1691 & 1692 | TolR protein (tolR) |
| ORF00847 | 1693 & 1694 | TolA protein |
| ORF00848 | 1695 & 1696 | TolA protein |
| ORF00849 | 1697 & 1698 | tolB (tolB) |
| ORF00850 | 1699 & 1700 | Peptidoglycan-associated lipoprotein precursor |
| ORF00851 | 1701 & 1702 | YbgF protein |
| ORF00852 | 1703 & 1704 | quinolinate synthetase complex, A subunit (nadA) |
| ORF00853 | 1705 & 1706 | Protein pnuC |
| ORF00854 | 1707 & 1708 | cation efflux family protein (efflux) |
| ORF00855 | 1709 & 1710 | conserved hypothetical protein |
| ORF00856 | 1711 & 1712 | phospho-2-dehydro-3-deoxyheptonate aldolase [2.5.1.54] |
| ORF00857 | 1713 & 1714 | hypothetical protein |
| ORF00858 | 1715 & 1716 | Phosphoglycerate mutase 1 |
| ORF00859 | 1717 & 1718 | Aldose 1-epimerase |
| ORF00860 | 1719 & 1720 | galactokinase (galK) [2.7.1.6] |
| ORF00861 | 1721 & 1722 | galactose-1-phosphate uridylyltransferase (galT) [2.7.7.10] |
| ORF00862 | 1723 & 1724 | UDP-glucose 4-epimerase (galE) [5.1.3.2] |
| ORF00863 | 1725 & 1726 | ATP-binding component of molybdate transport system (atp_bind) |
| ORF00864 | 1727 & 1728 | hypothetical protein |
| ORF00865 | 1729 & 1730 | Transcriptional regulator modE (modE) |
| ORF00866 | 1731 & 1732 | conserved hypothetical protein |
| ORF00867 | 1733 & 1734 | molybdate ABC transporter, periplasmic molybdate-binding protein (modA) |
| ORF00868 | 1735 & 1736 | molybdate ABC transporter, permease protein (modB) |
| ORF00869 | 1737 & 1738 | molybdate ABC transporter, ATP-binding protein (modC) [3.6.3.29] |
| ORF00870 | 1739 & 1740 | putative phosphatase |
| ORF00871 | 1741 & 1742 | conserved hypothetical protein |
| ORF00872 | 1743 & 1744 | ybhD protein |
| ORF00873 | 1745 & 1746 | FldA protein |
| ORF00874 | 1747 & 1748 | 2-oxoglutarate-malate translocator homolog yflS (SODiT1) |
| ORF00875 | 1749 & 1750 | aconitate hydratase, putative |
| ORF00876 | 1751 & 1752 | possible pectinesterase precursor |
| ORF00877 | 1753 & 1754 | conserved hypothetical protein TIGR00481 |
| ORF00878 | 1755 & 1756 | adenosylmethionine-8-amino-7-oxononanoate aminotransferase (bioA) [2.6.1.62] |
| ORF00879 | 1757 & 1758 | biotin synthase (bioB) [2.8.1.6] |
| ORF00880 | 1759 & 1760 | 8-amino-7-oxononanoate synthase (bioF) [2.3.1.47] |

TABLE 1-continued

Annotation of ORF00001 to ORF04995

| ORFnnnnn | SEQ ID NOs | Annotation |
|---|---|---|
| ORF00881 | 1761 & 1762 | biotin biosynthesis protein BioC (bioC) |
| ORF00882 | 1763 & 1764 | Dethiobiotin synthetase (DTBS) |
| ORF00883 | 1765 & 1766 | Phage minor tail protein |
| ORF00884 | 1767 & 1768 | phage minor tail protein L |
| ORF00885 | 1769 & 1770 | Putative tail fiber component K of prophage |
| ORF00886 | 1771 & 1772 | Minor tail protein precursor H |
| ORF00887 | 1773 & 1774 | Phage minor tail protein |
| ORF00888 | 1775 & 1776 | phage minor tail protein L |
| ORF00889 | 1777 & 1778 | Putative tail component of prophage |
| ORF00890 | 1779 & 1780 | Phage minor tail protein L |
| ORF00891 | 1781 & 1782 | Putative tail component of prophage |
| ORF00892 | 1783 & 1784 | Phage minor tail protein L |
| ORF00893 | 1785 & 1786 | Putative tail fiber component K of prophage |
| ORF00894 | 1787 & 1788 | Putative tail fiber component K of prophage |
| ORF00895 | 1789 & 1790 | Bacteriophage lambda tail assembly protein I |
| ORF00896 | 1791 & 1792 | host specificity protein (partial) |
| ORF00897 | 1793 & 1794 | tail assembly protein |
| ORF00898 | 1795 & 1796 | Bacteriophage lambda tail assembly protein I |
| ORF00899 | 1797 & 1798 | host specificity protein (partial) |
| ORF00900 | 1799 & 1800 | Putative tail component of prophage (partial) |
| ORF00901 | 1801 & 1802 | hypothetical protein |
| ORF00902 | 1803 & 1804 | conserved hypothetical protein |
| ORF00903 | 1805 & 1806 | conserved hypothetical protein |
| ORF00904 | 1807 & 1808 | conserved hypothetical protein |
| ORF00905 | 1809 & 1810 | SitD protein (AF128999) |
| ORF00906 | 1811 & 1812 | SitC protein (AF128999) |
| ORF00907 | 1813 & 1814 | SitB protein (AF128999) |
| ORF00908 | 1815 & 1816 | periplasmic binding protein (chelated) |
| ORF00909 | 1817 & 1818 | putative transposase |
| ORF00910 | 1819 & 1820 | conserved hypothetical protein |
| ORF00911 | 1821 & 1822 | isocitrate dehydrogenase [1.1.1.42] |
| ORF00912 | 1823 & 1824 | ydfO protein |
| ORF00913 | 1825 & 1826 | Hypothetical transcriptional regulator ycgE |
| ORF00914 | 1827 & 1828 | conserved hypothetical protein |
| ORF00915 | 1829 & 1830 | Sensors of blue-light using FAD family |
| ORF00916 | 1831 & 1832 | probable membrane protein b1168 (o528) |
| ORF00917 | 1833 & 1834 | conserved hypothetical protein |
| ORF00918 | 1835 & 1836 | conserved hypothetical protein |
| ORF00919 | 1837 & 1838 | conserved hypothetical protein |
| ORF00920 | 1839 & 1840 | conserved hypothetical protein |
| ORF00921 | 1841 & 1842 | putative ATP-binding component of a transport system |
| ORF00922 | 1843 & 1844 | cell division topological specificity factor MinE (minE) |
| ORF00923 | 1845 & 1846 | cell division inhibitor MinD |
| ORF00924 | 1847 & 1848 | tail assembly protein |
| ORF00925 | 1849 & 1850 | Host specificity protein J (partial) |
| ORF00926 | 1851 & 1852 | host specificity protein (partial) |
| ORF00927 | 1853 & 1854 | excinuclease ABC, B subunit (uvrB) |
| ORF00928 | 1855 & 1856 | Uncharacterized conserved membrane-associated protein |
| ORF00929 | 1857 & 1858 | Molybdenum cofactor biosynthesis protein A |
| ORF00930 | 1859 & 1860 | molybdenum cofactor biosynthesis protein B |
| ORF00931 | 1861 & 1862 | molybdenum cofactor biosynthesis protein C (moaC) |
| ORF00932 | 1863 & 1864 | Molybdopterin converting factor subunit 1 (MPT) |
| ORF00933 | 1865 & 1866 | Molybdopterin converting factor subunit 2 |
| ORF00934 | 1867 & 1868 | conserved hypothetical protein |
| ORF00935 | 1869 & 1870 | membrane protein (SAD) |
| ORF00936 | 1871 & 1872 | hypothetical protein |
| ORF00937 | 1873 & 1874 | Uncharacterized protein family UPF0005, putative |
| ORF00938 | 1875 & 1876 | membrane protein, putative |
| ORF00939 | 1877 & 1878 | phospholipase family protein [2.7.8.—] |
| ORF00940 | 1879 & 1880 | endonuclease-exonuclease-phosphatase family protein |
| ORF00941 | 1881 & 1882 | ABC transporter, permease protein, putative |
| ORF00942 | 1883 & 1884 | conserved hypothetical protein |
| ORF00943 | 1885 & 1886 | ElsD (membrane) |
| ORF00944 | 1887 & 1888 | ABC transporter, ATP binding-permease protein |
| ORF00945 | 1889 & 1890 | Hypothetical membrane protein ybhG |
| ORF00946 | 1891 & 1892 | probable transcription regulator ybiH |
| ORF00947 | 1893 & 1894 | Superfamily II DNA and RNA helicases |
| ORF00948 | 1895 & 1896 | GTP cyclohydrolase II (F160) |
| ORF00949 | 1897 & 1898 | probably ATP-dependent helicase |
| ORF00950 | 1899 & 1900 | glycosyl transferase family protein (o320) [2.4.2.18] |
| ORF00951 | 1901 & 1902 | YbiC (o361) [1.1.1.—] |
| ORF00952 | 1903 & 1904 | Protein of unknown function (DUF1471) superfamily |
| ORF00953 | 1905 & 1906 | TraR |
| ORF00954 | 1907 & 1908 | iron-regulated outer membrane protein |
| ORF00955 | 1909 & 1910 | TonB-dependent receptor for iron transport XF0599 (III) |
| ORF00956 | 1911 & 1912 | hypothetical protein |

TABLE 1-continued

Annotation of ORF00001 to ORF04995

| ORFnnnnn | SEQ ID NOs | Annotation |
|---|---|---|
| ORF00957 | 1913 & 1914 | Protein of unknown function (DUF1471) family |
| ORF00958 | 1915 & 1916 | Protein of unknown function (DUF890) superfamily |
| ORF00959 | 1917 & 1918 | putative transport protein |
| ORF00960 | 1919 & 1920 | ATP-binding component of glutamine high-affinity transport system (atp_bind) |
| ORF00961 | 1921 & 1922 | amino acid ABC transporter, amino acid-binding-permease protein |
| ORF00962 | 1923 & 1924 | amino acid ABC transporter, amino acid-binding-permease protein (GlnH) |
| ORF00963 | 1925 & 1926 | global regulator, starvation conditions |
| ORF00964 | 1927 & 1928 | transporter, EamA family |
| ORF00965 | 1929 & 1930 | outer membrane protein X |
| ORF00966 | 1931 & 1932 | Dca |
| ORF00967 | 1933 & 1934 | Transcriptional regulator mntR (Manganese transport regulator) |
| ORF00968 | 1935 & 1936 | transporter, NadC-P-Pho87 family, putative |
| ORF00969 | 1937 & 1938 | Protein ybiS precursor |
| ORF00970 | 1939 & 1940 | ABC transporter ATP-binding protein |
| ORF00971 | 1941 & 1942 | hydrolase, haloacid dehalogenase-like family |
| ORF00972 | 1943 & 1944 | pyruvate formate-lyase [2.3.1.54] |
| ORF00973 | 1945 & 1946 | Iron-dependent pyruvate formate-lyase-activating enzyme (pflC) [1.97.1.4] |
| ORF00974 | 1947 & 1948 | transaldolase, putative |
| ORF00975 | 1949 & 1950 | molybdopterin synthase sulfurylase MoeB (moeB) |
| ORF00976 | 1951 & 1952 | Molybdopterin biosynthesis protein moeA (moeA) |
| ORF00977 | 1953 & 1954 | asparaginase [3.5.1.1] |
| ORF00978 | 1955 & 1956 | Hypothetical ABC transporter ATP-binding protein in bcr 5'region. (D90720) |
| ORF00979 | 1957 & 1958 | Heme-binding protein a precursor (hemin-binding lipoprotein). |
| ORF00980 | 1959 & 1960 | ABC transporter permease protein (permease) |
| ORF00981 | 1961 & 1962 | peptide ABC transporter, permease protein |
| ORF00982 | 1963 & 1964 | EAL domain protein |
| ORF00983 | 1965 & 1966 | Hypothetical membrane protein yliF |
| ORF00984 | 1967 & 1968 | MiaB-like tRNA modifying enzyme YliG, TIGR01125 |
| ORF00985 | 1969 & 1970 | conserved hypothetical protein |
| ORF00986 | 1971 & 1972 | IppZ |
| ORF00987 | 1973 & 1974 | glutathione S-transferase |
| ORF00988 | 1975 & 1976 | Penicillin-binding protein 6 precursor (PBP) [3.4.16.4] |
| ORF00989 | 1977 & 1978 | Deoxyribose operon repressor (AE006172) |
| ORF00990 | 1979 & 1980 | unnamed protein product |
| ORF00991 | 1981 & 1982 | hypothetical protein |
| ORF00992 | 1983 & 1984 | Multidrug translocase mdfA |
| ORF00993 | 1985 & 1986 | conserved hypothetical protein |
| ORF00994 | 1987 & 1988 | hydrolase, haloacid dehalogenase-like family |
| ORF00995 | 1989 & 1990 | Major Facilitator Superfamily subfamily |
| ORF00996 | 1991 & 1992 | transcription regulator, TetR family, putative |
| ORF00997 | 1993 & 1994 | TrkA, Potassium channel-family protein |
| ORF00998 | 1995 & 1996 | conserved hypothetical protein |
| ORF00999 | 1997 & 1998 | Glutaredoxin, GrxA family (grxA) |
| ORF01000 | 1999 & 2000 | Protein of unknown function (DUF1418) superfamily |
| ORF01001 | 2001 & 2002 | Oxygen-insensitive NADPH nitroreductase [1.—.—.—] |
| ORF01002 | 2003 & 2004 | ribosomal protein S6 modification protein |
| ORF01003 | 2005 & 2006 | putative sensory transduction regulator |
| ORF01004 | 2007 & 2008 | Putrescine-binding periplasmic protein precursor |
| ORF01005 | 2009 & 2010 | Putrescine transport ATP-binding protein potG (atp_bind) |
| ORF01006 | 2011 & 2012 | putrescine ABC transporter, permease protein (membrane) |
| ORF01007 | 2013 & 2014 | Putrescine transport system permease protein potI |
| ORF01008 | 2015 & 2016 | conserved hypothetical protein |
| ORF01009 | 2017 & 2018 | 23S rRNA (uracil-5-)-methyltransferase RumB (rumB) [2.1.1.—] |
| ORF01010 | 2019 & 2020 | Arginine-binding periplasmic protein 2 precursor |
| ORF01011 | 2021 & 2022 | Arginine transport system permease protein artM (membrane) |
| ORF01012 | 2023 & 2024 | Arginine transport system permease protein artQ (artQ) |
| ORF01013 | 2025 & 2026 | Arginine-binding periplasmic protein 1 precursor |
| ORF01014 | 2027 & 2028 | Arginine transport ATP-binding protein artP |
| ORF01015 | 2029 & 2030 | Putative lipoprotein ybjP precursor |
| ORF01016 | 2031 & 2032 | conserved protein |
| ORF01017 | 2033 & 2034 | N-acetylmuramoyl-L-alanine amidase domain protein [3.5.1.28] |
| ORF01018 | 2035 & 2036 | conserved hypothetical protein |
| ORF01019 | 2037 & 2038 | COG0702: Predicted nucleoside-diphosphate-sugar epimerases, putative |
| ORF01020 | 2039 & 2040 | Low-specificity L-threonine aldolase [4.1.2.5] |
| ORF01021 | 2041 & 2042 | pyruvate dehydrogenase [1.2.2.2] |
| ORF01022 | 2043 & 2044 | iron-sulfur cluster-binding protein |
| ORF01023 | 2045 & 2046 | hybrid cluster protein |
| ORF01024 | 2047 & 2048 | putative surface protein |
| ORF01025 | 2049 & 2050 | aquaporin Z |
| ORF01026 | 2051 & 2052 | homology with RecF protein |
| ORF01027 | 2053 & 2054 | SomA (VirG) |
| ORF01028 | 2055 & 2056 | Macrolide-specific efflux protein macA precursor |
| ORF01029 | 2057 & 2058 | Macrolide-specific ABC-type efflux carrier (efflux) |
| ORF01030 | 2059 & 2060 | Cold shock-like protein cspD |
| ORF01031 | 2061 & 2062 | site-specific recombinase, phage integrase family, truncation |
| ORF01032 | 2063 & 2064 | probable DNA binding protein-related protein |

TABLE 1-continued

Annotation of ORF00001 to ORF04995

| ORFnnnnn | SEQ ID NOs | Annotation |
|---|---|---|
| ORF01033 | 2065 & 2066 | hypothetical protein |
| ORF01034 | 2067 & 2068 | conserved hypothetical protein |
| ORF01035 | 2069 & 2070 | conserved hypothetical protein |
| ORF01036 | 2071 & 2072 | hypothetical bacteriophage protein |
| ORF01037 | 2073 & 2074 | Bacteriophage P4 DNA primase |
| ORF01038 | 2075 & 2076 | Unknown protein encoded by prophage |
| ORF01039 | 2077 & 2078 | Single-strand binding protein (SSB) (Helix-destabilizing protein) (ssb) |
| ORF01040 | 2079 & 2080 | hypothetical protein |
| ORF01041 | 2081 & 2082 | conserved hypothetical protein |
| ORF01042 | 2083 & 2084 | Gifsy-1 prophage protein |
| ORF01043 | 2085 & 2086 | Head decoration protein (Head protein GPSHP) |
| ORF01044 | 2087 & 2088 | hypothetical protein |
| ORF01045 | 2089 & 2090 | head-tail preconnector protein GP5 |
| ORF01046 | 2091 & 2092 | gp1 |
| ORF01047 | 2093 & 2094 | Unknown protein encoded by prophage |
| ORF01048 | 2095 & 2096 | Unknown protein encoded by prophage |
| ORF01049 | 2097 & 2098 | ATP-dependent Clp protease adaptor protein clpS |
| ORF01050 | 2099 & 2100 | ATP-binding component of serine protease |
| ORF01051 | 2101 & 2102 | ATP-dependent clp protease ATP-binding subunit clpA |
| ORF01052 | 2103 & 2104 | CRISPR-associated protein Cas1 (cas1) |
| ORF01053 | 2105 & 2106 | unnamed protein product; Similar to unknown protein |
| ORF01054 | 2107 & 2108 | conserved hypothetical protein |
| ORF01055 | 2109 & 2110 | conserved hypothetical protein |
| ORF01056 | 2111 & 2112 | conserved hypothetical protein |
| ORF01057 | 2113 & 2114 | conserved hypothetical protein |
| ORF01058 | 2115 & 2116 | conserved hypothetical protein |
| ORF01059 | 2117 & 2118 | translation initiation factor IF-1 (infA) |
| ORF01060 | 2119 & 2120 | leucyl-phenylalanyl-tRNA--protein transferase (aat) [2.3.2.—] |
| ORF01061 | 2121 & 2122 | Transport ATP-binding protein cydC |
| ORF01062 | 2123 & 2124 | Transport ATP-binding protein cydD |
| ORF01063 | 2125 & 2126 | Antirestriction protein family |
| ORF01064 | 2127 & 2128 | YeeS protein (o160) |
| ORF01065 | 2129 & 2130 | Transport ATP-binding protein cydD |
| ORF01066 | 2131 & 2132 | thioredoxin-disulfide reductase (trxB) [1.8.1.9] |
| ORF01067 | 2133 & 2134 | Leucine-responsive Regulatory protein |
| ORF01068 | 2135 & 2136 | Cell division protein ftsK |
| ORF01069 | 2137 & 2138 | outer membrane lipoprotein carrier protein LolA (lolA) |
| ORF01070 | 2139 & 2140 | unnamed protein product |
| ORF01071 | 2141 & 2142 | seryl-tRNA synthetase (serS) [6.1.1.11] |
| ORF01072 | 2143 & 2144 | Anaerobic dimethyl sulfoxide reductase chain A precursor (dmsA) [1.8.99.—] |
| ORF01073 | 2145 & 2146 | anaerobic dimethylsulfoxide reductase chain B (dmsB) [1.—.—.—] |
| ORF01074 | 2147 & 2148 | DMSO reductase anchor subunit (DmsC) (dmsC) [1.8.99.—] |
| ORF01075 | 2149 & 2150 | Protein ycaC |
| ORF01076 | 2151 & 2152 | Hypothetical MFS-type transporter protein ycaD |
| ORF01077 | 2153 & 2154 | pyruvate formate lyase activating enzyme 1 [1.97.1.4] |
| ORF01078 | 2155 & 2156 | phage integrase |
| ORF01079 | 2157 & 2158 | phage regulatory protein |
| ORF01080 | 2159 & 2160 | gpB |
| ORF01081 | 2161 & 2162 | gp80-related protein |
| ORF01082 | 2163 & 2164 | InsAB' protein |
| ORF01083 | 2165 & 2166 | InsA protein |
| ORF01084 | 2167 & 2168 | gp81 |
| ORF01085 | 2169 & 2170 | TraR protein |
| ORF01086 | 2171 & 2172 | gp83 |
| ORF01087 | 2173 & 2174 | Replication gene A protein (GPA) |
| ORF01088 | 2175 & 2176 | gp91 |
| ORF01089 | 2177 & 2178 | conserved hypothetical protein |
| ORF01090 | 2179 & 2180 | hypothetical protein |
| ORF01091 | 2181 & 2182 | hypothetical protein |
| ORF01092 | 2183 & 2184 | phage portal protein, PBSX family |
| ORF01093 | 2185 & 2186 | Putative ATPase subunit of terminase (gpP-like) |
| ORF01094 | 2187 & 2188 | Phage capsid scaffolding protein (GPO) |
| ORF01095 | 2189 & 2190 | capsid scaffolding protein |
| ORF01096 | 2191 & 2192 | phage major capsid protein, P2 family |
| ORF01097 | 2193 & 2194 | Phage small terminase subunit |
| ORF01098 | 2195 & 2196 | Phage head completion protein (GPL) |
| ORF01099 | 2197 & 2198 | Tail protein X (GPX)-related protein |
| ORF01100 | 2199 & 2200 | Phage holin family 2 |
| ORF01101 | 2201 & 2202 | Lysozyme (Lysis protein) (Muramidase) (Endolysin)(Protein gpK) [3.2.1.17] |
| ORF01102 | 2203 & 2204 | hypothetical protein |
| ORF01103 | 2205 & 2206 | Protein lysA |
| ORF01104 | 2207 & 2208 | Protein lysB (AB008550) |
| ORF01105 | 2209 & 2210 | LysC |
| ORF01106 | 2211 & 2212 | Tail completion protein R (GPR) |
| ORF01107 | 2213 & 2214 | phage virion morphogenesis protein |
| ORF01108 | 2215 & 2216 | gpV (gpV) |

TABLE 1-continued

Annotation of ORF00001 to ORF04995

| ORFnnnnn | SEQ ID NOs | Annotation |
|---|---|---|
| ORF01109 | 2217 & 2218 | Baseplate assembly protein W (GPW) (gpW) |
| ORF01110 | 2219 & 2220 | Baseplate J-like protein |
| ORF01111 | 2221 & 2222 | gpI (gpI) |
| ORF01112 | 2223 & 2224 | gpH |
| ORF01113 | 2225 & 2226 | gpG (gpG) |
| ORF01114 | 2227 & 2228 | hypothetical protein |
| ORF01115 | 2229 & 2230 | Phage tail sheath protein |
| ORF01116 | 2231 & 2232 | phage major tail tube protein |
| ORF01117 | 2233 & 2234 | Phage tail protein E |
| ORF01118 | 2235 & 2236 | phage tail tape meausure protein, TP901 family, putative |
| ORF01119 | 2237 & 2238 | gpU (gpU) |
| ORF01120 | 2239 & 2240 | Gene D protein (GPD) |
| ORF01121 | 2241 & 2242 | Ogr |
| ORF01122 | 2243 & 2244 | formate acetyltransferase (pflB) [2.3.1.54] |
| ORF01123 | 2245 & 2246 | Probable formate transporter 1 |
| ORF01124 | 2247 & 2248 | unnamed protein product |
| ORF01125 | 2249 & 2250 | Protein of unknown function (DUF421) family |
| ORF01126 | 2251 & 2252 | phosphoserine aminotransferase (serC) [2.6.1.52] |
| ORF01127 | 2253 & 2254 | 3-phosphoshikimate 1-carboxyvinyltransferase (aroA) [2.5.1.19] |
| ORF01128 | 2255 & 2256 | cmk protein precursor [3.4.24.—] |
| ORF01129 | 2257 & 2258 | cytidylate kinase (cmk) [2.7.4.14] |
| ORF01130 | 2259 & 2260 | ribosomal protein S1 (rpsA) |
| ORF01131 | 2261 & 2262 | integration host factor, beta subunit (ihfB) |
| ORF01132 | 2263 & 2264 | DNA internalization-related competence protein ComEC-Rec2 |
| ORF01133 | 2265 & 2266 | lipid A export ATP-binding-permease protein MsbA (msbA) |
| ORF01134 | 2267 & 2268 | tetraacyldisaccharide 4'-kinase (lpxK) [2.7.1.130] |
| ORF01135 | 2269 & 2270 | Protein of unknown function (DUF1006) superfamily |
| ORF01136 | 2271 & 2272 | Tetraacyldisaccharide-1-P 4'-kinase |
| ORF01137 | 2273 & 2274 | 3-deoxy-D-manno-octulosonate cytidylyltransferase (kdsB) [2.7.7.38] |
| ORF01138 | 2275 & 2276 | Uncharacterized ACR, COG1434 family |
| ORF01139 | 2277 & 2278 | mukF protein (killing factor KicB) |
| ORF01140 | 2279 & 2280 | conserved hypothetical protein |
| ORF01141 | 2281 & 2282 | Protein smtA |
| ORF01142 | 2283 & 2284 | Chromosome partition protein mukF (kicB) |
| ORF01143 | 2285 & 2286 | Chromosome partition protein mukE |
| ORF01144 | 2287 & 2288 | cell division protein mukB (mukB) |
| ORF01145 | 2289 & 2290 | conserved hypothetical protein |
| ORF01146 | 2291 & 2292 | Bacterial protein of unknown function (DUF882) superfamily |
| ORF01147 | 2293 & 2294 | metallo-beta-lactamase superfamily protein [3.—.—.—] |
| ORF01148 | 2295 & 2296 | Aspartate aminotransferase (aspC) [2.6.1.1] |
| ORF01149 | 2297 & 2298 | Outer membrane protein F precursor (GBP) |
| ORF01150 | 2299 & 2300 | asparaginyl-tRNA synthetase (asnS) [6.1.1.22] |
| ORF01151 | 2301 & 2302 | nicotinate phosphoribosyltransferase (pncB) [2.4.2.11] |
| ORF01152 | 2303 & 2304 | aminopeptidase N (pepN) [3.4.11.2] |
| ORF01153 | 2305 & 2306 | sulfonate ABC transporter, ATP-binding subunit SsuB (AF075709) |
| ORF01154 | 2307 & 2308 | sulfonate ABC transporter, permease protein SsuC |
| ORF01155 | 2309 & 2310 | Alkanesulfonate monooxygenase [1.14.14.5] |
| ORF01156 | 2311 & 2312 | hypothetical protein |
| ORF01157 | 2313 & 2314 | ABC transporter, aliphatic sulfonates binding protein |
| ORF01158 | 2315 & 2316 | FMN reductase [1.5.1.29] |
| ORF01159 | 2317 & 2318 | dihydroorotate oxidase (pyrD) [1.3.3.1] |
| ORF01160 | 2319 & 2320 | Protein of unknown function (DUF1379) superfamily |
| ORF01161 | 2321 & 2322 | flavodoxin reductase (ferredoxin-NADPH reductase) family 1 |
| ORF01162 | 2323 & 2324 | predicted N6-adenine-specific DNA methylase |
| ORF01163 | 2325 & 2326 | ABC transporter ATP-binding protein uup |
| ORF01164 | 2327 & 2328 | hypothetical protein |
| ORF01165 | 2329 & 2330 | Paraquat-inducible protein A |
| ORF01166 | 2331 & 2332 | paraquat-inducible protein B |
| ORF01167 | 2333 & 2334 | Protein of unknown function (DUF330) superfamily |
| ORF01168 | 2335 & 2336 | Ribosome modulation factor (Protein E)-related protein |
| ORF01169 | 2337 & 2338 | beta-hydroxyacyl-(acyl-carrier-protein) dehydratase FabA (fabA) [4.2.1.—] |
| ORF01170 | 2339 & 2340 | unnamed protein product |
| ORF01171 | 2341 & 2342 | Outer membrane protein A precursor |
| ORF01172 | 2343 & 2344 | Cell division inhibitor |
| ORF01173 | 2345 & 2346 | hypothetical membrane protein, TIGR01666 (yccS) |
| ORF01174 | 2347 & 2348 | Regulator of competence-specific genes |
| ORF01175 | 2349 & 2350 | Domain of unknown function |
| ORF01176 | 2351 & 2352 | DNA helicase IV [3.6.1.—] |
| ORF01177 | 2353 & 2354 | methylglyoxal synthase (mgsA) [4.2.3.3] |
| ORF01178 | 2355 & 2356 | Hypothetical UPF0319 protein yccT precursor |
| ORF01179 | 2357 & 2358 | Protein yccU |
| ORF01180 | 2359 & 2360 | hemimethylated DNA binding domain, putative |
| ORF01181 | 2361 & 2362 | predicted SAM-dependent methyltransferase |
| ORF01182 | 2363 & 2364 | Acylphosphatase |
| ORF01183 | 2365 & 2366 | probable sulfite reductase gamma chain [1.8.—.—] |
| ORF01184 | 2367 & 2368 | Integral membrane protein |

TABLE 1-continued

Annotation of ORF00001 to ORF04995

| ORFnnnnn | SEQ ID NOs | Annotation |
|---|---|---|
| ORF01185 | 2369 & 2370 | Hydrogenase-1 small chain precursor |
| ORF01186 | 2371 & 2372 | conserved hypothetical protein |
| ORF01187 | 2373 & 2374 | Unknown protein encoded within prophage |
| ORF01188 | 2375 & 2376 | Uncharacterized BCR, COG1636 family |
| ORF01189 | 2377 & 2378 | putative cell killing protein of prophage (gef) |
| ORF01190 | 2379 & 2380 | Protein of unknown function (DUF1277) superfamily |
| ORF01191 | 2381 & 2382 | endodeoxyribonuclease RUS (Holliday junction resolvase) [3.1.22.—] |
| ORF01192 | 2383 & 2384 | Antitermination protein Q homolog of cryptic prophage |
| ORF01193 | 2385 & 2386 | hypothetical protein |
| ORF01194 | 2387 & 2388 | unnamed protein product; ORF137, length |
| ORF01195 | 2389 & 2390 | lysis protein S.b1556 |
| ORF01196 | 2391 & 2392 | hypothetical bacteriophage protein |
| ORF01197 | 2393 & 2394 | Lysozyme (Lysis protein) (Muramidase) (Endolysin) [3.2.1.17] |
| ORF01198 | 2395 & 2396 | lipoprotein Rz1 precursor-related protein |
| ORF01199 | 2397 & 2398 | Bacteriophage lysis protein |
| ORF01200 | 2399 & 2400 | Sb56 |
| ORF01201 | 2401 & 2402 | phage terminase, small subunit, putative, P27 family, putative |
| ORF01202 | 2403 & 2404 | phage terminase, large subunit, putative |
| ORF01203 | 2405 & 2406 | hypothetical protein |
| ORF01204 | 2407 & 2408 | phage portal protein, HK97 family |
| ORF01205 | 2409 & 2410 | Caudovirus prohead protease |
| ORF01206 | 2411 & 2412 | phage major capsid protein, HK97 family |
| ORF01207 | 2413 & 2414 | uncharacterized phage protein (possible DNA packaging) |
| ORF01208 | 2415 & 2416 | phage head-tail adaptor, putative |
| ORF01209 | 2417 & 2418 | phage protein, HK97 gp10 family |
| ORF01210 | 2419 & 2420 | Gp11 |
| ORF01211 | 2421 & 2422 | major tail subunit |
| ORF01212 | 2423 & 2424 | Phage tail assembly chaperone |
| ORF01213 | 2425 & 2426 | Gp14 |
| ORF01214 | 2427 & 2428 | tail length tape measure protein |
| ORF01215 | 2429 & 2430 | phage minor tail protein L |
| ORF01216 | 2431 & 2432 | Putative tail fiber component K of prophage |
| ORF01217 | 2433 & 2434 | Bacteriophage lambda tail assembly protein I |
| ORF01218 | 2435 & 2436 | Host specificity protein J (partial) |
| ORF01219 | 2437 & 2438 | Host specificity protein J (partial) |
| ORF01220 | 2439 & 2440 | host specificity protein (partial) |
| ORF01221 | 2441 & 2442 | Lom |
| ORF01222 | 2443 & 2444 | conserved hypothetical protein |
| ORF01223 | 2445 & 2446 | conserved hypothetical protein |
| ORF01224 | 2447 & 2448 | conserved hypothetical protein |
| ORF01225 | 2449 & 2450 | conserved hypothetical protein |
| ORF01226 | 2451 & 2452 | CdtA |
| ORF01227 | 2453 & 2454 | CdtB |
| ORF01228 | 2455 & 2456 | CdtC |
| ORF01229 | 2457 & 2458 | Periplasmic solute binding protein family family |
| ORF01230 | 2459 & 2460 | MEMBRANE PROTEIN |
| ORF01231 | 2461 & 2462 | Hypothetical UPF0190 protein yedY (AE005419) |
| ORF01232 | 2463 & 2464 | transthyretin family protein |
| ORF01233 | 2465 & 2466 | Transcriptional activator protein CopR. |
| ORF01234 | 2467 & 2468 | histidine kinase [2.7.3.—] |
| ORF01235 | 2469 & 2470 | H-NS-repressed protein, 30K (Hsp31) |
| ORF01236 | 2471 & 2472 | Outer membrane protein N precursor (OmpF) |
| ORF01237 | 2473 & 2474 | HD domain protein |
| ORF01238 | 2475 & 2476 | DNA-cytosine methyltransferase (M.EcoDcm) [2.1.1.37] |
| ORF01239 | 2477 & 2478 | integral membrane protein |
| ORF01240 | 2479 & 2480 | patch repair protein [3.1.—.—] |
| ORF01241 | 2481 & 2482 | Protein of unknown function |
| ORF01242 | 2483 & 2484 | conserved hypothetical protein |
| ORF01243 | 2485 & 2486 | conserved hypothetical protein |
| ORF01244 | 2487 & 2488 | diguanylate cyclase (GGDEF) domain protein |
| ORF01245 | 2489 & 2490 | mannosyl-3-phosphoglycerate phosphatase-related protein [3.1.3.—] |
| ORF01246 | 2491 & 2492 | conserved hypothetical protein |
| ORF01247 | 2493 & 2494 | conserved hypothetical protein |
| ORF01248 | 2495 & 2496 | Colanic acid capsular biosynthesis activation protein A |
| ORF01249 | 2497 & 2498 | flagellar biosynthetic protein FliR (fliR) |
| ORF01250 | 2499 & 2500 | flagellar biosynthetic protein FliQ (fliQ) |
| ORF01251 | 2501 & 2502 | flagellar biosynthetic protein FliP (fliP) |
| ORF01252 | 2503 & 2504 | terminase large subunit |
| ORF01253 | 2505 & 2506 | phage terminase family protein, putative |
| ORF01254 | 2507 & 2508 | hypothetical protein |
| ORF01255 | 2509 & 2510 | Gp45 |
| ORF01256 | 2511 & 2512 | conserved hypothetical protein |
| ORF01257 | 2513 & 2514 | CI protein |
| ORF01258 | 2515 & 2516 | transcriptional regulator, Cro-CI family-related protein |
| ORF01259 | 2517 & 2518 | repressor (cII) |
| ORF01260 | 2519 & 2520 | O (DNA replication; 299) |

TABLE 1-continued

Annotation of ORF00001 to ORF04995

| ORFnnnnn | SEQ ID NOs | Annotation |
|---|---|---|
| ORF01261 | 2521 & 2522 | P protein |
| ORF01262 | 2523 & 2524 | hydrogenase |
| ORF01263 | 2525 & 2526 | Hydrogenase-1 large chain (NiFe hydrogenase) (Membrane-bound hydrogenase 1 large subunit) (HYD1) (hyaB) [1.12.99.6] |
| ORF01264 | 2527 & 2528 | Ni—Fe-hydrogenase, b-type cytochrome subunit (CybH) |
| ORF01265 | 2529 & 2530 | Hydrogenase 1 maturation protease [3.4.24.—] |
| ORF01266 | 2531 & 2532 | Hydrogenase-1 operon protein hyaE |
| ORF01267 | 2533 & 2534 | Hydrogenase-1 operon protein hyaF |
| ORF01268 | 2535 & 2536 | cytochrome d ubiquinol oxidase, subunit I |
| ORF01269 | 2537 & 2538 | cytochrome d ubiquinol oxidase, subunit II (cydB) [1.10.3.—] |
| ORF01270 | 2539 & 2540 | conserved hypothetical protein |
| ORF01271 | 2541 & 2542 | cold shock-like protein |
| ORF01272 | 2543 & 2544 | Periplasmic appA protein precursor (agp) [3.1.3.2] |
| ORF01273 | 2545 & 2546 | hypothetical protein |
| ORF01274 | 2547 & 2548 | cold shock-like protein |
| ORF01275 | 2549 & 2550 | GnsB protein |
| ORF01276 | 2551 & 2552 | Putative electron transport protein yccM |
| ORF01277 | 2553 & 2554 | 2.7.3.—[2.7.3.—] |
| ORF01278 | 2555 & 2556 | TorCAD operon transcriptional Regulatory protein torR |
| ORF01279 | 2557 & 2558 | Periplasmic protein torT precursor |
| ORF01280 | 2559 & 2560 | trimethylamine-N-oxide reductase c-type cytochrome TorC (torC) |
| ORF01281 | 2561 & 2562 | trimethylamine-N-oxide reductase TorA (torA) [1.7.2.3] |
| ORF01282 | 2563 & 2564 | Chaperone protein torD |
| ORF01283 | 2565 & 2566 | conserved hypothetical protein |
| ORF01284 | 2567 & 2568 | conserved hypothetical protein |
| ORF01285 | 2569 & 2570 | dnaJ protein |
| ORF01286 | 2571 & 2572 | periplasmic glucose-1-phosphatase |
| ORF01287 | 2573 & 2574 | conserved hypothetical protein |
| ORF01288 | 2575 & 2576 | trp repressor-binding protein |
| ORF01289 | 2577 & 2578 | conserved hypothetical protein |
| ORF01290 | 2579 & 2580 | uracil-xanthine permease |
| ORF01291 | 2581 & 2582 | conserved hypothetical protein |
| ORF01292 | 2583 & 2584 | uracil-xanthine permease |
| ORF01293 | 2585 & 2586 | 4-hydroxyphenylacetate 3-monooxygenase (EC 1.14.13.3) small chain [1.14.13.3] |
| ORF01294 | 2587 & 2588 | putative nitroreductase (AE005300) [1.—.—.—] |
| ORF01295 | 2589 & 2590 | 3-oxoadipate enol-lactone hydrolase-4-carboxymuconolactone decarboxylase, putative |
| ORF01296 | 2591 & 2592 | hypothetical protein |
| ORF01297 | 2593 & 2594 | endoribonuclease L-PSP, putative |
| ORF01298 | 2595 & 2596 | Hypothetical isochorismatase family protein ycdL |
| ORF01299 | 2597 & 2598 | bacterial luciferase family protein, putative |
| ORF01300 | 2599 & 2600 | transcriptional regulator, TetR family, |
| ORF01301 | 2601 & 2602 | proline dehydrogenase-delta-1-pyrroline-5-carboxylate dehydrogenase |
| ORF01302 | 2603 & 2604 | conserved hypothetical protein |
| ORF01303 | 2605 & 2606 | sodium-proline symporter (putP) |
| ORF01304 | 2607 & 2608 | membrane protein, putative |
| ORF01305 | 2609 & 2610 | putative lipoprotein |
| ORF01306 | 2611 & 2612 | Tat-translocated enzyme |
| ORF01307 | 2613 & 2614 | PhoH family protein |
| ORF01308 | 2615 & 2616 | conserved hypothetical protein |
| ORF01309 | 2617 & 2618 | haemin storage system, HmsR protein (lgtD) |
| ORF01310 | 2619 & 2620 | HmsF (HmsF) |
| ORF01311 | 2621 & 2622 | haemin storage system, HmsH protein |
| ORF01312 | 2623 & 2624 | GGDEF domain protein |
| ORF01313 | 2625 & 2626 | integrase |
| ORF01314 | 2627 & 2628 | probable membrane protein |
| ORF01315 | 2629 & 2630 | INSA |
| ORF01316 | 2631 & 2632 | transposase |
| ORF01317 | 2633 & 2634 | hypothetical protein |
| ORF01318 | 2635 & 2636 | Prophage CP4-57 Regulatory protein alpA |
| ORF01319 | 2637 & 2638 | conserved hypothetical protein |
| ORF01320 | 2639 & 2640 | predicted methyltransferase |
| ORF01321 | 2641 & 2642 | predicted methyltransferase |
| ORF01322 | 2643 & 2644 | enterotoxin |
| ORF01323 | 2645 & 2646 | aminotransferase, class II, putative |
| ORF01324 | 2647 & 2648 | KbaY [4.1.2.—] |
| ORF01325 | 2649 & 2650 | PUTATIVE TAGATOSE 6-PHOSPHATE KINASE PROTEIN |
| ORF01326 | 2651 & 2652 | DeoR-family regulatory protein |
| ORF01327 | 2653 & 2654 | Transcriptional regulator of sugar metabolism |
| ORF01328 | 2655 & 2656 | D-galactarate dehydratase [4.2.1.42] |
| ORF01329 | 2657 & 2658 | D-GALACTARATE DEHYDRATASE [4.2.1.7] |
| ORF01330 | 2659 & 2660 | putative hydrolase |
| ORF01331 | 2661 & 2662 | galactarate dehydrogenase [4.2.1.42] |
| ORF01332 | 2663 & 2664 | hypothetical protein |
| ORF01333 | 2665 & 2666 | conserved hypothetical protein |
| ORF01334 | 2667 & 2668 | Putative F1C and S fimbrial switch Regulatory |

TABLE 1-continued

Annotation of ORF00001 to ORF04995

| ORFnnnnn | SEQ ID NOs | Annotation |
|---|---|---|
| ORF01335 | 2669 & 2670 | SfaB protein |
| ORF01336 | 2671 & 2672 | hypothetical protein |
| ORF01337 | 2673 & 2674 | SfaD protein |
| ORF01338 | 2675 & 2676 | SfaE protein |
| ORF01339 | 2677 & 2678 | F1C fimbrial usher |
| ORF01340 | 2679 & 2680 | S fimbrial adhesin minor subunit SfaG |
| ORF01341 | 2681 & 2682 | S fimbrial adhesin minor subunit SfaS (pilin) |
| ORF01342 | 2683 & 2684 | S fimbrial adhesin minor subunit SfaH |
| ORF01343 | 2685 & 2686 | EAL domain, putative |
| ORF01344 | 2687 & 2688 | PapX protein |
| ORF01345 | 2689 & 2690 | hypothetical protein |
| ORF01346 | 2691 & 2692 | IroN protein |
| ORF01347 | 2693 & 2694 | IroE |
| ORF01348 | 2695 & 2696 | IroD protein (Fes) |
| ORF01349 | 2697 & 2698 | IroC (ABC) |
| ORF01350 | 2699 & 2700 | Putative glucosyltransferase |
| ORF01351 | 2701 & 2702 | conserved hypothetical protein |
| ORF01352 | 2703 & 2704 | conserved hypothetical protein |
| ORF01353 | 2705 & 2706 | unnamed protein product; ORF94, length (ISPlu9-p) |
| ORF01354 | 2707 & 2708 | Transposase, IS4 family |
| ORF01355 | 2709 & 2710 | tonB dependent outer membrane hemin receptor, hmuR (Y08983) |
| ORF01356 | 2711 & 2712 | conserved hypothetical protein |
| ORF01357 | 2713 & 2714 | cobalamin synthesis protein, putative |
| ORF01358 | 2715 & 2716 | ECs1339 |
| ORF01359 | 2717 & 2718 | conserved hypothetical protein |
| ORF01360 | 2719 & 2720 | hypothetical protein |
| ORF01361 | 2721 & 2722 | replication protein (Rep) |
| ORF01362 | 2723 & 2724 | hypothetical protein |
| ORF01363 | 2725 & 2726 | YeeP protein |
| ORF01364 | 2727 & 2728 | antigen43 protein orthologue |
| ORF01365 | 2729 & 2730 | conserved hypothetical protein |
| ORF01366 | 2731 & 2732 | Z1215 protein (o273) |
| ORF01367 | 2733 & 2734 | conserved hypothetical protein |
| ORF01368 | 2735 & 2736 | Antirestriction protein family |
| ORF01369 | 2737 & 2738 | YeeS protein (o160) |
| ORF01370 | 2739 & 2740 | intergenic-region protein-related protein |
| ORF01371 | 2741 & 2742 | conserved hypothetical protein |
| ORF01372 | 2743 & 2744 | intergenic-region protein |
| ORF01373 | 2745 & 2746 | YeeV protein |
| ORF01374 | 2747 & 2748 | L0008-like protein |
| ORF01375 | 2749 & 2750 | Z1225 protein (AF071034) |
| ORF01376 | 2751 & 2752 | Z1226 protein |
| ORF01377 | 2753 & 2754 | putative dehydrogenase (AE005314) |
| ORF01378 | 2755 & 2756 | PHP family protein |
| ORF01379 | 2757 & 2758 | TorD protein |
| ORF01380 | 2759 & 2760 | Protein of unknown function (DUF1097) superfamily |
| ORF01381 | 2761 & 2762 | Curli production assembly-transport component csgG precursor |
| ORF01382 | 2763 & 2764 | Curli production assembly-transport component csgF precursor |
| ORF01383 | 2765 & 2766 | Curli production assembly-transport component csgE precursor |
| ORF01384 | 2767 & 2768 | transcriptional regulator, LuxR family |
| ORF01385 | 2769 & 2770 | curli fiber major subunit CsgA, degenerate |
| ORF01386 | 2771 & 2772 | curli fiber major subunit CsgA, degenerate, putative |
| ORF01387 | 2773 & 2774 | conserved hypothetical protein |
| ORF01388 | 2775 & 2776 | Appr-1-p processing enzyme family protein |
| ORF01389 | 2777 & 2778 | cardiolipin synthase |
| ORF01390 | 2779 & 2780 | Glucans biosynthesis protein C [2.1.—.—] |
| ORF01391 | 2781 & 2782 | conserved hypothetical protein |
| ORF01392 | 2783 & 2784 | Periplasmic glucans biosynthesis protein mdoG precursor |
| ORF01393 | 2785 & 2786 | Periplasmic glucans biosynthesis protein mdoH |
| ORF01394 | 2787 & 2788 | conserved hypothetical protein |
| ORF01395 | 2789 & 2790 | Protein of unknown function (DUF1375) superfamily |
| ORF01396 | 2791 & 2792 | Acidic protein msyB |
| ORF01397 | 2793 & 2794 | major facilitator family transporter |
| ORF01398 | 2795 & 2796 | Lipid A biosynthesis lauroyl acyltransferase |
| ORF01399 | 2797 & 2798 | rhodanese-like domain protein, putative |
| ORF01400 | 2799 & 2800 | Protein yceI precursor |
| ORF01401 | 2801 & 2802 | Cytochrome b561 homolog 2 |
| ORF01402 | 2803 & 2804 | conserved hypothetical protein |
| ORF01403 | 2805 & 2806 | N-methyl-L-tryptophan oxidase (MTOX) [1.5.3.—] |
| ORF01404 | 2807 & 2808 | unnamed protein product; ORF_ID: o233#8 |
| ORF01405 | 2809 & 2810 | unnamed protein product; ORF_ID: o233#9 |
| ORF01406 | 2811 & 2812 | dihydroorotase, homodimeric type (pyrC) [3.5.2.3] |
| ORF01407 | 2813 & 2814 | Protein of unknown function (DUF1439) superfamily |
| ORF01408 | 2815 & 2816 | Glutaredoxin, GrxB family (grxB) |
| ORF01409 | 2817 & 2818 | Major Facilitator Superfamily subfamily |
| ORF01410 | 2819 & 2820 | Ribosomal-protein-alanine acetyltransferase [2.3.1.128] |

TABLE 1-continued

Annotation of ORF00001 to ORF04995

| ORFnnnnn | SEQ ID NOs | Annotation |
|---|---|---|
| ORF01411 | 2821 & 2822 | g20.3 |
| ORF01412 | 2823 & 2824 | putative virulence factor |
| ORF01413 | 2825 & 2826 | integral membrane protein MviN (mviN) |
| ORF01414 | 2827 & 2828 | Flagella synthesis protein flgN |
| ORF01415 | 2829 & 2830 | Negative regulator of flagellin synthesis (Anti-sigma-28 factor) |
| ORF01416 | 2831 & 2832 | flagellar basal body P-ring protein FlgA precursor |
| ORF01417 | 2833 & 2834 | flagellar basal-body rod protein FlgB (flgB) |
| ORF01418 | 2835 & 2836 | flagellar basal-body rod protein FlgC (flgC) |
| ORF01419 | 2837 & 2838 | flagellar biosynthesis, hook protein |
| ORF01420 | 2839 & 2840 | flagellar biosynthesis, hook protein |
| ORF01421 | 2841 & 2842 | Flagellar basal-body rod protein flgF |
| ORF01422 | 2843 & 2844 | Flagellar basal-body rod protein flgG (Distal rod protein) |
| ORF01423 | 2845 & 2846 | flagellar L-ring protein FlgH (flgH) |
| ORF01424 | 2847 & 2848 | flagellar P-ring protein FlgI (flgI) |
| ORF01425 | 2849 & 2850 | Peptidoglycan hydrolase flgJ [3.2.1.—] |
| ORF01426 | 2851 & 2852 | flagellar hook-associated protein 1 (hap1) |
| ORF01427 | 2853 & 2854 | Flagellar hook-associated protein 3 (hap3) |
| ORF01428 | 2855 & 2856 | Ribonuclease E (RNase E) (rne) [3.1.4.—] |
| ORF01429 | 2857 & 2858 | hypothetical protein |
| ORF01430 | 2859 & 2860 | ribosomal large subunit pseudouridine synthase C (orfx) [4.2.1.70] |
| ORF01431 | 2861 & 2862 | ribosomal large subunit pseudouridine synthase C (orfx) [4.2.1.70] |
| ORF01432 | 2863 & 2864 | maf protein (maf) |
| ORF01433 | 2865 & 2866 | Uncharacterized ACR, COG1399 |
| ORF01434 | 2867 & 2868 | ribosomal protein L32 (rpmF) |
| ORF01435 | 2869 & 2870 | 3-oxoacyl-[acyl-carrier-protein] synthase II |
| ORF01436 | 2871 & 2872 | Aminodeoxychorismate lyase (4-amino-4-deoxychorismatelyase) (ADC lyase) (ADCL) (ADCL) [4.1.3.38] |
| ORF01437 | 2873 & 2874 | conserved hypothetical protein TIGR00247 |
| ORF01438 | 2875 & 2876 | thymidylate kinase (tmk) [2.7.4.9] |
| ORF01439 | 2877 & 2878 | DNA polymerase III, delta' subunit [2.7.7.7] |
| ORF01440 | 2879 & 2880 | Putative deoxyribonuclease ycfH |
| ORF01441 | 2881 & 2882 | PTS system, glucose-specific IIBC component (ptsG) [2.7.1.69] |
| ORF01442 | 2883 & 2884 | FhuE receptor precursor (III) |
| ORF01443 | 2885 & 2886 | HIT-like protein ycfF (Ap4A) |
| ORF01444 | 2887 & 2888 | Protein of unknown function (DUF1425) superfamily |
| ORF01445 | 2889 & 2890 | Fibronectin-binding protein B |
| ORF01446 | 2891 & 2892 | unnamed protein product [3.2.1.21] |
| ORF01447 | 2893 & 2894 | Beta-hexosaminidase |
| ORF01448 | 2895 & 2896 | ycfP protein |
| ORF01449 | 2897 & 2898 | NADH dehydrogenase |
| ORF01450 | 2899 & 2900 | conserved hypothetical protein |
| ORF01451 | 2901 & 2902 | transcriptional regulator, TetR family |
| ORF01452 | 2903 & 2904 | Protein of unknown function (DUF1471) superfamily |
| ORF01453 | 2905 & 2906 | ErfK-YbiS-YcfS-YnhG family |
| ORF01454 | 2907 & 2908 | transcription-repair coupling factor mutation frequency decline |
| ORF01455 | 2909 & 2910 | Acyltransferase family, putative |
| ORF01456 | 2911 & 2912 | hypothetical protein |
| ORF01457 | 2913 & 2914 | ABC transporter, integral membrane protein |
| ORF01458 | 2915 & 2916 | lipoprotein releasing system, ATP-binding protein (lolD) |
| ORF01459 | 2917 & 2918 | lipoprotein releasing system, transmembrane protein LolE (lolE) |
| ORF01460 | 2919 & 2920 | ROK family protein |
| ORF01461 | 2921 & 2922 | NAD-dependent deacetylase (Regulatory protein SIR2homolog) (DMB) [3.5.1.—] |
| ORF01462 | 2923 & 2924 | conserved hypothetical protein |
| ORF01463 | 2925 & 2926 | conserved hypothetical protein |
| ORF01464 | 2927 & 2928 | Spermidine-putrescine-binding periplasmic protein precursor (potD) |
| ORF01465 | 2929 & 2930 | Spermidine-putrescine transport system permease protein potC (potC) |
| ORF01466 | 2931 & 2932 | spermidine-putrescine transport system permease |
| ORF01467 | 2933 & 2934 | ABC transporter, polyamine transport protein, ATP-binding protein (atp_bind) |
| ORF01468 | 2935 & 2936 | peptidase T (pepT) [3.4.11.14] |
| ORF01469 | 2937 & 2938 | ycfD protein |
| ORF01470 | 2939 & 2940 | Sensor protein phoQ [2.7.3.—] |
| ORF01471 | 2941 & 2942 | transcriptional regulatory protein |
| ORF01472 | 2943 & 2944 | adenylosuccinate lyase (purB) [4.3.2.2] |
| ORF01473 | 2945 & 2946 | Uncharacterized protein involved in purine metabolism |
| ORF01474 | 2947 & 2948 | tRNA (5-methylaminomethyl-2-thiouridylate)-methyltransferase (trmU) [2.1.1.61] |
| ORF01475 | 2949 & 2950 | unnamed protein product [3.6.—.—] |
| ORF01476 | 2951 & 2952 | RNA pseudouridylate synthase family protein [4.2.1.70] |
| ORF01477 | 2953 & 2954 | conserved hypothetical protein |
| ORF01478 | 2955 & 2956 | isocitrate dehydrogenase, NADP-dependent (icd) [1.1.1.42] |
| ORF01479 | 2957 & 2958 | Prophage lambda integrase |
| ORF01480 | 2959 & 2960 | conserved hypothetical protein |
| ORF01481 | 2961 & 2962 | unnamed protein product; Some similarities with bacteriophage protein |
| ORF01482 | 2963 & 2964 | exonuclease Z0951 [similarity] [3.1.11.3] |
| ORF01483 | 2965 & 2966 | recombination protein Bet |
| ORF01484 | 2967 & 2968 | Host-nuclease inhibitor protein Gam |
| ORF01485 | 2969 & 2970 | Kil protein |

TABLE 1-continued

Annotation of ORF00001 to ORF04995

| ORFnnnnn | SEQ ID NOs | Annotation |
|---|---|---|
| ORF01486 | 2971 & 2972 | Lambda Regulatory protein CIII-related protein |
| ORF01487 | 2973 & 2974 | Ea10 gene protein |
| ORF01488 | 2975 & 2976 | conserved hypothetical protein |
| ORF01489 | 2977 & 2978 | antitermination protein Q |
| ORF01490 | 2979 & 2980 | lysozyme [3.2.1.17] |
| ORF01491 | 2981 & 2982 | Bacteriophage lysis protein |
| ORF01492 | 2983 & 2984 | hypothetical protein |
| ORF01493 | 2985 & 2986 | prophage L54a, HNH endonuclease family protein |
| ORF01494 | 2987 & 2988 | small terminase subunit |
| ORF01495 | 2989 & 2990 | phage terminase, large subunit, putative |
| ORF01496 | 2991 & 2992 | conserved hypothetical protein |
| ORF01497 | 2993 & 2994 | phage portal protein, HK97 family |
| ORF01498 | 2995 & 2996 | Sb5 (AF181080) |
| ORF01499 | 2997 & 2998 | phage major capsid protein, HK97 family |
| ORF01500 | 2999 & 3000 | Sb7-related protein |
| ORF01501 | 3001 & 3002 | Sb8 |
| ORF01502 | 3003 & 3004 | Sb9 |
| ORF01503 | 3005 & 3006 | hypothetical protein |
| ORF01504 | 3007 & 3008 | Sb11 |
| ORF01505 | 3009 & 3010 | conserved hypothetical protein |
| ORF01506 | 3011 & 3012 | Bacteriophage Mu tail sheath protein (GpL) |
| ORF01507 | 3013 & 3014 | Sb14 |
| ORF01508 | 3015 & 3016 | hypothetical protein |
| ORF01509 | 3017 & 3018 | Sb15 |
| ORF01510 | 3019 & 3020 | tail protein |
| ORF01511 | 3021 & 3022 | tail-DNA circulation protein (muN) |
| ORF01512 | 3023 & 3024 | Bacteriophage Mu P protein |
| ORF01513 | 3025 & 3026 | Bacteriophage Mu Gp45 protein |
| ORF01514 | 3027 & 3028 | Phage protein GP46 |
| ORF01515 | 3029 & 3030 | tail protein |
| ORF01516 | 3031 & 3032 | tail protein |
| ORF01517 | 3033 & 3034 | ycfE protein (fragment) |
| ORF01518 | 3035 & 3036 | Domain of unknown function DUF144 superfamily |
| ORF01519 | 3037 & 3038 | unnamed protein product; unidentified reading frame P-293 |
| ORF01520 | 3039 & 3040 | lipoprotein Rz1 precursor-related protein |
| ORF01521 | 3041 & 3042 | Bacteriophage lysis protein |
| ORF01522 | 3043 & 3044 | Bor protein homolog from lambdoid prophage DLP12 |
| ORF01523 | 3045 & 3046 | hypothetical protein |
| ORF01524 | 3047 & 3048 | conserved hypothetical protein |
| ORF01525 | 3049 & 3050 | Bacteriophage lambda head decoration protein D |
| ORF01526 | 3051 & 3052 | Phage major capsid protein E |
| ORF01527 | 3053 & 3054 | conserved hypothetical protein |
| ORF01528 | 3055 & 3056 | Phage Head-Tail Attachment |
| ORF01529 | 3057 & 3058 | Prophage minor tail protein Z (GPZ) |
| ORF01530 | 3059 & 3060 | Minor tail protein U |
| ORF01531 | 3061 & 3062 | hypothetical protein |
| ORF01532 | 3063 & 3064 | Minor tail protein Z (GPZ) |
| ORF01533 | 3065 & 3066 | Phage minor tail protein U |
| ORF01534 | 3067 & 3068 | minor tail protein |
| ORF01535 | 3069 & 3070 | Phage minor tail protein U |
| ORF01536 | 3071 & 3072 | major tail protein |
| ORF01537 | 3073 & 3074 | phage minor tail protein G |
| ORF01538 | 3075 & 3076 | minor tail protein |
| ORF01539 | 3077 & 3078 | minor tail protein |
| ORF01540 | 3079 & 3080 | tail length tape measure protein precursor |
| ORF01541 | 3081 & 3082 | minor tail protein |
| ORF01542 | 3083 & 3084 | Minor tail protein precursor H |
| ORF01543 | 3085 & 3086 | Minor tail protein precursor H |
| ORF01544 | 3087 & 3088 | hypothetical bacteriophage protein |
| ORF01545 | 3089 & 3090 | unnamed protein product; Similar to tail fiber assembly protein |
| ORF01546 | 3091 & 3092 | Protease VII precursor (Omptin) (Outer membrane protein3B) (Protease A) (SopA) [3.4.21.87] |
| ORF01547 | 3093 & 3094 | Protease VII precursor (Omptin) (Outer membrane protein3B) (Protease A) (SopA) [3.4.21.87] |
| ORF01548 | 3095 & 3096 | Protease VII precursor (Omptin) (Outer membrane protein3B) (Protease A) (SopA) [3.4.21.87] |
| ORF01549 | 3097 & 3098 | ydfE protein (35 kD) |
| ORF01550 | 3099 & 3100 | Phage terminase large subunit (GpA) |
| ORF01551 | 3101 & 3102 | Phage terminase large subunit (GpA) |
| ORF01552 | 3103 & 3104 | Phage terminase large subunit (GpA) |
| ORF01553 | 3105 & 3106 | Portal protein (Head protein GP4) |
| ORF01554 | 3107 & 3108 | head-tail preconnector protein GP5 |
| ORF01555 | 3109 & 3110 | Head-tail preconnector protein GP5 [Contains: Scaffold protein GP6(Head protein GP6)] |
| ORF01556 | 3111 & 3112 | Bacteriophage lambda head decoration protein D |
| ORF01557 | 3113 & 3114 | Phage major capsid protein E |

TABLE 1-continued

Annotation of ORF00001 to ORF04995

| ORFnnnnn | SEQ ID NOs | Annotation |
|---|---|---|
| ORF01558 | 3115 & 3116 | conserved hypothetical protein |
| ORF01559 | 3117 & 3118 | Phage Head-Tail Attachment |
| ORF01560 | 3119 & 3120 | Prophage minor tail protein Z (GPZ) |
| ORF01561 | 3121 & 3122 | Phage minor tail protein U |
| ORF01562 | 3123 & 3124 | major tail protein |
| ORF01563 | 3125 & 3126 | phage minor tail protein G |
| ORF01564 | 3127 & 3128 | minor tail protein |
| ORF01565 | 3129 & 3130 | Portal protein (Head protein GP4) |
| ORF01566 | 3131 & 3132 | head-tail preconnector protein GP5 |
| ORF01567 | 3133 & 3134 | Head-tail preconnector protein GP5 [Contains: Scaffold protein GP6(Head protein GP6)] |
| ORF01568 | 3135 & 3136 | Head-tail preconnector protein GP5 [Contains: Scaffold protein GP6(Head protein GP6)] |
| ORF01569 | 3137 & 3138 | Bacteriophage lambda head decoration protein D |
| ORF01570 | 3139 & 3140 | phage tail tape measure protein, lambda family |
| ORF01571 | 3141 & 3142 | Phage minor tail protein |
| ORF01572 | 3143 & 3144 | minor tail protein |
| ORF01573 | 3145 & 3146 | Putative tail component of prophage |
| ORF01574 | 3147 & 3148 | Phage minor tail protein |
| ORF01575 | 3149 & 3150 | Phage minor tail protein L |
| ORF01576 | 3151 & 3152 | Putative tail component of prophage |
| ORF01577 | 3153 & 3154 | Phage minor tail protein |
| ORF01578 | 3155 & 3156 | Phage minor tail protein L |
| ORF01579 | 3157 & 3158 | transcriptional regulator, GntR family |
| ORF01580 | 3159 & 3160 | Probable oxidoreductase ydfG |
| ORF01581 | 3161 & 3162 | peptidyl-dipeptidase Dcp, putative |
| ORF01582 | 3163 & 3164 | peptidyl-dipeptidase Dcp |
| ORF01583 | 3165 & 3166 | hypothetical protein |
| ORF01584 | 3167 & 3168 | GGDEF domain protein |
| ORF01585 | 3169 & 3170 | hypothetical protein |
| ORF01586 | 3171 & 3172 | Major Facilitator Superfamily subfamily |
| ORF01587 | 3173 & 3174 | YdeD |
| ORF01588 | 3175 & 3176 | Putative conserved protein |
| ORF01589 | 3177 & 3178 | PTS system, cellobiose-specific IIB component (PTS) [2.7.1.69] |
| ORF01590 | 3179 & 3180 | Putative conserved protein |
| ORF01591 | 3181 & 3182 | PTS system, cellobiose-specific IIA component |
| ORF01592 | 3183 & 3184 | f538 |
| ORF01593 | 3185 & 3186 | 6-phospho-beta-glucosidase |
| ORF01594 | 3187 & 3188 | Multiple antibiotic resistance protein marB-related protein |
| ORF01595 | 3189 & 3190 | multiple antibiotic resistance protein MarA |
| ORF01596 | 3191 & 3192 | Multiple antibiotic resistance protein marR (AL359989) |
| ORF01597 | 3193 & 3194 | conserved hypothetical protein TIGR00427 |
| ORF01598 | 3195 & 3196 | Sugar efflux transporter |
| ORF01599 | 3197 & 3198 | transcriptional regulator, LysR family |
| ORF01600 | 3199 & 3200 | Aldehyde-dehydrogenase like protein ynel (SSDH) [1.2.1.—] |
| ORF01601 | 3201 & 3202 | glutaminase family protein, interruption-N |
| ORF01602 | 3203 & 3204 | conserved hypothetical protein |
| ORF01603 | 3205 & 3206 | GGDEF domain protein |
| ORF01604 | 3207 & 3208 | altronate oxidoreductase |
| ORF01605 | 3209 & 3210 | Uncharacterised protein family (UPF0187) superfamily |
| ORF01606 | 3211 & 3212 | trans-aconitate methyltransferase [2.1.1.144] |
| ORF01607 | 3213 & 3214 | Protein hipB |
| ORF01608 | 3215 & 3216 | Protein hipA |
| ORF01609 | 3217 & 3218 | conserved hypothetical protein |
| ORF01610 | 3219 & 3220 | short chain dehydrogenase |
| ORF01611 | 3221 & 3222 | Type-1 fimbrial protein, A chain precursor |
| ORF01612 | 3223 & 3224 | Chaperone protein fimC precursor |
| ORF01613 | 3225 & 3226 | Outer membrane usher protein fimD precursor |
| ORF01614 | 3227 & 3228 | fimbrial morphology |
| ORF01615 | 3229 & 3230 | Hypothetical fimbrial-like protein ydeQ precursor |
| ORF01616 | 3231 & 3232 | oxidoreductase alpha (molybdopterin) subunit |
| ORF01617 | 3233 & 3234 | HTH-type transcriptional regulator ydeO |
| ORF01618 | 3235 & 3236 | arylsulfatase B (GALNS) |
| ORF01619 | 3237 & 3238 | radical SAM domain protein protein |
| ORF01620 | 3239 & 3240 | ABC efflux transporter, permease-ATP-binding protein, putative |
| ORF01621 | 3241 & 3242 | cds103 |
| ORF01622 | 3243 & 3244 | cds103 |
| ORF01623 | 3245 & 3246 | peptidase, M16 family, putative [3.4.99.—] |
| ORF01624 | 3247 & 3248 | glutamate decarboxylase [4.1.1.15] |
| ORF01625 | 3249 & 3250 | Amino acid antiporter |
| ORF01626 | 3251 & 3252 | yngK protein |
| ORF01627 | 3253 & 3254 | Putative conserved protein-related protein |
| ORF01628 | 3255 & 3256 | Sensor protein FixL (EC 2.7.3.—). (nifL) [2.7.3.—] |
| ORF01629 | 3257 & 3258 | protein C, osmotically inducible |
| ORF01630 | 3259 & 3260 | hypothetical protein |
| ORF01631 | 3261 & 3262 | conserved hypothetical protein |

TABLE 1-continued

Annotation of ORF00001 to ORF04995

| ORFnnnnn | SEQ ID NOs | Annotation |
|---|---|---|
| ORF01632 | 3263 & 3264 | conserved hypothetical protein |
| ORF01633 | 3265 & 3266 | 30S ribosomal protein S22 (Stationary-phase-induced ribosome-associated protein) (SRA) (Protein D)-related protein |
| ORF01634 | 3267 & 3268 | hypothetical protein |
| ORF01635 | 3269 & 3270 | NAD-linked malate dehydrogenase (malic enzyme) |
| ORF01636 | 3271 & 3272 | alcohol dehydrogenase, propanol-preferring (adhA) [1.—.—.—] |
| ORF01637 | 3273 & 3274 | proteic killer suppression protein hig A |
| ORF01638 | 3275 & 3276 | conserved hypothetical protein |
| ORF01639 | 3277 & 3278 | proteic killer active protein hig B |
| ORF01640 | 3279 & 3280 | formate dehydrogenase, gamma subunit [1.2.1.2] |
| ORF01641 | 3281 & 3282 | formate dehydrogenase, beta subunit (FdxH) [1.2.1.2] |
| ORF01642 | 3283 & 3284 | formate dehydrogenase, alpha subunit, selenocysteine-containing [1.2.1.2] |
| ORF01643 | 3285 & 3286 | formate dehydrogenase, alpha subunit, selenocysteine-containing [1.2.1.2] |
| ORF01644 | 3287 & 3288 | formate dehydrogenase, alpha subunit, selenocysteine-containing [1.2.1.2] |
| ORF01645 | 3289 & 3290 | hypothetical protein |
| ORF01646 | 3291 & 3292 | membrane protein yddG |
| ORF01647 | 3293 & 3294 | nitrite extrusion protein 2 |
| ORF01648 | 3295 & 3296 | nitrate reductase, alpha subunit [1.7.99.4] |
| ORF01649 | 3297 & 3298 | nitrate reductase, beta subunit (narH) [1.7.99.4] |
| ORF01650 | 3299 & 3300 | Respiratory nitrate reductase 2 delta chain [1.7.99.4] |
| ORF01651 | 3301 & 3302 | respiratory nitrate reductase, gamma subunit (narI) [1.7.99.4] |
| ORF01652 | 3303 & 3304 | phenazine biosynthesis protein PhzF family subfamily |
| ORF01653 | 3305 & 3306 | Chain D, M. Smegmatis Arylamine N-Acetyl Transferase [2.3.1.118] |
| ORF01654 | 3307 & 3308 | Flavin reductase like domain protein |
| ORF01655 | 3309 & 3310 | H repeat-associated protein (ORF-H) |
| ORF01656 | 3311 & 3312 | conserved hypothetical protein |
| ORF01657 | 3313 & 3314 | conserved hypothetical protein |
| ORF01658 | 3315 & 3316 | Aec15 (AF044503) |
| ORF01659 | 3317 & 3318 | Uncharacterized conserved protein |
| ORF01660 | 3319 & 3320 | probable transferase (U59485) |
| ORF01661 | 3321 & 3322 | glutathione S-transferase gst |
| ORF01662 | 3323 & 3324 | L-asparagine permease (516aa) |
| ORF01663 | 3325 & 3326 | conserved hypothetical protein |
| ORF01664 | 3327 & 3328 | TonB-dependent receptor protein |
| ORF01665 | 3329 & 3330 | Putative conserved protein-related protein |
| ORF01666 | 3331 & 3332 | acetyltransferase, GNAT family [2.3.1.—] |
| ORF01667 | 3333 & 3334 | Protein of unknown function, DUF606 superfamily |
| ORF01668 | 3335 & 3336 | conserved hypothetical protein |
| ORF01669 | 3337 & 3338 | conserved hypothetical protein |
| ORF01670 | 3339 & 3340 | hypothetical protein |
| ORF01671 | 3341 & 3342 | aldehyde dehydrogenase family protein (BADH) [1.2.1.8] |
| ORF01672 | 3343 & 3344 | polyamine ABC transporter, permease protein |
| ORF01673 | 3345 & 3346 | polyamine ABC transporter, permease protein |
| ORF01674 | 3347 & 3348 | polyamine ABC transporter, ATP-binding protein |
| ORF01675 | 3349 & 3350 | polyamine ABC transporter, periplasmic polyamine-binding protein |
| ORF01676 | 3351 & 3352 | unnamed protein product (TAT) [2.6.1.5] |
| ORF01677 | 3353 & 3354 | unnamed protein product |
| ORF01678 | 3355 & 3356 | conserved hypothetical protein |
| ORF01679 | 3357 & 3358 | peptidase, U32 family |
| ORF01680 | 3359 & 3360 | transcriptional regulator, Cro-Cl family, putative |
| ORF01681 | 3361 & 3362 | similar to benzoate transport protein |
| ORF01682 | 3363 & 3364 | Hypothetical lipoprotein ydcL precursor |
| ORF01683 | 3365 & 3366 | tellurite resistance protein TehB (tehB) |
| ORF01684 | 3367 & 3368 | Tellurite resistance protein tehA |
| ORF01685 | 3369 & 3370 | ribosomal-protein-serine acetyltransferase, putative |
| ORF01686 | 3371 & 3372 | conserved hypothetical protein |
| ORF01687 | 3373 & 3374 | Protein of unknown function (DUF465) family |
| ORF01688 | 3375 & 3376 | Glucans biosynthesis protein D precursor |
| ORF01689 | 3377 & 3378 | Protein of unknown function (DUF1338) family |
| ORF01690 | 3379 & 3380 | transcriptional regulator PcaQ |
| ORF01691 | 3381 & 3382 | methyl-accepting chemotaxis protein II, aspartate sensor receptor |
| ORF01692 | 3383 & 3384 | Hok protein.-related protein |
| ORF01693 | 3385 & 3386 | conserved hypothetical protein |
| ORF01694 | 3387 & 3388 | Cytochrome b561 (561) |
| ORF01695 | 3389 & 3390 | glyceraldehyde-3-phosphate dehydrogenase, type I (gap) [1.2.1.—] |
| ORF01696 | 3391 & 3392 | Aldehyde dehydrogenase A (NAD) [1.2.1.22] |
| ORF01697 | 3393 & 3394 | Protein ydcF |
| ORF01698 | 3395 & 3396 | ATP-dependent helicase HrpA (hrpA) |
| ORF01699 | 3397 & 3398 | [acyl-carrier-protein] phosphodiesterase acpD (fragment) [3.1.4.14] |
| ORF01700 | 3399 & 3400 | Dual specificity phosphatase, catalytic domain protein |
| ORF01701 | 3401 & 3402 | Lysophospholipase |
| ORF01702 | 3403 & 3404 | phosphatidate cytidylyltransferase (cdsA) [2.7.7.41] |
| ORF01703 | 3405 & 3406 | CDP-alcohol phosphatidyltransferase family |
| ORF01704 | 3407 & 3408 | oxidoreductase, aldo-keto reductase family [1.—.—.—] |
| ORF01705 | 3409 & 3410 | split orf |
| ORF01706 | 3411 & 3412 | Protein of unknown function (DUF1318) family |

TABLE 1-continued

Annotation of ORF00001 to ORF04995

| ORFnnnnn | SEQ ID NOs | Annotation |
|---|---|---|
| ORF01707 | 3413 & 3414 | lipoprotein, putative |
| ORF01708 | 3415 & 3416 | unnamed protein product; Similar to membrane protein YdbH of *Escherichia coli* |
| ORF01709 | 3417 & 3418 | fermentative D-lactate dehydrogenase (D-LDH) [1.1.1.28] |
| ORF01710 | 3419 & 3420 | Heat shock protein hslJ |
| ORF01711 | 3421 & 3422 | lipoprotein, putative |
| ORF01712 | 3423 & 3424 | pyruvate:ferredoxin (flavodoxin) oxidoreductase (nifJ) [1.2.7.1] |
| ORF01713 | 3425 & 3426 | Outer membrane protein N precursor (lbc) |
| ORF01714 | 3427 & 3428 | putative filament protein |
| ORF01715 | 3429 & 3430 | integrase for bacteriophage BP-933W |
| ORF01716 | 3431 & 3432 | YdaO protein |
| ORF01717 | 3433 & 3434 | ATP-independent RNA helicase dbpA |
| ORF01718 | 3435 & 3436 | hypothetical protein |
| ORF01719 | 3437 & 3438 | CorA-like Mg2+ transporter protein |
| ORF01720 | 3439 & 3440 | Diguanylate cyclase-phosphodiesterase domain 1 (GGDEF) |
| ORF01721 | 3441 & 3442 | Smr domain protein |
| ORF01722 | 3443 & 3444 | drug resistance transporter, Bcr-CflA family (emrB) |
| ORF01723 | 3445 & 3446 | HlyD family secretion protein |
| ORF01724 | 3447 & 3448 | transcriptional regulator, AraC family |
| ORF01725 | 3449 & 3450 | conserved hypothetical protein |
| ORF01726 | 3451 & 3452 | Methylated-DNA--protein-cysteine methyltransferase (6-O-methylguanine-DNA methyltransferase) (MGMT) (O-6-methylguanine-DNA-alkyltransferase) [2.1.1.63] |
| ORF01727 | 3453 & 3454 | Fumarate and nitrate reduction Regulatory protein |
| ORF01728 | 3455 & 3456 | universal stress protein family domain protein |
| ORF01729 | 3457 & 3458 | conserved hypothetical protein |
| ORF01730 | 3459 & 3460 | small-conductance mechanosensitive channel |
| ORF01731 | 3461 & 3462 | Periplasmic murein peptide-binding protein precursor |
| ORF01732 | 3463 & 3464 | Xanthosine operon regulatory protein. |
| ORF01733 | 3465 & 3466 | dienelactone hydrolase domain protein |
| ORF01734 | 3467 & 3468 | conserved hypothetical protein |
| ORF01735 | 3469 & 3470 | Mandelate racemase —muconate lactonizing enzyme, C-terminal domain protein |
| ORF01736 | 3471 & 3472 | YcjI |
| ORF01737 | 3473 & 3474 | thiol peroxidase (P20) [1.11.1.—] |
| ORF01738 | 3475 & 3476 | Transcriptional Regulatory protein tyrR |
| ORF01739 | 3477 & 3478 | conserved hypothetical protein TIGR01620 |
| ORF01740 | 3479 & 3480 | YcjX (AY008264) |
| ORF01741 | 3481 & 3482 | transcription regulator homolog lin2974 |
| ORF01742 | 3483 & 3484 | Outer membrane protein G precursor |
| ORF01743 | 3485 & 3486 | ABC transporter domain protein |
| ORF01744 | 3487 & 3488 | beta-phosphoglucomutase (pgmB) [5.4.2.6] |
| ORF01745 | 3489 & 3490 | maltose phosphorylase homolog lin2966 (phosphorylase) [3.2.1.—] |
| ORF01746 | 3491 & 3492 | oxidoreductase, Gfo-Idh-MocA family |
| ORF01747 | 3493 & 3494 | an *E. coli* protein homolog lin2968 [5.3.1.—] |
| ORF01748 | 3495 & 3496 | Alcohol dehydrogenase (EC 1.1.1.1). [1.1.1.—] |
| ORF01749 | 3497 & 3498 | ABC transporter, permease protein (AF175299) |
| ORF01750 | 3499 & 3500 | Sn-glycerol-3-phosphate transport system permease protein UgpA. (AF307052) |
| ORF01751 | 3501 & 3502 | ABC transporter, substrate-binding protein |
| ORF01752 | 3503 & 3504 | dextransucrase (EC 2.4.1.5), putative [2.4.1.5] |
| ORF01753 | 3505 & 3506 | rhodanese-like domain protein |
| ORF01754 | 3507 & 3508 | phage shock protein-related protein |
| ORF01755 | 3509 & 3510 | Phage shock protein C |
| ORF01756 | 3511 & 3512 | phage shock protein B |
| ORF01757 | 3513 & 3514 | Phage shock protein A |
| ORF01758 | 3515 & 3516 | Psp operon transcriptional activator |
| ORF01759 | 3517 & 3518 | probable amino acid permease ycjJ |
| ORF01760 | 3519 & 3520 | conserved hypothetical protein |
| ORF01761 | 3521 & 3522 | Peptide transport periplasmic protein sapA precursor |
| ORF01762 | 3523 & 3524 | Peptide transport system permease protein sapB |
| ORF01763 | 3525 & 3526 | Peptide transport system permease protein sapC (sapC) |
| ORF01764 | 3527 & 3528 | Peptide transport system ATP-binding protein sapD |
| ORF01765 | 3529 & 3530 | Peptide transport system ATP-binding protein sapF |
| ORF01766 | 3531 & 3532 | drug resistance transporter, Bcr-CflA family protein |
| ORF01767 | 3533 & 3534 | EefC outer membrane protein |
| ORF01768 | 3535 & 3536 | Acriflavine resistance protein B |
| ORF01769 | 3537 & 3538 | Acriflavine resistance protein A precursor (MFP) |
| ORF01770 | 3539 & 3540 | transcriptional regulator, TetR family |
| ORF01771 | 3541 & 3542 | enoyl-[acyl-carrier-protein] reductase ECs1861 (NADH) [1.3.1.9] |
| ORF01772 | 3543 & 3544 | conserved hypothetical protein |
| ORF01773 | 3545 & 3546 | exoribonuclease II (rnb) [3.1.13.1] |
| ORF01774 | 3547 & 3548 | sensory box protein |
| ORF01775 | 3549 & 3550 | conserved hypothetical protein |
| ORF01776 | 3551 & 3552 | glycerol-3-phosphate regulon repressor, putative |
| ORF01777 | 3553 & 3554 | Osmotically inducible lipoprotein B precursor-related protein |
| ORF01778 | 3555 & 3556 | translation initation factor SUI1, putative |
| ORF01779 | 3557 & 3558 | orotidine 5'-phosphate decarboxylase (pyrF) [4.1.1.23] |
| ORF01780 | 3559 & 3560 | hypothetical protein |
| ORF01781 | 3561 & 3562 | predicted N-acetylglucosaminyl transferase |

TABLE 1-continued

Annotation of ORF00001 to ORF04995

| ORFnnnnn | SEQ ID NOs | Annotation |
|---|---|---|
| ORF01782 | 3563 & 3564 | unnamed protein product |
| ORF01783 | 3565 & 3566 | Phosphatidylglycerophosphatase B (pgpB) [3.1.3.27] |
| ORF01784 | 3567 & 3568 | GTP cyclohydrolase II (ribA) [3.5.4.25] |
| ORF01785 | 3569 & 3570 | aconitate hydratase 1 (acnA) [4.2.1.3] |
| ORF01786 | 3571 & 3572 | conserved hypothetical protein |
| ORF01787 | 3573 & 3574 | conserved hypothetical protein |
| ORF01788 | 3575 & 3576 | HTH-type transcriptional regulator cysB (Cys regulon transcriptionalactivator) |
| ORF01789 | 3577 & 3578 | DNA topoisomerase I |
| ORF01790 | 3579 & 3580 | hypothetical protein |
| ORF01791 | 3581 & 3582 | Protein yciN |
| ORF01792 | 3583 & 3584 | Possible protease sohB |
| ORF01793 | 3585 & 3586 | Oxidoreductase [1.—.—.—] |
| ORF01794 | 3587 & 3588 | cob(I)alamin adenosyltransferase (cobO) [2.5.1.17] |
| ORF01795 | 3589 & 3590 | RNA pseudouridylate synthase family protein [4.2.1.70] |
| ORF01796 | 3591 & 3592 | conserved hypothetical protein |
| ORF01797 | 3593 & 3594 | Sua5-YciO-YrdC-YwlC family protein |
| ORF01798 | 3595 & 3596 | Protein trpH |
| ORF01799 | 3597 & 3598 | anthranilate synthase component I (trpE) [4.1.3.27] |
| ORF01800 | 3599 & 3600 | Anthranilate synthase component II [4.1.3.27] |
| ORF01801 | 3601 & 3602 | anthranilate isomerase (PRAI) [4.1.1.48] |
| ORF01802 | 3603 & 3604 | tryptophan synthase, beta subunit (trpB) [4.2.1.20] |
| ORF01803 | 3605 & 3606 | tryptophan synthase, alpha subunit (trpA) [4.2.1.20] |
| ORF01804 | 3607 & 3608 | conserved hypothetical protein |
| ORF01805 | 3609 & 3610 | Protein yciF |
| ORF01806 | 3611 & 3612 | yciE |
| ORF01807 | 3613 & 3614 | Outer membrane protein W precursor |
| ORF01808 | 3615 & 3616 | Tail fiber assembly protein homolog from lambdoid prophage |
| ORF01809 | 3617 & 3618 | Tail fiber assembly protein homolog from lambdoid prophage Qin |
| ORF01810 | 3619 & 3620 | probable membrane protein of prophage CP-933X Z1918 |
| ORF01811 | 3621 & 3622 | probable membrane protein of prophage CP-933X Z1918 |
| ORF01812 | 3623 & 3624 | unknown protein encoded by prophage CP-933X |
| ORF01813 | 3625 & 3626 | hypothetical protein |
| ORF01814 | 3627 & 3628 | Lom |
| ORF01815 | 3629 & 3630 | host specificity protein (partial) |
| ORF01816 | 3631 & 3632 | Host specificity protein J (partial) |
| ORF01817 | 3633 & 3634 | Bacteriophage lambda tail assembly protein I |
| ORF01818 | 3635 & 3636 | Putative tail fiber component K of prophage |
| ORF01819 | 3637 & 3638 | minor tail protein |
| ORF01820 | 3639 & 3640 | minor tail protein |
| ORF01821 | 3641 & 3642 | Phage minor tail protein |
| ORF01822 | 3643 & 3644 | Minor tail protein precursor H |
| ORF01823 | 3645 & 3646 | minor tail protein |
| ORF01824 | 3647 & 3648 | phage minor tail protein G |
| ORF01825 | 3649 & 3650 | Bacterial Ig-like domain (group 2) family |
| ORF01826 | 3651 & 3652 | Phage minor tail protein U |
| ORF01827 | 3653 & 3654 | Prophage minor tail protein Z (GPZ) |
| ORF01828 | 3655 & 3656 | Phage Head-Tail Attachment |
| ORF01829 | 3657 & 3658 | conserved hypothetical protein |
| ORF01830 | 3659 & 3660 | Phage major capsid protein E |
| ORF01831 | 3661 & 3662 | Bacteriophage lambda head decoration protein D |
| ORF01832 | 3663 & 3664 | head-tail preconnector protein GP5 |
| ORF01833 | 3665 & 3666 | phage portal protein, lambda family |
| ORF01834 | 3667 & 3668 | gpW |
| ORF01835 | 3669 & 3670 | Phage terminase large subunit (GpA) |
| ORF01836 | 3671 & 3672 | Terminase small subunit (GP1) (fragment) |
| ORF01837 | 3673 & 3674 | hypothetical protein |
| ORF01838 | 3675 & 3676 | Bacteriophage lysis protein |
| ORF01839 | 3677 & 3678 | lipoprotein Rz1 precursor-related protein |
| ORF01840 | 3679 & 3680 | putative bacteriophage protein |
| ORF01841 | 3681 & 3682 | Lysozyme (Lysis protein) (Muramidase) (Endolysin) [3.2.1.17] |
| ORF01842 | 3683 & 3684 | Protein of unknown function (DUF1327) superfamily |
| ORF01843 | 3685 & 3686 | Lysis protein S homolog from lambdoid prophage |
| ORF01844 | 3687 & 3688 | unnamed protein product; ORF616 |
| ORF01845 | 3689 & 3690 | unnamed protein product; ORF616 |
| ORF01846 | 3691 & 3692 | DNA adenine-methylase |
| ORF01847 | 3693 & 3694 | unknown protein encoded by prophage CP-933O |
| ORF01848 | 3695 & 3696 | Antitermination protein Q homolog of cryptic prophage |
| ORF01849 | 3697 & 3698 | endodeoxyribonuclease RUS (Holliday junction resolvase) [3.1.22.—] |
| ORF01850 | 3699 & 3700 | Protein of unknown function (DUF1277) superfamily |
| ORF01851 | 3701 & 3702 | prophage maintenance protein [similarity]-related protein |
| ORF01852 | 3703 & 3704 | hypothetical protein |
| ORF01853 | 3705 & 3706 | conserved hypothetical protein |
| ORF01854 | 3707 & 3708 | Unknown protein encoded within prophage |
| ORF01855 | 3709 & 3710 | conserved hypothetical protein |
| ORF01856 | 3711 & 3712 | Unknown protein encoded by cryptic prophage |
| ORF01857 | 3713 & 3714 | Peptidase S24-like domain, putative |

TABLE 1-continued

Annotation of ORF00001 to ORF04995

| ORFnnnnn | SEQ ID NOs | Annotation |
|---|---|---|
| ORF01858 | 3715 & 3716 | Protein of unknown function (DUF1391) family |
| ORF01859 | 3717 & 3718 | ydfB protein-related protein |
| ORF01860 | 3719 & 3720 | conserved hypothetical protein |
| ORF01861 | 3721 & 3722 | hypothetical protein |
| ORF01862 | 3723 & 3724 | Division inhibition protein dicB |
| ORF01863 | 3725 & 3726 | unknown protein encoded by prophage CP-933O-related protein |
| ORF01864 | 3727 & 3728 | Exodeoxyribonuclease VIII (35 kD) [3.1.11.—] |
| ORF01865 | 3729 & 3730 | integrase |
| ORF01866 | 3731 & 3732 | Outer membrane protein W precursor |
| ORF01867 | 3733 & 3734 | yciC |
| ORF01868 | 3735 & 3736 | intracellular septation protein A (ispZ) |
| ORF01869 | 3737 & 3738 | acyl-CoA hydrolase [3.1.2.—] |
| ORF01870 | 3739 & 3740 | TonB protein |
| ORF01871 | 3741 & 3742 | ycil protein |
| ORF01872 | 3743 & 3744 | Putative potassium channel protein |
| ORF01873 | 3745 & 3746 | Cardiolipin synthetase (Cardiolipin synthase) (CLsynthase) [2.7.8.—] |
| ORF01874 | 3747 & 3748 | Protein of unknown function, DUF440 superfamily |
| ORF01875 | 3749 & 3750 | peptide ABC transporter, ATP-binding protein (AA1) |
| ORF01876 | 3751 & 3752 | oligopeptide ABC transporter, ATP-binding protein (AA1) |
| ORF01877 | 3753 & 3754 | oligopeptide ABC transporter, permease protein (AA1) |
| ORF01878 | 3755 & 3756 | Oligopeptide transport system permease protein oppB (AA1) |
| ORF01879 | 3757 & 3758 | Periplasmic oligopeptide-binding protein precursor |
| ORF01880 | 3759 & 3760 | membrane protein, putative |
| ORF01881 | 3761 & 3762 | acetaldehyde dehydrogenase (acetylating) —alcohol dehydrogenase (EC 1.1.1.1) (ACDH) [1.2.1.10] |
| ORF01882 | 3763 & 3764 | Transposase insG for insertion sequence element IS4 |
| ORF01883 | 3765 & 3766 | thymidine kinase [2.7.1.21] |
| ORF01884 | 3767 & 3768 | conserved hypothetical protein |
| ORF01885 | 3769 & 3770 | DNA-binding protein H-NS homolog virR |
| ORF01886 | 3771 & 3772 | UTP-glucose-1-phosphate uridylyltransferase (galU) [2.7.7.9] |
| ORF01887 | 3773 & 3774 | Hnr protein |
| ORF01888 | 3775 & 3776 | drug transporter |
| ORF01889 | 3777 & 3778 | unnamed protein product |
| ORF01890 | 3779 & 3780 | formyltetrahydrofolate deformylase (purU) [3.5.1.10] |
| ORF01891 | 3781 & 3782 | Tpn1330 protein |
| ORF01892 | 3783 & 3784 | respiratory nitrate reductase, gamma subunit (narI) [1.7.99.4] |
| ORF01893 | 3785 & 3786 | Respiratory nitrate reductase 1 delta chain [1.7.99.4] |
| ORF01894 | 3787 & 3788 | nitrate reductase, beta subunit (narH) [1.7.99.4] |
| ORF01895 | 3789 & 3790 | nitrate reductase, alpha subunit [1.7.99.4] |
| ORF01896 | 3791 & 3792 | Nitrite extrusion protein 1 |
| ORF01897 | 3793 & 3794 | Nitrate-nitrite sensor protein narX [2.7.3.—] |
| ORF01898 | 3795 & 3796 | narL |
| ORF01899 | 3797 & 3798 | conserved hypothetical protein |
| ORF01900 | 3799 & 3800 | YchN protein |
| ORF01901 | 3801 & 3802 | Cation transport protein chaC |
| ORF01902 | 3803 & 3804 | Cation transport regulator chaB-related protein |
| ORF01903 | 3805 & 3806 | Calcium-proton antiporter |
| ORF01904 | 3807 & 3808 | conserved hypothetical protein |
| ORF01905 | 3809 & 3810 | 3-deoxy-8-phosphooctulonate synthase (kdsA) [2.5.1.55] |
| ORF01906 | 3811 & 3812 | Protein sirB1 |
| ORF01907 | 3813 & 3814 | Protein sirB1 |
| ORF01908 | 3815 & 3816 | Protein sirB2 |
| ORF01909 | 3817 & 3818 | Protein methyltransferase hemK (hemK) [2.1.1.—] |
| ORF01910 | 3819 & 3820 | peptide chain release factor 1 (prfA) |
| ORF01911 | 3821 & 3822 | glutamyl-tRNA reductase (hemA) [1.2.1.—] |
| ORF01912 | 3823 & 3824 | outer membrane lipoprotein LolB (lolB) |
| ORF01913 | 3825 & 3826 | 4-diphosphocytidyl-2C-methyl-D-erythritol kinase (ispE) [2.7.1.148] |
| ORF01914 | 3827 & 3828 | Ribose-phosphate pyrophosphokinase |
| ORF01915 | 3829 & 3830 | sulfate permease family protein |
| ORF01916 | 3831 & 3832 | conserved hypothetical protein |
| ORF01917 | 3833 & 3834 | peptidyl-tRNA hydrolase (pth) [3.1.1.29] |
| ORF01918 | 3835 & 3836 | GTP-binding protein YchF (ychF) |
| ORF01919 | 3837 & 3838 | Glycerol metabolism operon Regulatory protein |
| ORF01920 | 3839 & 3840 | dihydroxyacetone kinase, DhaK subunit (dhaK) [2.7.1.—] |
| ORF01921 | 3841 & 3842 | dihydroxyacetone kinase, L subunit [2.7.1.—] |
| ORF01922 | 3843 & 3844 | phosphoenolpyruvate-protein phosphotransferase, EI-HPr-EIIA components |
| ORF01923 | 3845 & 3846 | hypothetical protein |
| ORF01924 | 3847 & 3848 | conserved hypothetical protein |
| ORF01925 | 3849 & 3850 | Trehalase [3.2.1.28] |
| ORF01926 | 3851 & 3852 | Periplasmic binding protein family |
| ORF01927 | 3853 & 3854 | Iron (III) |
| ORF01928 | 3855 & 3856 | conserved hypothetical protein |
| ORF01929 | 3857 & 3858 | possible ABC-type iron-siderophore transport system ATP-binding protein (III) |
| ORF01930 | 3859 & 3860 | conserved hypothetical protein |
| ORF01931 | 3861 & 3862 | modD protein (modD) |
| ORF01932 | 3863 & 3864 | Putative outer membrane receptor, probably tonB dependent |

TABLE 1-continued

Annotation of ORF00001 to ORF04995

| ORFnnnnn | SEQ ID NOs | Annotation |
|---|---|---|
| ORF01933 | 3865 & 3866 | Transglycosylase associated protein |
| ORF01934 | 3867 & 3868 | YcgR protein superfamily |
| ORF01935 | 3869 & 3870 | murein transglycosylase E |
| ORF01936 | 3871 & 3872 | Muramoyltetrapeptide carboxypeptidase (LD-carboxypeptidase A) [3.4.17.13] |
| ORF01937 | 3873 & 3874 | Na+-H+ antiporter |
| ORF01938 | 3875 & 3876 | alanine racemase (alr) [5.1.1.1] |
| ORF01939 | 3877 & 3878 | D-amino acid dehydrogenase small subunit |
| ORF01940 | 3879 & 3880 | unidentified protein |
| ORF01941 | 3881 & 3882 | negative regulator for fad regulon, and positive |
| ORF01942 | 3883 & 3884 | Na+-H+ antiporter NhaB (nhaB) |
| ORF01943 | 3885 & 3886 | Disulfide bond formation protein B [1.8.4.—] |
| ORF01944 | 3887 & 3888 | UmuC protein |
| ORF01945 | 3889 & 3890 | UmuD protein (R391) [3.4.21.—] |
| ORF01946 | 3891 & 3892 | cytolysin A |
| ORF01947 | 3893 & 3894 | Bacterial protein of unknown function (DUF838) superfamily |
| ORF01948 | 3895 & 3896 | Protein ycgM (FAA) |
| ORF01949 | 3897 & 3898 | Protein ycgL |
| ORF01950 | 3899 & 3900 | Fels-1 Prophage Protein-like family |
| ORF01951 | 3901 & 3902 | septum site-determining protein MinC (minC) |
| ORF01952 | 3903 & 3904 | Lom |
| ORF01953 | 3905 & 3906 | Putative tail component of prophage (partial) |
| ORF01954 | 3907 & 3908 | Lom |
| ORF01955 | 3909 & 3910 | Putative tail component of prophage (partial) |
| ORF01956 | 3911 & 3912 | hypothetical protein |
| ORF01957 | 3913 & 3914 | GntR-family transcriptional regulator |
| ORF01958 | 3915 & 3916 | conserved hypothetical protein |
| ORF01959 | 3917 & 3918 | fructuronate reductase [1.—.—.—] |
| ORF01960 | 3919 & 3920 | metabolite-proton symporter (PPII) |
| ORF01961 | 3921 & 3922 | L-iditol 2-dehydrogenase |
| ORF01962 | 3923 & 3924 | Starvation sensing protein rspA |
| ORF01963 | 3925 & 3926 | Uncharacterized BCR, YnfA-UPF0060 family superfamily |
| ORF01964 | 3927 & 3928 | Protein of unknown function (DUF1283) superfamily |
| ORF01965 | 3929 & 3930 | Spermidine N(1)-acetyltransferase (SAT) [2.3.1.57] |
| ORF01966 | 3931 & 3932 | ynfC protein |
| ORF01967 | 3933 & 3934 | Protein of unknown function (DUF1161) family |
| ORF01968 | 3935 & 3936 | DmsA [1.8.99.—] |
| ORF01969 | 3937 & 3938 | DmsA [1.8.99.—] |
| ORF01970 | 3939 & 3940 | dimethylsulfoxide reductase chain A2 precursor, anaerobic [1.8.—.—] |
| ORF01971 | 3941 & 3942 | Anaerobic dimethyl sulfoxide reductase chain B (dmsB) [1.8.—.—] |
| ORF01972 | 3943 & 3944 | DMSO reductase anchor subunit (DmsC) (dmsC) [1.8.99.—] |
| ORF01973 | 3945 & 3946 | TorD protein |
| ORF01974 | 3947 & 3948 | dethiobiotin synthetase (DTBS) |
| ORF01975 | 3949 & 3950 | Putative chloride channel protein eriC-like |
| ORF01976 | 3951 & 3952 | Mlc protein |
| ORF01977 | 3953 & 3954 | transcriptional regulator, LysR family |
| ORF01978 | 3955 & 3956 | unnamed protein product |
| ORF01979 | 3957 & 3958 | Acid shock protein repeat family |
| ORF01980 | 3959 & 3960 | glutamyl endopeptidase [3.4.21.—] |
| ORF01981 | 3961 & 3962 | possible chaperone |
| ORF01982 | 3963 & 3964 | DMT Superfamily drug efflux pump |
| ORF01983 | 3965 & 3966 | Domain of unknown function, putative |
| ORF01984 | 3967 & 3968 | NAD(P) transhydrogenase, beta subunit (pntB) [1.6.1.2] |
| ORF01985 | 3969 & 3970 | NAD(P) transhydrogenase, alpha subunit (pntA) [1.6.1.1] |
| ORF01986 | 3971 & 3972 | Protein ydgH precursor |
| ORF01987 | 3973 & 3974 | hypothetical protein |
| ORF01988 | 3975 & 3976 | unnamed protein product |
| ORF01989 | 3977 & 3978 | fabG5, putative [1.—.—.—] |
| ORF01990 | 3979 & 3980 | Membrane protein glpM |
| ORF01991 | 3981 & 3982 | Transcriptional Regulatory protein rstA |
| ORF01992 | 3983 & 3984 | Sensor protein rstB [2.7.3.—] |
| ORF01993 | 3985 & 3986 | DNA replication terminus site-binding protein |
| ORF01994 | 3987 & 3988 | fumarate hydratase, class II (fumC) [4.2.1.2] |
| ORF01995 | 3989 & 3990 | fumarate hydratase class I, anaerobic [4.2.1.2] |
| ORF01996 | 3991 & 3992 | mannose-6-phosphate isomerase, class I (manA) [5.3.1.8] |
| ORF01997 | 3993 & 3994 | Bacterial protein of unknown function (DUF945) superfamily |
| ORF01998 | 3995 & 3996 | membrane-associated protein |
| ORF01999 | 3997 & 3998 | Glucuronide carrier protein |
| ORF02000 | 3999 & 4000 | Beta-glucuronidase (GUS) [3.2.1.31] |
| ORF02001 | 4001 & 4002 | transcriptional regulator, TetR family domain protein, putative |
| ORF02002 | 4003 & 4004 | 7-alpha-hydroxysteroid dehydrogenase |
| ORF02003 | 4005 & 4006 | Maltose regulon Regulatory protein malI |
| ORF02004 | 4007 & 4008 | PTS system, maltose and glucose-specific IIBC component (malX) [2.7.1.69] |
| ORF02005 | 4009 & 4010 | aminotransferase, class II, putative [4.4.1.8] |
| ORF02006 | 4011 & 4012 | adenosine deaminase (add) [3.5.4.4] |
| ORF02007 | 4013 & 4014 | predicted dehydrogenase |
| ORF02008 | 4015 & 4016 | Hha protein |

TABLE 1-continued

Annotation of ORF00001 to ORF04995

| ORFnnnnn | SEQ ID NOs | Annotation |
|---|---|---|
| ORF02009 | 4017 & 4018 | conserved hypothetical protein |
| ORF02010 | 4019 & 4020 | Electron transport complex protein rnfA |
| ORF02011 | 4021 & 4022 | Electron transport complex protein rnfB |
| ORF02012 | 4023 & 4024 | Electron transport complex protein rnfC |
| ORF02013 | 4025 & 4026 | Electron transport complex protein rnfD |
| ORF02014 | 4027 & 4028 | Electron transport complex protein rnfG (rnfG) |
| ORF02015 | 4029 & 4030 | Electron transport complex protein rnfE |
| ORF02016 | 4031 & 4032 | endonuclease III (nth) [4.2.99.18] |
| ORF02017 | 4033 & 4034 | Hypothetical transporter ydgR |
| ORF02018 | 4035 & 4036 | Glutathione S-transferase [2.5.1.18] |
| ORF02019 | 4037 & 4038 | pyridoxal kinase [2.7.1.35] |
| ORF02020 | 4039 & 4040 | tyrosyl-tRNA synthetase (tyrS) [6.1.1.1] |
| ORF02021 | 4041 & 4042 | pyridoxamine 5'-phosphate oxidase (pdxH) [1.4.3.5] |
| ORF02022 | 4043 & 4044 | ydhA protein |
| ORF02023 | 4045 & 4046 | Hypothetical UPF0075 protein ydhH |
| ORF02024 | 4047 & 4048 | SlyA |
| ORF02025 | 4049 & 4050 | Fusaric acid resistance protein FusE. |
| ORF02026 | 4051 & 4052 | Fusaric acid resistance protein conserved region family |
| ORF02027 | 4053 & 4054 | Copper-zinc superoxide dismutase (sodC) |
| ORF02028 | 4055 & 4056 | oxidoreductase, aldo-keto reductase family [1.—.—.—] |
| ORF02029 | 4057 & 4058 | unnamed protein product |
| ORF02030 | 4059 & 4060 | transcriptional regulatory protein |
| ORF02031 | 4061 & 4062 | N-ethylmaleimide reductase (Y13942) [1.—.—.—] |
| ORF02032 | 4063 & 4064 | lactoylglutathione lyase (gloA) [4.4.1.5] |
| ORF02033 | 4065 & 4066 | ribonuclease T (rnt) [3.1.13.—] |
| ORF02034 | 4067 & 4068 | glutaredoxin-related protein |
| ORF02035 | 4069 & 4070 | hypothetical protein |
| ORF02036 | 4071 & 4072 | putative lipoprotein |
| ORF02037 | 4073 & 4074 | superoxide dismutase, iron [1.15.1.1] |
| ORF02038 | 4075 & 4076 | major facilitator family transporter (AL136500) |
| ORF02039 | 4077 & 4078 | hypothetical protein |
| ORF02040 | 4079 & 4080 | Purine nucleotide synthesis repressor (purR) |
| ORF02041 | 4081 & 4082 | cyn operon transcriptional activator. |
| ORF02042 | 4083 & 4084 | Bicyclomycin resistance protein (Sulfonamide resistance protein). |
| ORF02043 | 4085 & 4086 | cyclopropane-fatty-acyl-phospholipid synthase [2.1.1.79] |
| ORF02044 | 4087 & 4088 | riboflavin synthase, alpha subunit (ribE) [2.5.1.9] |
| ORF02045 | 4089 & 4090 | Multidrug resistance protein norM |
| ORF02046 | 4091 & 4092 | possible enzyme |
| ORF02047 | 4093 & 4094 | Protein ydhR precursor |
| ORF02048 | 4095 & 4096 | conserved hypothetical protein |
| ORF02049 | 4097 & 4098 | conserved hypothetical protein |
| ORF02050 | 4099 & 4100 | PhsC protein homolog [2.8.1.5] |
| ORF02051 | 4101 & 4102 | nrfC protein homolog b1671 (nrfC) [2.8.1.5] |
| ORF02052 | 4103 & 4104 | conserved hypothetical protein |
| ORF02053 | 4105 & 4106 | aldehyde-ferredoxin oxidoreductase PH0892 (aor) [1.—.—.—] |
| ORF02054 | 4107 & 4108 | aldehyde oxidoreductase (aor) [1.—.—.—] |
| ORF02055 | 4109 & 4110 | iron-sulfur cluster-binding protein [2.8.1.5] |
| ORF02056 | 4111 & 4112 | conserved hypothetical protein |
| ORF02057 | 4113 & 4114 | pyruvate kinase (pyk) [2.7.1.40] |
| ORF02058 | 4115 & 4116 | major outer membrane lipoprotein |
| ORF02059 | 4117 & 4118 | ErfK-YbiS-YcfS-YnhG family |
| ORF02060 | 4119 & 4120 | SufE protein (orf5) |
| ORF02061 | 4121 & 4122 | aminotransferase, class-V [4.4.1.16] |
| ORF02062 | 4123 & 4124 | FeS assembly protein SufD (sufD) |
| ORF02063 | 4125 & 4126 | FeS assembly ATPase SufC (sufC) |
| ORF02064 | 4127 & 4128 | FeS assembly protein SufB (sufB) |
| ORF02065 | 4129 & 4130 | FeS assembly scaffold SufA (sufA) |
| ORF02066 | 4131 & 4132 | unnamed protein product |
| ORF02067 | 4133 & 4134 | uncharacterized domain 1, putative |
| ORF02068 | 4135 & 4136 | oxidoreductase, FAD-binding, putative |
| ORF02069 | 4137 & 4138 | Hypothetical UPF0118 protein ydiK |
| ORF02070 | 4139 & 4140 | conserved hypothetical protein |
| ORF02071 | 4141 & 4142 | transport system permease protein homolog lin2340 |
| ORF02072 | 4143 & 4144 | Hypothetical transport protein ydiN |
| ORF02073 | 4145 & 4146 | shikimate 5-dehydrogenase [1.1.1.—] |
| ORF02074 | 4147 & 4148 | 3-dehydroquinate dehydratase, type I (aroD) [4.2.1.10] |
| ORF02075 | 4149 & 4150 | acetyl-CoA-transferase subunit, putative [2.8.3.—] |
| ORF02076 | 4151 & 4152 | acyl-CoA dehydrogenase family protein, putative [1.3.99.—] |
| ORF02077 | 4153 & 4154 | Hypothetical transcriptional regulator ydiP |
| ORF02078 | 4155 & 4156 | FixA protein |
| ORF02079 | 4157 & 4158 | electron transfer flavoprotein, alpha subunit, putative |
| ORF02080 | 4159 & 4160 | flavoprotein, probably electron transport [1.5.5.—] |
| ORF02081 | 4161 & 4162 | Ferredoxin-like protein ydiT |
| ORF02082 | 4163 & 4164 | substrate--CoA ligase, putative [6.2.1.—] |
| ORF02083 | 4165 & 4166 | phosphoenolpyruvate synthase (ppsA) [2.7.9.2] |
| ORF02084 | 4167 & 4168 | Hypothetical UPF0085 protein ydiA |

TABLE 1-continued

Annotation of ORF00001 to ORF04995

| ORFnnnnn | SEQ ID NOs | Annotation |
|---|---|---|
| ORF02085 | 4169 & 4170 | phospho-2-dehydro-3-deoxyheptonate aldolase [2.5.1.54] |
| ORF02086 | 4171 & 4172 | conserved hypothetical protein |
| ORF02087 | 4173 & 4174 | Hypothetical UPF0061 protein ydiU (AP001520) |
| ORF02088 | 4175 & 4176 | conserved hypothetical protein |
| ORF02089 | 4177 & 4178 | lipoprotein (ORF) |
| ORF02090 | 4179 & 4180 | Vitamin B12 transport ATP-binding protein btuD (VitaminB12-transporting ATPase) [3.6.3.33] |
| ORF02091 | 4181 & 4182 | Glutathione peroxidase |
| ORF02092 | 4183 & 4184 | Vitamin B12 transport system permease protein btuC (membrane) |
| ORF02093 | 4185 & 4186 | integration host factor, alpha subunit (ihfA) |
| ORF02094 | 4187 & 4188 | phenylalanyl-tRNA synthetase, beta subunit (pheT) [6.1.1.20] |
| ORF02095 | 4189 & 4190 | phenylalanyl-tRNA synthetase, alpha subunit (pheS) [6.1.1.20] |
| ORF02096 | 4191 & 4192 | ribosomal protein L20 (rplT) |
| ORF02097 | 4193 & 4194 | ribosomal protein L35 (rpmI) |
| ORF02098 | 4195 & 4196 | translation initiation factor IF-3 (infC) |
| ORF02099 | 4197 & 4198 | threonyl-tRNA synthetase (thrS) [6.1.1.3] |
| ORF02100 | 4199 & 4200 | InsAB' protein |
| ORF02101 | 4201 & 4202 | InsA protein |
| ORF02102 | 4203 & 4204 | hypothetical protein |
| ORF02103 | 4205 & 4206 | Protein of unknown function, DUF481 superfamily |
| ORF02104 | 4207 & 4208 | pfkB (pfkB) [2.7.1.11] |
| ORF02105 | 4209 & 4210 | conserved hypothetical protein |
| ORF02106 | 4211 & 4212 | Fructosamine kinase subfamily |
| ORF02107 | 4213 & 4214 | conserved hypothetical protein |
| ORF02108 | 4215 & 4216 | Protein yniC (YniC) [3.1.3.18] |
| ORF02109 | 4217 & 4218 | Predicted membrane-bound metal-dependent hydrolase (DUF457) family |
| ORF02110 | 4219 & 4220 | sodium:dicarboxylate symporter family protein |
| ORF02111 | 4221 & 4222 | Cell division activator cedA |
| ORF02112 | 4223 & 4224 | conserved hypothetical protein |
| ORF02113 | 4225 & 4226 | Catalase HPII (III) [1.11.1.6] |
| ORF02114 | 4227 & 4228 | unnamed protein product; ORF 28.5 |
| ORF02115 | 4229 & 4230 | 6-phospho-beta-glucosidase [3.2.1.86] |
| ORF02116 | 4231 & 4232 | Cel operon repressor |
| ORF02117 | 4233 & 4234 | PEP-dependent phosphotransferase enzyme III for cellobiose, arbutin, and salicin (PTS) [2.7.1.69] |
| ORF02118 | 4235 & 4236 | PTS system, cellobiose-specific IIC component (celB) |
| ORF02119 | 4237 & 4238 | PTS system, N,N'-diacetylchitobiose-specific IIB component (EIIB-Chb)(N,N'-diacetylchitobiose-permease IIB component) (Phosphotransferaseenzyme II, B component) [2.7.1.69] |
| ORF02120 | 4239 & 4240 | Osmotically inducible lipoprotein E precursor |
| ORF02121 | 4241 & 4242 | NAD+ synthetase (nadE) [6.3.1.5] |
| ORF02122 | 4243 & 4244 | Bacterial protein of unknown function (DUF886) superfamily |
| ORF02123 | 4245 & 4246 | excinuclease ABC subunit C homolog |
| ORF02124 | 4247 & 4248 | Spheroplast protein Y precursor |
| ORF02125 | 4249 & 4250 | conserved hypothetical protein |
| ORF02126 | 4251 & 4252 | Succinylglutamate desuccinylase [3.1.—.—] |
| ORF02127 | 4253 & 4254 | Succinylarginine dihydrolase (astB) |
| ORF02128 | 4255 & 4256 | Succinate semialdehyde dehydrogenase (EC 1.2.1.24) (NAD(+)-dependent succinic semialdehyde dehydrogenase). (retinol) [1.2.1.24] |
| ORF02129 | 4257 & 4258 | Arginine N-succinyltransferase beta subunit (astA) [2.3.1.109] |
| ORF02130 | 4259 & 4260 | Succinylornithine transaminase (Succinylornithineaminotransferase) (ACOAT) [2.6.1.—] |
| ORF02131 | 4261 & 4262 | exodeoxyribonuclease III (xth) [3.1.11.2] |
| ORF02132 | 4263 & 4264 | membrane protein, probable, putative |
| ORF02133 | 4265 & 4266 | conserved hypothetical protein |
| ORF02134 | 4267 & 4268 | DedA family family |
| ORF02135 | 4269 & 4270 | IS110 family transposase, truncation, putative |
| ORF02136 | 4271 & 4272 | Protein ynjB |
| ORF02137 | 4273 & 4274 | Hypothetical ABC transporter permease protein ynjC |
| ORF02138 | 4275 & 4276 | Inner membrane protein Malk (P-loop) |
| ORF02139 | 4277 & 4278 | 2.8.1.1 [2.8.1.1] |
| ORF02140 | 4279 & 4280 | phosphatidylglycerophosphate synthase |
| ORF02141 | 4281 & 4282 | Protein of unknown function (DUF1496) superfamily |
| ORF02142 | 4283 & 4284 | mutT2 [3.6.1.—] |
| ORF02143 | 4285 & 4286 | NADP-specific glutamate dehydrogenase (NADP-GDH) [1.4.1.4] |
| ORF02144 | 4287 & 4288 | DNA topoisomerase III |
| ORF02145 | 4289 & 4290 | selenide, water dikinase (selD) [2.7.9.3] |
| ORF02146 | 4291 & 4292 | Protein ydjA |
| ORF02147 | 4293 & 4294 | hypothetical protein |
| ORF02148 | 4295 & 4296 | signal peptide peptidase SppA, 67K type (sppA) [3.4.—.—] |
| ORF02149 | 4297 & 4298 | L-asparaginase (ansA) [3.5.1.1] |
| ORF02150 | 4299 & 4300 | Pyrazinamidase-nicotinamidase (PZASE) [3.5.1.—] |
| ORF02151 | 4301 & 4302 | putative transport protein |
| ORF02152 | 4303 & 4304 | similar to transcription regulator DeoR family |
| ORF02153 | 4305 & 4306 | aldo-keto reductase Atu3877 (gsp69) [1.—.—.—] |
| ORF02154 | 4307 & 4308 | putative kinase |

TABLE 1-continued

Annotation of ORF00001 to ORF04995

| ORFnnnnn | SEQ ID NOs | Annotation |
|---|---|---|
| ORF02155 | 4309 & 4310 | Fructose-tagatose bisphosphate aldolase [4.1.2.—] |
| ORF02156 | 4311 & 4312 | Sorbitol dehydrogenase (EC 1.1.1.14) (L-iditol 2-dehydrogenase). (sorbitol) [1.1.1.14] |
| ORF02157 | 4313 & 4314 | Membrane transporter D1. |
| ORF02158 | 4315 & 4316 | sorbitol dehydrogenase, putative [1.1.1.—] |
| ORF02159 | 4317 & 4318 | Protein of unknown function (DUF1315) superfamily |
| ORF02160 | 4319 & 4320 | methionine-R-sulfoxide reductase (msrB) [1.8.4.6] |
| ORF02161 | 4321 & 4322 | glyceraldehyde-3-phosphate dehydrogenase, type I (gap) [1.2.1.—] |
| ORF02162 | 4323 & 4324 | transglycolase (fragment) |
| ORF02163 | 4325 & 4326 | Morphine 6-dehydrogenase (EC 1.1.1.218) (Naloxone reductase). (PA0804) [1.1.1.—] |
| ORF02164 | 4327 & 4328 | MltA-interacting protein precursor |
| ORF02165 | 4329 & 4330 | hypothetical protein |
| ORF02166 | 4331 & 4332 | protein kinase |
| ORF02167 | 4333 & 4334 | Hypothetical UPF0229 protein yeaH |
| ORF02168 | 4335 & 4336 | GGDEF domain protein |
| ORF02169 | 4337 & 4338 | GGDEF domain protein |
| ORF02170 | 4339 & 4340 | unnamed protein product |
| ORF02171 | 4341 & 4342 | transcriptional regulator araC family |
| ORF02172 | 4343 & 4344 | Protein of unknown function (DUF441) superfamily |
| ORF02173 | 4345 & 4346 | cyanate MFS transporter (permease) |
| ORF02174 | 4347 & 4348 | Protein of unknown function, DUF488 superfamily |
| ORF02175 | 4349 & 4350 | hemolysin VCA0594 |
| ORF02176 | 4351 & 4352 | GGDEF domain protein |
| ORF02177 | 4353 & 4354 | hypothetical protein |
| ORF02178 | 4355 & 4356 | Transglycosylase associated protein |
| ORF02179 | 4357 & 4358 | conserved hypothetical protein |
| ORF02180 | 4359 & 4360 | tellurite resistance protein TehB, putative |
| ORF02181 | 4361 & 4362 | hypothetical protein |
| ORF02182 | 4363 & 4364 | translocator protein, LysE family superfamily |
| ORF02183 | 4365 & 4366 | conserved hypothetical protein |
| ORF02184 | 4367 & 4368 | tartrate dehydrogenase (3-IPM-DH) [1.1.1.93] |
| ORF02185 | 4369 & 4370 | ribonuclease D (rnd) [3.1.26.3] |
| ORF02186 | 4371 & 4372 | Long-chain-fatty-acid--CoA ligase |
| ORF02187 | 4373 & 4374 | outer membrane lipoprotein |
| ORF02188 | 4375 & 4376 | Hypothetical M22 peptidase homolog yeaZ [3.4.24.57] |
| ORF02189 | 4377 & 4378 | unnamed protein product |
| ORF02190 | 4379 & 4380 | Endoribonuclease L-PSP superfamily |
| ORF02191 | 4381 & 4382 | conserved hypothetical protein |
| ORF02192 | 4383 & 4384 | Hypothetical UPF0181 protein yoaH-related protein |
| ORF02193 | 4385 & 4386 | Para-aminobenzoate synthase component I [6.3.5.8] |
| ORF02194 | 4387 & 4388 | MutT-family protein |
| ORF02195 | 4389 & 4390 | L-serine ammonia-lyase (sdaA) [4.3.1.17] |
| ORF02196 | 4391 & 4392 | EAL domain protein |
| ORF02197 | 4393 & 4394 | possible CorC-HlyC family of Mg+2-Co+2-heavy metal efflux pumps |
| ORF02198 | 4395 & 4396 | PTS enzyme IIAB, mannose-specific (EIII-MAN) |
| ORF02199 | 4397 & 4398 | PTS system, mannose-specific IIC component |
| ORF02200 | 4399 & 4400 | PTS system, mannose-specific IID component |
| ORF02201 | 4401 & 4402 | Hypothetical UPF0266 protein yobD |
| ORF02202 | 4403 & 4404 | Domain of unknown function DUF family |
| ORF02203 | 4405 & 4406 | 23S rRNA m1G745 methyltransferase, putative [2.1.1.51] |
| ORF02204 | 4407 & 4408 | Cold shock-like protein cspE |
| ORF02205 | 4409 & 4410 | conserved hypothetical protein |
| ORF02206 | 4411 & 4412 | lipoprotein, putative |
| ORF02207 | 4413 & 4414 | conserved hypothetical protein |
| ORF02208 | 4415 & 4416 | Transcriptional regulator kdgR |
| ORF02209 | 4417 & 4418 | MULTIDRUG RESISTANCE PROTEIN B |
| ORF02210 | 4419 & 4420 | heat shock protein, integral membrane protein (htpX) [3.4.24.—] |
| ORF02211 | 4421 & 4422 | Tail-specific protease precursor [3.4.21.102] |
| ORF02212 | 4423 & 4424 | carboxy-terminal protease for penicillin-binding protein 3 |
| ORF02213 | 4425 & 4426 | ProP effector |
| ORF02214 | 4427 & 4428 | GAF domain protein |
| ORF02215 | 4429 & 4430 | PqiA protein |
| ORF02216 | 4431 & 4432 | PqiA protein |
| ORF02217 | 4433 & 4434 | mce related protein family |
| ORF02218 | 4435 & 4436 | Sun-nucleolar protein family protein |
| ORF02219 | 4437 & 4438 | Protein of unknown function (DUF1480) superfamily |
| ORF02220 | 4439 & 4440 | Protein of unknown function (DUF1482) family |
| ORF02221 | 4441 & 4442 | Serine-threonine protein phosphatase 1 |
| ORF02222 | 4443 & 4444 | conserved hypothetical protein |
| ORF02223 | 4445 & 4446 | unnamed protein product |
| ORF02224 | 4447 & 4448 | Copper resistance protein D family, putative |
| ORF02225 | 4449 & 4450 | Protein yobA precursor |
| ORF02226 | 4451 & 4452 | DNA polymerase III, theta subunit [2.7.7.7] |
| ORF02227 | 4453 & 4454 | hydrolase, carbon-nitrogen family family |
| ORF02228 | 4455 & 4456 | DNA polymerase III, alpha subunit, Gram-positive type, putative |
| ORF02229 | 4457 & 4458 | protease II (AB004795) [3.4.21.83] |

TABLE 1-continued

Annotation of ORF00001 to ORF04995

| ORFnnnnn | SEQ ID NOs | Annotation |
|---|---|---|
| ORF02230 | 4459 & 4460 | unidentified reading frame |
| ORF02231 | 4461 & 4462 | unnamed protein product; Similar to lipoprotein YebF precursor of *Escherichia coli* |
| ORF02232 | 4463 & 4464 | hypothetical protein |
| ORF02233 | 4465 & 4466 | DNA damage-inducible gene in SOS regulon, dependent on cyclic AMP and H-NS |
| ORF02234 | 4467 & 4468 | phosphoribosylglycinamide formyltransferase 2 (purT) [2.1.2.—] |
| ORF02235 | 4469 & 4470 | 2-deydro-3-deoxyphosphogluconate aldolase-4-hydroxy-2-oxoglutarate aldolase (eda) [4.1.3.16] |
| ORF02236 | 4471 & 4472 | phoshogluconate dehydratase (edd) [4.2.1.12] |
| ORF02237 | 4473 & 4474 | glucose-6-phosphate 1-dehydrogenase (zwf) [1.1.1.49] |
| ORF02238 | 4475 & 4476 | conserved hypothetical protein |
| ORF02239 | 4477 & 4478 | Hex regulon repressor |
| ORF02240 | 4479 & 4480 | pyruvate kinase (pyk) [2.7.1.40] |
| ORF02241 | 4481 & 4482 | lipid A biosynthesis (KDO)2-(lauroyl)-lipid IVA acyltransferase (msbB) [2.3.1.—] |
| ORF02242 | 4483 & 4484 | Cell envelope |
| ORF02243 | 4485 & 4486 | High-affinity zinc uptake system protein znuA precursor (AE005408) |
| ORF02244 | 4487 & 4488 | ABC superfamily high affinity Zn transport protein (atp_bind) |
| ORF02245 | 4489 & 4490 | High-affinity zinc uptake system membrane protein znuB (atp_bind) |
| ORF02246 | 4491 & 4492 | Holliday junction DNA helicase RuvB (ruvB) |
| ORF02247 | 4493 & 4494 | Holliday junction DNA helicase RuvA (ruvA) |
| ORF02248 | 4495 & 4496 | Protein of unknown function (DUF1105) superfamily |
| ORF02249 | 4497 & 4498 | crossover junction endodeoxyribonuclease RuvC (ruvC) [3.1.22.4] |
| ORF02250 | 4499 & 4500 | conserved hypothetical protein TIGR01033 |
| ORF02251 | 4501 & 4502 | dATP pyrophosphohydrolase |
| ORF02252 | 4503 & 4504 | aspartyl-tRNA synthetase (aspS) [6.1.1.12] |
| ORF02253 | 4505 & 4506 | Hypothetical isochorismatase family protein yecD |
| ORF02254 | 4507 & 4508 | Protein of unknown function superfamily |
| ORF02255 | 4509 & 4510 | conserved hypothetical protein |
| ORF02256 | 4511 & 4512 | methyltransferase, putative |
| ORF02257 | 4513 & 4514 | methyltransferase, putative |
| ORF02258 | 4515 & 4516 | Trimethylamine-N-oxide reductase 2 precursor |
| ORF02259 | 4517 & 4518 | Cytochrome c-type protein torY |
| ORF02260 | 4519 & 4520 | copper homeostasis protein VC0730 |
| ORF02261 | 4521 & 4522 | Protein yecM |
| ORF02262 | 4523 & 4524 | arginyl-tRNA synthetase (argS) [6.1.1.19] |
| ORF02263 | 4525 & 4526 | Flagellar protein flhE precursor |
| ORF02264 | 4527 & 4528 | flagellar biosynthesis protein FlhA (flhA) |
| ORF02265 | 4529 & 4530 | flagellar biosynthetic protein FlhB (flhB) |
| ORF02266 | 4531 & 4532 | conserved hypothetical protein |
| ORF02267 | 4533 & 4534 | Chemotaxis protein cheZ |
| ORF02268 | 4535 & 4536 | Chemotaxis protein cheY |
| ORF02269 | 4537 & 4538 | Chemotaxis response regulator protein-glutamate methylesterase(EC 3.1.1.61) [3.1.1.61] |
| ORF02270 | 4539 & 4540 | Chemotaxis protein methyltransferase [2.1.1.80] |
| ORF02271 | 4541 & 4542 | methyl-accepting chemotaxis protein IV, peptide sensor receptor |
| ORF02272 | 4543 & 4544 | conserved hypothetical protein |
| ORF02273 | 4545 & 4546 | Methyl-accepting chemotaxis protein II |
| ORF02274 | 4547 & 4548 | Chemotaxis protein cheW |
| ORF02275 | 4549 & 4550 | Chemotaxis protein cheA |
| ORF02276 | 4551 & 4552 | Chemotaxis motB protein |
| ORF02277 | 4553 & 4554 | Chemotaxis motA protein |
| ORF02278 | 4555 & 4556 | Flagellar transcriptional activator flhC |
| ORF02279 | 4557 & 4558 | regulator of flagellar biosynthesis, acting on class 2 operons; transcriptional initiation factor |
| ORF02280 | 4559 & 4560 | Universal stress protein C (UspA) |
| ORF02281 | 4561 & 4562 | alpha,alpha-trehalose-phosphate synthase [UDP-forming] (otsA) [2.4.1.15] |
| ORF02282 | 4563 & 4564 | trehalose-phosphatase (otsB) [3.1.3.12] |
| ORF02283 | 4565 & 4566 | L-arabinose transport system permease protein araH |
| ORF02284 | 4567 & 4568 | L-arabinose transport ATP-binding protein araG |
| ORF02285 | 4569 & 4570 | L-arabinose-binding periplasmic protein precursor (PBP) |
| ORF02286 | 4571 & 4572 | Ferritin-like protein 2 |
| ORF02287 | 4573 & 4574 | conserved hypothetical protein |
| ORF02288 | 4575 & 4576 | lipoprotein, putative |
| ORF02289 | 4577 & 4578 | conserved hypothetical protein |
| ORF02290 | 4579 & 4580 | cytoplasmic ferritin (an iron storage protein) |
| ORF02291 | 4581 & 4582 | conserved hypothetical protein |
| ORF02292 | 4583 & 4584 | Tyrosine-specific transport protein |
| ORF02293 | 4585 & 4586 | preprotein translocase, SecA subunit |
| ORF02294 | 4587 & 4588 | conserved hypothetical protein |
| ORF02295 | 4589 & 4590 | Fels-2 prophage: similar to retron in E |
| ORF02296 | 4591 & 4592 | ParA |
| ORF02297 | 4593 & 4594 | Sb32 |
| ORF02298 | 4595 & 4596 | hypothetical protein |
| ORF02299 | 4597 & 4598 | phage portal protein, PBSX family |
| ORF02300 | 4599 & 4600 | Putative ATPase subunit of terminase (gpP-like) |
| ORF02301 | 4601 & 4602 | Phage capsid scaffolding protein (GPO) |
| ORF02302 | 4603 & 4604 | phage major capsid protein, P2 family |

TABLE 1-continued

Annotation of ORF00001 to ORF04995

| ORFnnnnn | SEQ ID NOs | Annotation |
|---|---|---|
| ORF02303 | 4605 & 4606 | Phage small terminase subunit |
| ORF02304 | 4607 & 4608 | head completion-stabilization protein L |
| ORF02305 | 4609 & 4610 | Phage Tail Protein X |
| ORF02306 | 4611 & 4612 | Bbp2 |
| ORF02307 | 4613 & 4614 | conserved hypothetical protein |
| ORF02308 | 4615 & 4616 | phage tail completion protein R |
| ORF02309 | 4617 & 4618 | Fels-2 prophage: similar to gpS for completion |
| ORF02310 | 4619 & 4620 | baseplate assembly protein V (gpV) |
| ORF02311 | 4621 & 4622 | phage baseplate assembly protein W (gpW) |
| ORF02312 | 4623 & 4624 | Baseplate J-like protein |
| ORF02313 | 4625 & 4626 | gpI (gpI) |
| ORF02314 | 4627 & 4628 | gpH (gpH) |
| ORF02315 | 4629 & 4630 | gpU prime (gpG) |
| ORF02316 | 4631 & 4632 | CDP-diacylglycerol--glycerol-3-phosphate 3-phosphatidyltransferase (pgsA) [2.7.8.5] |
| ORF02317 | 4633 & 4634 | excinuclease ABC, C subunit (uvrC) |
| ORF02318 | 4635 & 4636 | response regulator protein |
| ORF02319 | 4637 & 4638 | conserved hypothetical protein |
| ORF02320 | 4639 & 4640 | Regulatory protein sdiA |
| ORF02321 | 4641 & 4642 | amino acid ABC transporter, ATP-binding protein |
| ORF02322 | 4643 & 4644 | amino acid ABC transporter, permease protein (permease) |
| ORF02323 | 4645 & 4646 | 4.4.1.15 [3.5.99.7] |
| ORF02324 | 4647 & 4648 | Cystine-binding periplasmic protein precursor |
| ORF02325 | 4649 & 4650 | FliZ protein |
| ORF02326 | 4651 & 4652 | transcription initiation factor alternative sigma factor 28 (Sigma) |
| ORF02327 | 4653 & 4654 | FliC |
| ORF02328 | 4655 & 4656 | Flagellar hook-associated protein 2 (HAP2) |
| ORF02329 | 4657 & 4658 | flagellar protein FliS (fliS) |
| ORF02330 | 4659 & 4660 | flagellar protein FliT |
| ORF02331 | 4661 & 4662 | Cytoplasmic alpha-amylase [3.2.1.1] |
| ORF02332 | 4663 & 4664 | Hypothetical lipoprotein yedD precursor |
| ORF02333 | 4665 & 4666 | YeeE-YedE family protein family |
| ORF02334 | 4667 & 4668 | Hypothetical UPF0033 protein yedF-related protein |
| ORF02335 | 4669 & 4670 | Uncharacterized ACR, COG2135 superfamily |
| ORF02336 | 4671 & 4672 | Outer membrane porin protein nmpC precursor |
| ORF02337 | 4673 & 4674 | Hypothetical transcriptional regulator ybcM |
| ORF02338 | 4675 & 4676 | conserved hypothetical protein |
| ORF02339 | 4677 & 4678 | EmrE protein |
| ORF02340 | 4679 & 4680 | flagellar hook-basal body complex protein (FliE) (fliE) |
| ORF02341 | 4681 & 4682 | flagellar M-ring protein FliF (fliF) |
| ORF02342 | 4683 & 4684 | flagellar motor switch protein FliG (fliG) |
| ORF02343 | 4685 & 4686 | Flagellar assembly protein FliH (fliH) |
| ORF02344 | 4687 & 4688 | flagellum-specific ATP synthase |
| ORF02345 | 4689 & 4690 | flagellar export protein FliJ (fliJ) |
| ORF02346 | 4691 & 4692 | flagellar hook-length control protein |
| ORF02347 | 4693 & 4694 | Flagellar basal body-associated protein FliL (fliL) |
| ORF02348 | 4695 & 4696 | flagellar motor switch protein FliM (fliM) |
| ORF02349 | 4697 & 4698 | Flagellar motor switch protein fliN |
| ORF02350 | 4699 & 4700 | Flagellar protein fliO |
| ORF02351 | 4701 & 4702 | Unknown protein encoded by cryptic prophage |
| ORF02352 | 4703 & 4704 | Helix-turn-helix domain protein |
| ORF02353 | 4705 & 4706 | stability determinant |
| ORF02354 | 4707 & 4708 | unknown protein encoded by prophage CP-933N-related protein |
| ORF02355 | 4709 & 4710 | Division inhibition protein dicB |
| ORF02356 | 4711 & 4712 | conserved hypothetical protein |
| ORF02357 | 4713 & 4714 | Exodeoxyribonuclease VIII (35 kD) [3.1.11.—] |
| ORF02358 | 4715 & 4716 | conserved hypothetical protein |
| ORF02359 | 4717 & 4718 | Sb28 (AE005423) |
| ORF02360 | 4719 & 4720 | Protein of unknown function (DUF980) superfamily |
| ORF02361 | 4721 & 4722 | hypothetical protein |
| ORF02362 | 4723 & 4724 | integrase |
| ORF02363 | 4725 & 4726 | trpE2 |
| ORF02364 | 4727 & 4728 | Putative cytoplasmic transmembrane protein |
| ORF02365 | 4729 & 4730 | ABC transporter, ATP-binding-permease protein, putative |
| ORF02366 | 4731 & 4732 | EF0101 |
| ORF02367 | 4733 & 4734 | hypothetical protein |
| ORF02368 | 4735 & 4736 | Putataive AraC type regulator |
| ORF02369 | 4737 & 4738 | dihydroaeruginoic acid synthetase |
| ORF02370 | 4739 & 4740 | yersiniabactin biosynthetic protein |
| ORF02371 | 4741 & 4742 | yersiniabactin biosynthetic protein YbtU |
| ORF02372 | 4743 & 4744 | yersiniabactin biosynthetic protein YbtT |
| ORF02373 | 4745 & 4746 | mbtA [6.2.1.—] |
| ORF02374 | 4747 & 4748 | OMR family pesticin-yersiniabactin receptor protein (IRPC) |
| ORF02375 | 4749 & 4750 | conserved hypothetical protein |
| ORF02376 | 4751 & 4752 | putative factor |
| ORF02377 | 4753 & 4754 | putative factor |

TABLE 1-continued

Annotation of ORF00001 to ORF04995

| ORFnnnnn | SEQ ID NOs | Annotation |
|---|---|---|
| ORF02378 | 4755 & 4756 | conserved hypothetical protein |
| ORF02379 | 4757 & 4758 | major facilitator family transporter (PPII) |
| ORF02380 | 4759 & 4760 | AMP nucleosidase (amn) [3.2.2.4] |
| ORF02381 | 4761 & 4762 | Domain of unknown function, putative |
| ORF02382 | 4763 & 4764 | MelD protein |
| ORF02383 | 4765 & 4766 | amidase family protein, putative |
| ORF02384 | 4767 & 4768 | MATE efflux family protein subfamily |
| ORF02385 | 4769 & 4770 | Putative peptide synthetase |
| ORF02386 | 4771 & 4772 | NosB (AF183408) |
| ORF02387 | 4773 & 4774 | fmtA-like protein, putative |
| ORF02388 | 4775 & 4776 | thioesterase |
| ORF02389 | 4777 & 4778 | Prophage P4 integrase |
| ORF02390 | 4779 & 4780 | hypothetical protein |
| ORF02391 | 4781 & 4782 | MATE efflux family protein subfamily |
| ORF02392 | 4783 & 4784 | TubD protein [6.3.2.—] |
| ORF02393 | 4785 & 4786 | BarG |
| ORF02394 | 4787 & 4788 | NosB |
| ORF02395 | 4789 & 4790 | AMP-binding enzyme domain protein |
| ORF02396 | 4791 & 4792 | [acyl-carrier-protein] S-malonyltransferase [2.3.1.39] |
| ORF02397 | 4793 & 4794 | Putative acyl-coa dehydrogenase |
| ORF02398 | 4795 & 4796 | acyl carrier protein |
| ORF02399 | 4797 & 4798 | 3-hydroxyacyl CoA dehydrogenase (BHBD) [1.1.1.157] |
| ORF02400 | 4799 & 4800 | JamP |
| ORF02401 | 4801 & 4802 | oxidoreductase, zinc-binding dehydrogenase family family |
| ORF02402 | 4803 & 4804 | possible DNA-binding response regulator |
| ORF02403 | 4805 & 4806 | EntD-Gsp-HetI-Sfp family protein [2.7.8.—] |
| ORF02404 | 4807 & 4808 | transposase |
| ORF02405 | 4809 & 4810 | ISSo2, transposase OrfB, truncation |
| ORF02406 | 4811 & 4812 | Protein erfK-srfK precursor |
| ORF02407 | 4813 & 4814 | Nicotinate-nucleotide--dimethylbenzimidazole phosphoribosyltransferase(EC 2.4.2.21) (NN:DBI PRT) (N(1)-alpha-phosphoribosyltransferase) [2.4.2.21] |
| ORF02408 | 4815 & 4816 | cobalamin 5'-phosphate synthase (cobS) [2.7.8.26] |
| ORF02409 | 4817 & 4818 | Cobalamin biosynthesis protein cobU [2.7.1.156] |
| ORF02410 | 4819 & 4820 | conserved hypothetical protein |
| ORF02411 | 4821 & 4822 | conserved hypothetical protein |
| ORF02412 | 4823 & 4824 | TonB dependent receptor, putative |
| ORF02413 | 4825 & 4826 | conserved hypothetical protein |
| ORF02414 | 4827 & 4828 | Z1204 protein |
| ORF02415 | 4829 & 4830 | conserved hypothetical protein |
| ORF02416 | 4831 & 4832 | glucosaminyltransferase |
| ORF02417 | 4833 & 4834 | Sugar phosphate nucleotydyl transferase |
| ORF02418 | 4835 & 4836 | conserved hypothetical protein |
| ORF02419 | 4837 & 4838 | host specificity protein J, truncation, putative |
| ORF02420 | 4839 & 4840 | host specificity protein (partial) |
| ORF02421 | 4841 & 4842 | host specificity protein (partial) |
| ORF02422 | 4843 & 4844 | Terminase small subunit (GP1) (fragment) |
| ORF02423 | 4845 & 4846 | conserved hypothetical protein |
| ORF02424 | 4847 & 4848 | Partial tonB-like membrane protein encoded within prophage |
| ORF02425 | 4849 & 4850 | hypothetical protein |
| ORF02426 | 4851 & 4852 | Bor protein homolog from lambdoid prophage DLP12 |
| ORF02427 | 4853 & 4854 | Bacteriophage lysis protein |
| ORF02428 | 4855 & 4856 | lipoprotein Rz1 precursor-related protein |
| ORF02429 | 4857 & 4858 | hypothetical protein |
| ORF02430 | 4859 & 4860 | Lysozyme (Lysis protein) (Muramidase) (Endolysin) (lysozyme) [3.2.1.17] |
| ORF02431 | 4861 & 4862 | lysis protein S.b1556 |
| ORF02432 | 4863 & 4864 | hypothetical protein |
| ORF02433 | 4865 & 4866 | Outer membrane porin protein nmpC precursor (lbc) |
| ORF02434 | 4867 & 4868 | Antitermination protein Q homolog from lambdoid prophage |
| ORF02435 | 4869 & 4870 | endodeoxyribonuclease RUS (Holliday junction resolvase) |
| ORF02436 | 4871 & 4872 | Protein ninE-related protein |
| ORF02437 | 4873 & 4874 | phage N-6-adenine-methyltransferase [2.1.1.72] |
| ORF02438 | 4875 & 4876 | Protein ninB |
| ORF02439 | 4877 & 4878 | replication protein P |
| ORF02440 | 4879 & 4880 | transposase |
| ORF02441 | 4881 & 4882 | ECs1339 |
| ORF02442 | 4883 & 4884 | ribokinase |
| ORF02443 | 4885 & 4886 | Protein of unknown function (DUF1355) superfamily |
| ORF02444 | 4887 & 4888 | membrane protein, putative |
| ORF02445 | 4889 & 4890 | puative phophotriesterase (PTE) [3.1.8.1] |
| ORF02446 | 4891 & 4892 | gamma-glutamyltranspeptidase |
| ORF02447 | 4893 & 4894 | gamma-glutamyltranspeptidase |
| ORF02448 | 4895 & 4896 | ST55 protein |
| ORF02449 | 4897 & 4898 | conserved hypothetical protein |
| ORF02450 | 4899 & 4900 | conserved hypothetical protein |
| ORF02451 | 4901 & 4902 | ISBma3, transposase, truncation |
| ORF02452 | 4903 & 4904 | Prophage CP4-57 regulatory protein (AlpA) family |

TABLE 1-continued

Annotation of ORF00001 to ORF04995

| ORFnnnnn | SEQ ID NOs | Annotation |
|---|---|---|
| ORF02453 | 4905 & 4906 | hypothetical protein |
| ORF02454 | 4907 & 4908 | conserved hypothetical protein |
| ORF02455 | 4909 & 4910 | hypothetical protein |
| ORF02456 | 4911 & 4912 | Insertion sequence ATP-binding protein |
| ORF02457 | 4913 & 4914 | Transposase |
| ORF02458 | 4915 & 4916 | conserved hypothetical protein |
| ORF02459 | 4917 & 4918 | ferric-enterobactin-transport protein (III) |
| ORF02460 | 4919 & 4920 | ABC transporter permease STY0802 (FecCD_family) |
| ORF02461 | 4921 & 4922 | Periplasmic binding protein (III) |
| ORF02462 | 4923 & 4924 | TonB dependent receptor |
| ORF02463 | 4925 & 4926 | YeeP protein |
| ORF02464 | 4927 & 4928 | conserved hypothetical protein |
| ORF02465 | 4929 & 4930 | conserved hypothetical protein |
| ORF02466 | 4931 & 4932 | conserved hypothetical protein |
| ORF02467 | 4933 & 4934 | Patatin-like phospholipase family |
| ORF02468 | 4935 & 4936 | conserved hypothetical protein |
| ORF02469 | 4937 & 4938 | conserved hypothetical protein |
| ORF02470 | 4939 & 4940 | conserved hypothetical protein |
| ORF02471 | 4941 & 4942 | Z1215 protein (o273) |
| ORF02472 | 4943 & 4944 | Antirestriction protein family |
| ORF02473 | 4945 & 4946 | YeeS protein (o160) |
| ORF02474 | 4947 & 4948 | Protein of unknown function (DUF987) superfamily |
| ORF02475 | 4949 & 4950 | YeeU protein |
| ORF02476 | 4951 & 4952 | L0007-like protein |
| ORF02477 | 4953 & 4954 | YeeW protein |
| ORF02478 | 4955 & 4956 | Protein of unknown function (DUF496) superfamily |
| ORF02479 | 4957 & 4958 | conserved hypothetical protein |
| ORF02480 | 4959 & 4960 | DNA gyrase inhibitory protein |
| ORF02481 | 4961 & 4962 | Penicillin-binding protein 6B precursor (PBP) |
| ORF02482 | 4963 & 4964 | penicillin binding protein 6b |
| ORF02483 | 4965 & 4966 | Exodeoxyribonuclease I |
| ORF02484 | 4967 & 4968 | amino acid permease |
| ORF02485 | 4969 & 4970 | transcriptional regulator, LysR family |
| ORF02486 | 4971 & 4972 | Protein yeeZ precursor |
| ORF02487 | 4973 & 4974 | addiction module toxin, Txe-YoeB family |
| ORF02488 | 4975 & 4976 | yefM protein |
| ORF02489 | 4977 & 4978 | ATP phosphoribosyltransferase (hisG) [2.4.2.17] |
| ORF02490 | 4979 & 4980 | histidinol dehydrogenase (hisD) [1.1.1.23] |
| ORF02491 | 4981 & 4982 | histidinol-phosphate aminotransferase (hisC) [2.6.1.9] |
| ORF02492 | 4983 & 4984 | Histidine biosynthesis bifunctional protein hisB |
| ORF02493 | 4985 & 4986 | Imidazole glycerol phosphate synthase subunit hisH (IGPsynthase glutamine amidotransferase subunit) (IGP synthase subunithisH) (ImGP synthase subunit hisH) (IGPS subunit hisH) [2.4.2.—] |
| ORF02494 | 4987 & 4988 | imidazole glycerol phosphate synthase, glutamine amidotransferase subunit (hisH) [2.4.2.—] |
| ORF02495 | 4989 & 4990 | phosphoribosylformimino-5-aminoimidazole carboxamide ribotide isomerase (hisA) [5.3.1.16] |
| ORF02496 | 4991 & 4992 | imidazoleglycerol phosphate synthase, cyclase subunit (hisF) |
| ORF02497 | 4993 & 4994 | Histidine biosynthesis bifunctional protein hislE [Includes: Phosphoribosyl-AMP cyclohydrolase (PRA-CH); Phosphoribosyl-ATP pyrophosphatase (EC 3.6.1.31) (PRA-PH)] (PRA-PH) [3.5.4.19] |
| ORF02498 | 4995 & 4996 | Chain length determinant protein |
| ORF02499 | 4997 & 4998 | UDP-glucose 6-dehydrogenase (UDPGDH) [1.1.1.22] |
| ORF02500 | 4999 & 5000 | 6-phosphogluconate dehydrogenase, decarboxylating (gnd) [1.1.1.44] |
| ORF02501 | 5001 & 5002 | WbnE [2.4.1.—] |
| ORF02502 | 5003 & 5004 | putative glycosyltransferase [2.4.1.—] |
| ORF02503 | 5005 & 5006 | glycosyl transferase CpsO |
| ORF02504 | 5007 & 5008 | rhamnosyl transferase Cps6bS |
| ORF02505 | 5009 & 5010 | O-antigen modification protein |
| ORF02506 | 5011 & 5012 | rfbX protein |
| ORF02507 | 5013 & 5014 | dTDP-4-dehydrorhamnose 3,5-epimerase (rfbC) [5.1.3.13] |
| ORF02508 | 5015 & 5016 | glucose-1-phosphate thymidylyltransferase (rfbA) [2.7.7.24] |
| ORF02509 | 5017 & 5018 | dTDP-4-dehydrorhamnose reductase (rfbD) [1.1.1.133] |
| ORF02510 | 5019 & 5020 | dTDP-glucose 4,6-dehydratase (rfbB) [4.2.1.46] |
| ORF02511 | 5021 & 5022 | regulatory protein GalF (galF) |
| ORF02512 | 5023 & 5024 | Colanic acid biosynthesis protein wcaM |
| ORF02513 | 5025 & 5026 | Amylovoran biosynthesis glycosyl transferase amsK [2.—.—.—] |
| ORF02514 | 5027 & 5028 | Colanic acid biosynthesis protein wcaK [2.—.—.—] |
| ORF02515 | 5029 & 5030 | Lipopolysaccharide biosynthesis protein wzxC |
| ORF02516 | 5031 & 5032 | glycosyl transferase (WcaJ) [2.7.—.—] |
| ORF02517 | 5033 & 5034 | Phosphomannomutase |
| ORF02518 | 5035 & 5036 | mannose-1-phosphate guanylyltransferase-mannose-6-phosphate isomerase |
| ORF02519 | 5037 & 5038 | lipopolysaccharide biosynthesis protein, putative |
| ORF02520 | 5039 & 5040 | GDP-mannose mannosyl hydrolase [3.6.1.—] |
| ORF02521 | 5041 & 5042 | GDP-fucose synthetase chain A (GER1) [1.1.1.271] |
| ORF02522 | 5043 & 5044 | GDP-mannose 4,6-dehydratase (gmd) [4.2.1.47] |

TABLE 1-continued

Annotation of ORF00001 to ORF04995

| ORFnnnnn | SEQ ID NOs Annotation |
|---|---|
| ORF02523 | 5045 & 5046 acetyltransferase, CysE-LacA-LpxA-NodL family, putative [2.3.1.—] |
| ORF02524 | 5047 & 5048 glycosyl transferase, group 2 family protein, putative |
| ORF02525 | 5049 & 5050 Putative colanic acid polymerase |
| ORF02526 | 5051 & 5052 possible glycosyl transferase |
| ORF02527 | 5053 & 5054 serine acetyltransferase [2.3.1.—] |
| ORF02528 | 5055 & 5056 possible glycosyl transferase |
| ORF02529 | 5057 & 5058 Tyrosine-protein kinase wzc |
| ORF02530 | 5059 & 5060 Low molecular weight protein-tyrosine-phosphatase wzb [3.1.3.48] |
| ORF02531 | 5061 & 5062 membrane protein |
| ORF02532 | 5063 & 5064 putative transport protein |
| ORF02533 | 5065 & 5066 unnamed protein product |
| ORF02534 | 5067 & 5068 PHIKZ114 |
| ORF02535 | 5069 & 5070 Protein asmA precursor |
| ORF02536 | 5071 & 5072 deoxycytidine triphosphate deaminase (dcd) [3.5.4.13] |
| ORF02537 | 5073 & 5074 uridine kinase (udk) [2.7.1.48] |
| ORF02538 | 5075 & 5076 MASE1 domain family |
| ORF02539 | 5077 & 5078 Ada regulatory protein, putative [3.2.2.21] |
| ORF02540 | 5079 & 5080 hypothetical protein |
| ORF02541 | 5081 & 5082 Molecular chaperone |
| ORF02542 | 5083 & 5084 conserved hypothetical protein |
| ORF02543 | 5085 & 5086 conserved hypothetical protein |
| ORF02544 | 5087 & 5088 von Willebrand factor type A domain protein |
| ORF02545 | 5089 & 5090 putative membrane protein |
| ORF02546 | 5091 & 5092 AcrB-AcrD-AcrF (HAE1) |
| ORF02547 | 5093 & 5094 AcrB-AcrD-AcrF family membrane protein |
| ORF02548 | 5095 & 5096 MFS superfamily drug efflux pump |
| ORF02549 | 5097 & 5098 sensor histidine kinase SrrB, putative [2.7.3.—] |
| ORF02550 | 5099 & 5100 Transcriptional regulatory protein baeR (ResD) |
| ORF02551 | 5101 & 5102 Domain of unknown function (DUF1508) family |
| ORF02552 | 5103 & 5104 conserved hypothetical protein |
| ORF02553 | 5105 & 5106 conserved hypothetical protein |
| ORF02554 | 5107 & 5108 conserved hypothetical protein |
| ORF02555 | 5109 & 5110 conserved hypothetical protein |
| ORF02556 | 5111 & 5112 YegQ [3.4.—.—] |
| ORF02557 | 5113 & 5114 conserved hypothetical protein TIGR00147 |
| ORF02558 | 5115 & 5116 Galactitol utilization operon repressor (fragment) |
| ORF02559 | 5117 & 5118 hexitol dehydrogenase [1.1.1.251] |
| ORF02560 | 5119 & 5120 PTS system, sorbitol-specific IIC component (EIIC-GAT) |
| ORF02561 | 5121 & 5122 PTS system, galactitol-specific IIB component (EIIB-Gat) (Galacticol-permease IIB component) (Phosphotransferase enzyme II, B component)(EC 2.7.1.69) [2.7.1.69] |
| ORF02562 | 5123 & 5124 PTS system, galactitol-specific IIA component (EIIA-Gat) (Galacticol-permease IIA component) (Phosphotransferase enzyme II, A component)(EC 2.7.1.69) (EIIA-GAT) [2.7.1.69] |
| ORF02563 | 5125 & 5126 PUTATIVE TAGATOSE 6-PHOSPHATE KINASE PROTEIN [2.7.1.144] |
| ORF02564 | 5127 & 5128 class II aldolase, tagatose bisphosphate family [4.1.2.—] |
| ORF02565 | 5129 & 5130 dehydrin [4.1.2.13] |
| ORF02566 | 5131 & 5132 nucleoside permease NupG, putative |
| ORF02567 | 5133 & 5134 ADP-ribosylglycohydrolase, putative |
| ORF02568 | 5135 & 5136 transcriptional regulator, GntR family, putative |
| ORF02569 | 5137 & 5138 Ribokinase (EC 2.7.1.15). [2.7.1.15] |
| ORF02570 | 5139 & 5140 glycosyl hydrolase, family 25 [3.2.1.17] |
| ORF02571 | 5141 & 5142 phosphomethylpyrimidine kinase (thiD) [2.7.4.7] |
| ORF02572 | 5143 & 5144 hydroxyethylthiazole kinase (thiM) [2.7.1.50] |
| ORF02573 | 5145 & 5146 Uncharacterized BCR, COG1937 family |
| ORF02574 | 5147 & 5148 NirC |
| ORF02575 | 5149 & 5150 conserved hypothetical protein |
| ORF02576 | 5151 & 5152 conserved hypothetical protein |
| ORF02577 | 5153 & 5154 Hypothetical outer membrane usher protein yehB precursor |
| ORF02578 | 5155 & 5156 Hypothetical fimbrial chaperone yehC precursor |
| ORF02579 | 5157 & 5158 Fimbrial protein subfamily |
| ORF02580 | 5159 & 5160 Mrp protein (mrp) |
| ORF02581 | 5161 & 5162 Methionyl-tRNA synthetase (metG) [6.1.1.10] |
| ORF02582 | 5163 & 5164 molybdate metabolism regulator, second fragment 2 (fragment) |
| ORF02583 | 5165 & 5166 yehI (fragment) |
| ORF02584 | 5167 & 5168 yehI (fragment) |
| ORF02585 | 5169 & 5170 conserved hypothetical protein |
| ORF02586 | 5171 & 5172 conserved hypothetical protein |
| ORF02587 | 5173 & 5174 VWA domain containing CoxE-like protein family |
| ORF02588 | 5175 & 5176 yehQ gene product |
| ORF02589 | 5177 & 5178 Hypothetical lipoprotein yehR precursor |
| ORF02590 | 5179 & 5180 uncharacterized protein conserved in bacteria |
| ORF02591 | 5181 & 5182 unnamed protein product |
| ORF02592 | 5183 & 5184 putative 2-component sensor protein |
| ORF02593 | 5185 & 5186 MerR-like regulator A |
| ORF02594 | 5187 & 5188 glycine betaine-l-proline transport system permease protein prow (AE005444) |
| ORF02595 | 5189 & 5190 putative membrane protein |

TABLE 1-continued

Annotation of ORF00001 to ORF04995

| ORFnnnnn | SEQ ID NOs | Annotation |
|---|---|---|
| ORF02596 | 5191 & 5192 | amino acid ABC transporter, ATP-binding protein (AE005444) |
| ORF02597 | 5193 & 5194 | ABC transporter, permease protein (AE005444) |
| ORF02598 | 5195 & 5196 | glycine betaine-L-proline ABC transporter, periplasmic substrate-binding protein, putative |
| ORF02599 | 5197 & 5198 | yohA (STI) [3.2.1.21] |
| ORF02600 | 5199 & 5200 | D-lactate dehydrogenase |
| ORF02601 | 5201 & 5202 | beta-lactamase |
| ORF02602 | 5203 & 5204 | Protein of unknown function (DUF1282) superfamily |
| ORF02603 | 5205 & 5206 | DedA family protein |
| ORF02604 | 5207 & 5208 | yohF [1.—.—.—] |
| ORF02605 | 5209 & 5210 | Putative channel-filament proteins |
| ORF02606 | 5211 & 5212 | Dihydrouridine synthase (Dus) superfamily |
| ORF02607 | 5213 & 5214 | LrgA family subfamily, putative |
| ORF02608 | 5215 & 5216 | membrane protein, putative |
| ORF02609 | 5217 & 5218 | cytidine deaminase (cdd) [3.5.4.5] |
| ORF02610 | 5219 & 5220 | SanA protein |
| ORF02611 | 5221 & 5222 | conserved hypothetical protein |
| ORF02612 | 5223 & 5224 | glutamate synthase, small subunit (NADPH) |
| ORF02613 | 5225 & 5226 | dihydroorotase dehydrogenase (pyrD) |
| ORF02614 | 5227 & 5228 | conserved hypothetical protein |
| ORF02615 | 5229 & 5230 | ribose ABC transporter, permease protein (membrane) |
| ORF02616 | 5231 & 5232 | Galactoside transport ATP-binding protein mglA (atp_bind) |
| ORF02617 | 5233 & 5234 | D-galactose-binding periplasmic protein precursor (GBP) (D-galactose-D-glucose binding protein) (GGBP) |
| ORF02618 | 5235 & 5236 | Mgl repressor and galactose ultrainduction factor |
| ORF02619 | 5237 & 5238 | unnamed protein product |
| ORF02620 | 5239 & 5240 | conserved hypothetical protein |
| ORF02621 | 5241 & 5242 | GTP cyclohydrolase I (folE) [3.5.4.16] |
| ORF02622 | 5243 & 5244 | carboxylesterase [3.1.1.—] |
| ORF02623 | 5245 & 5246 | Colicin I receptor precursor |
| ORF02624 | 5247 & 5248 | lysine-specific permease |
| ORF02625 | 5249 & 5250 | transcriptional regulator, LysR family |
| ORF02626 | 5251 & 5252 | membrane protein, putative |
| ORF02627 | 5253 & 5254 | Endonuclease IV (Endodeoxyribonuclease IV) [3.1.21.2] |
| ORF02628 | 5255 & 5256 | yeiI |
| ORF02629 | 5257 & 5258 | inosine-uridine preferring nucleoside hydrolase (AL355920) |
| ORF02630 | 5259 & 5260 | Regulatory protein nsr |
| ORF02631 | 5261 & 5262 | nucleoside transporter |
| ORF02632 | 5263 & 5264 | uncharacterized enzyme involved in pigment biosynthesis |
| ORF02633 | 5265 & 5266 | yeiI |
| ORF02634 | 5267 & 5268 | PTS system, fructose-specific IIBC component [2.7.1.69] |
| ORF02635 | 5269 & 5270 | 1-phosphofructokinase (Fructose 1-phosphate kinase) (fruK) [2.7.1.56] |
| ORF02636 | 5271 & 5272 | PTS system, fructose-specific IIA-FPr component (EIIA-Fru) (Fructose-permease IIA-FPr component) (Phosphotransferase enzyme II, A-FPrcomponent) (Phosphotransferase FPr protein) (Pseudo-HPr)(EIII-Fru) (Fructose PTS diphosphoryl transfer protein) (EIII-FRU) [2.7.1.69] |
| ORF02637 | 5273 & 5274 | conserved hypothetical protein |
| ORF02638 | 5275 & 5276 | Sugar efflux transporter B (orf104) |
| ORF02639 | 5277 & 5278 | translation elongation factor EF-P (EF-P) |
| ORF02640 | 5279 & 5280 | D-MANNONATE OXIDOREDUCTASE |
| ORF02641 | 5281 & 5282 | CobW-P47K family protein domain protein |
| ORF02642 | 5283 & 5284 | PAP2 superfamily domain protein |
| ORF02643 | 5285 & 5286 | Lipoprotein spr precursor (spr) |
| ORF02644 | 5287 & 5288 | Rtn protein |
| ORF02645 | 5289 & 5290 | ABC transporter substrate-binding protein |
| ORF02646 | 5291 & 5292 | peptide ABC transporter, permease protein |
| ORF02647 | 5293 & 5294 | ABC transporter, permease protein |
| ORF02648 | 5295 & 5296 | ABC transporter, nucleotide binding-ATPase protein [peptide] |
| ORF02649 | 5297 & 5298 | unnamed protein product |
| ORF02650 | 5299 & 5300 | bicyclomycin resistance protein |
| ORF02651 | 5301 & 5302 | ribosomal small subunit pseudouridine synthase A |
| ORF02652 | 5303 & 5304 | yejH |
| ORF02653 | 5305 & 5306 | 50S ribosomal protein L25 |
| ORF02654 | 5307 & 5308 | nucleoid-associated protein |
| ORF02655 | 5309 & 5310 | hypothetical protein |
| ORF02656 | 5311 & 5312 | Protein of unknown function (DUF1414) superfamily |
| ORF02657 | 5313 & 5314 | Predicted hydrolase of alkaline phosphatase superfamily |
| ORF02658 | 5315 & 5316 | yejO |
| ORF02659 | 5317 & 5318 | Nitrate-nitrite response regulator protein narP |
| ORF02660 | 5319 & 5320 | Cytochrome c-type biogenesis protein ccmH precursor (nrfF) |
| ORF02661 | 5321 & 5322 | Thiol:disulfide interchange protein dsbE (Cytochrome c biogenesisprotein ccmG) (dsbE) |
| ORF02662 | 5323 & 5324 | cytochrome c-type biogenesis protein CcmF (ccmF) |
| ORF02663 | 5325 & 5326 | Cytochrome c-type biogenesis protein ccmE |
| ORF02664 | 5327 & 5328 | Heme exporter protein D (Cytochrome c-type biogenesis protein ccmD)-related protein |

TABLE 1-continued

Annotation of ORF00001 to ORF04995

| ORFnnnnn | SEQ ID NOs | Annotation |
|---|---|---|
| ORF02665 | 5329 & 5330 | heme exporter protein C |
| ORF02666 | 5331 & 5332 | heme exporter protein CcmB (ccmB) |
| ORF02667 | 5333 & 5334 | heme exporter protein CcmA (ccmA) |
| ORF02668 | 5335 & 5336 | Cytochrome c-type protein napC |
| ORF02669 | 5337 & 5338 | periplasmic nitrate reductase, diheme cytochrome c subunit (napB) |
| ORF02670 | 5339 & 5340 | Ferredoxin-type protein napH (napH) |
| ORF02671 | 5341 & 5342 | Ferredoxin-type protein napG (napG) |
| ORF02672 | 5343 & 5344 | periplasmic nitrate reductase, large subunit (napA) [1.7.99.4] |
| ORF02673 | 5345 & 5346 | NapD protein (napD) |
| ORF02674 | 5347 & 5348 | ferredoxin-type protein NapF (napF) |
| ORF02675 | 5349 & 5350 | Ecotin |
| ORF02676 | 5351 & 5352 | malate:quinone-oxidoreductase (mqo) [1.1.99.16] |
| ORF02677 | 5353 & 5354 | hypothetical protein |
| ORF02678 | 5355 & 5356 | MdlB protein |
| ORF02679 | 5357 & 5358 | Alkylated DNA repair protein alkB (alkB) |
| ORF02680 | 5359 & 5360 | O6-methylguanine-DNA methyltransferase; transcription activator-repressor [2.1.1.63] |
| ORF02681 | 5361 & 5362 | thiamine biosynthesis lipoprotein ApbE, putative |
| ORF02682 | 5363 & 5364 | Outer membrane protein C precursor (Porin ompC) (Outer membraneprotein 1B) (Ibc) |
| ORF02683 | 5365 & 5366 | YojQ [2.7.3.—] |
| ORF02684 | 5367 & 5368 | positive response regulator for colanic capsule biosynthesis |
| ORF02685 | 5369 & 5370 | Sensor protein rcsC |
| ORF02686 | 5371 & 5372 | Sensor protein atoS |
| ORF02687 | 5373 & 5374 | Acetoacetate metabolism Regulatory protein atoC (atoC) |
| ORF02688 | 5375 & 5376 | Acetate CoA-transferase alpha subunit [2.8.3.8] |
| ORF02689 | 5377 & 5378 | Acetate CoA-transferase beta subunit (atoA) [2.8.3.8] |
| ORF02690 | 5379 & 5380 | membrane protein, putative |
| ORF02691 | 5381 & 5382 | Acetyl-CoA acetyltransferase (atoB) [2.3.1.9] |
| ORF02692 | 5383 & 5384 | conserved hypothetical protein |
| ORF02693 | 5385 & 5386 | conserved hypothetical protein |
| ORF02694 | 5387 & 5388 | Alpha-2-macroglobulin family N-terminal region family |
| ORF02695 | 5389 & 5390 | Protein of unknown function (DUF1175) superfamily |
| ORF02696 | 5391 & 5392 | conserved hypothetical protein |
| ORF02697 | 5393 & 5394 | DNA gyrase, A subunit (gyrA) [5.99.1.3] |
| ORF02698 | 5395 & 5396 | ubiquinone biosynthesis O-methyltransferase (ubiG) [2.1.1.—] |
| ORF02699 | 5397 & 5398 | similar to [SwissProt Accession Number P45508] |
| ORF02700 | 5399 & 5400 | ribonucleoside diphosphate reductase 1, alpha subunit, B1 (nrdA) [1.17.4.1] |
| ORF02701 | 5401 & 5402 | ribonucleoside diphosphage reductase 1, beta subunit, B2 |
| ORF02702 | 5403 & 5404 | adrenodoxin family ferredoxin |
| ORF02703 | 5405 & 5406 | Protein inaA |
| ORF02704 | 5407 & 5408 | glycerophosphodiester phosphodiesterase, periplasmic |
| ORF02705 | 5409 & 5410 | glycerol-3-phosphate transporter (glpT) |
| ORF02706 | 5411 & 5412 | glpD2, putative [1.1.99.5] |
| ORF02707 | 5413 & 5414 | Anaerobic glycerol-3-phosphate dehydrogenase subunit B |
| ORF02708 | 5415 & 5416 | Anaerobic glycerol-3-phosphate dehydrogenase subunit C [1.1.99.5] |
| ORF02709 | 5417 & 5418 | conserved hypothetical protein |
| ORF02710 | 5419 & 5420 | transposase |
| ORF02711 | 5421 & 5422 | transposase |
| ORF02712 | 5423 & 5424 | similar to [SwissProt Accession Number P23522] |
| ORF02713 | 5425 & 5426 | major facilitator family transporter |
| ORF02714 | 5427 & 5428 | Mandelate racemase - muconate lactonizing enzyme, C-terminal domain protein |
| ORF02715 | 5429 & 5430 | transcriptional regulator, IclR family, putative |
| ORF02716 | 5431 & 5432 | CinA-like protein |
| ORF02717 | 5433 & 5434 | YfaZ precursor superfamily |
| ORF02718 | 5435 & 5436 | hydrolase, NUDIX family, putative |
| ORF02719 | 5437 & 5438 | protein induced by aluminum |
| ORF02720 | 5439 & 5440 | lipopolysaccharide biosynthesis protein |
| ORF02721 | 5441 & 5442 | Glycosyl transferase arnC (Ara4N transferase) (Polymixinresistance protein pmrF) [2.—.—.—] |
| ORF02722 | 5443 & 5444 | Formyl transferase, C-terminal domain protein |
| ORF02723 | 5445 & 5446 | PbgP4 protein |
| ORF02724 | 5447 & 5448 | melittin resistance protein PqaB |
| ORF02725 | 5449 & 5450 | sucrose-6 phosphate hydrolase |
| ORF02726 | 5451 & 5452 | conserved hypothetical protein |
| ORF02727 | 5453 & 5454 | Polymyxin B resistance protein pmrD |
| ORF02728 | 5455 & 5456 | O-succinylbenzoate-CoA ligase (menE) [6.2.1.26] |
| ORF02729 | 5457 & 5458 | o-succinylbenzoic acid (OSB) synthetase (menC) [4.2.1.—] |
| ORF02730 | 5459 & 5460 | naphthoate synthase (menB) [4.1.3.36] |
| ORF02731 | 5461 & 5462 | hydrolase, alpha-beta hydrolase fold family, putative |
| ORF02732 | 5463 & 5464 | 2-succinyl-6-hydroxy-2,4-cyclohexadiene-1-carboxylic acid synthase-2-oxoglutarate decarboxylase (menD) [4.1.1.71] |
| ORF02733 | 5465 & 5466 | Menaquinone-specific isochorismate synthase |
| ORF02734 | 5467 & 5468 | ElaB protein |
| ORF02735 | 5469 & 5470 | elaA protein VC2565 (putative) |
| ORF02736 | 5471 & 5472 | metallo-beta-lactamase superfamily protein [3.1.26.11] |

TABLE 1-continued

Annotation of ORF00001 to ORF04995

| ORFnnnnn | SEQ ID NOs | Annotation |
|---|---|---|
| ORF02737 | 5473 & 5474 | von Willebrand factor type A domain protein |
| ORF02738 | 5475 & 5476 | putative aminopeptidase |
| ORF02739 | 5477 & 5478 | conserved hypothetical protein |
| ORF02740 | 5479 & 5480 | NADH dehydrogenase I chain N (NUO14) [1.6.99.5] |
| ORF02741 | 5481 & 5482 | NADH dehydrogenase I chain M (NUO13) [1.6.99.5] |
| ORF02742 | 5483 & 5484 | NADH dehydrogenase I chain L ECs3162 (NUO12) [1.6.99.5] |
| ORF02743 | 5485 & 5486 | NADH dehydrogenase I chain L ECs3162 (NUO12) [1.6.99.5] |
| ORF02744 | 5487 & 5488 | NADH dehydrogenase I, K subunit (NUO11) [1.6.5.3] |
| ORF02745 | 5489 & 5490 | NADH-quinone oxidoreductase chain J (NADH dehydrogenaseI, chain J) (NDH-1, chain J) (NUO10) [1.6.99.5] |
| ORF02746 | 5491 & 5492 | NADH DEHYDROGENASE I CHAIN I (EC 1.6.5.3) (NADH-UBIQUINONE OXIDOREDUCTASE CHAIN 9) (NUO9) [1.6.5.3] |
| ORF02747 | 5493 & 5494 | NADH dehydrogenase I chain H (NUO8) [1.6.99.5] |
| ORF02748 | 5495 & 5496 | NADH DEHYDROGENASE I CHAIN G (EC 1.6.5.3) (NADH-UBIQUINONE OXIDOREDUCTASE CHAIN 7) (NUO7) (FRAGMENT) [1.6.5.3] |
| ORF02749 | 5497 & 5498 | NADH-quinone oxidoreductase, F subunit (nuoF) |
| ORF02750 | 5499 & 5500 | NADH-quinone oxidoreductase chain E (NADH dehydrogenaseI, chain E) (NDH-1, chain E) (NUO5) [1.6.99.5] |
| ORF02751 | 5501 & 5502 | NADH dehydrogenase I chain C-D (NUO4) [1.6.99.5] |
| ORF02752 | 5503 & 5504 | NADH-quinone oxidoreductase chain B (NADH dehydrogenaseI, chain B) (NDH-1, chain B) (NUO2) (NUO2) [1.6.99.5] |
| ORF02753 | 5505 & 5506 | NADH-quinone oxidoreductase chain A (NADH dehydrogenaseI, chain A) (NDH-1, chain A) (NUO1) [1.6.99.5] |
| ORF02754 | 5507 & 5508 | LysR family NADH dehydrogenase transcriptional regulator (RssB) |
| ORF02755 | 5509 & 5510 | hypothetical protein |
| ORF02756 | 5511 & 5512 | aminotransferase, classes I and II (ASPAT) [2.6.1.—] |
| ORF02757 | 5513 & 5514 | b2291 |
| ORF02758 | 5515 & 5516 | unnamed protein product |
| ORF02759 | 5517 & 5518 | hydrolase, haloacid dehalogenase-like family [3.1.3.—] |
| ORF02760 | 5519 & 5520 | Protein yfbU |
| ORF02761 | 5521 & 5522 | Hypothetical UPF0208 protein yfbV |
| ORF02762 | 5523 & 5524 | acetate kinase (ackA) [2.7.2.1] |
| ORF02763 | 5525 & 5526 | Phosphate acetyltransferase |
| ORF02764 | 5527 & 5528 | predicted membrane protein |
| ORF02765 | 5529 & 5530 | IPP isomerase type 1 family protein, putative [3.6.—.—] |
| ORF02766 | 5531 & 5532 | phosphoesterase, putative subfamily |
| ORF02767 | 5533 & 5534 | Glutathione S-transferase, N-terminal domain protein |
| ORF02768 | 5535 & 5536 | glutathione S-transferase, putative |
| ORF02769 | 5537 & 5538 | dihydroneopterin aldolase (folB) [4.1.2.25] |
| ORF02770 | 5539 & 5540 | conserved hypothetical protein TIGR01777 |
| ORF02771 | 5541 & 5542 | conserved hypothetical protein subfamily |
| ORF02772 | 5543 & 5544 | ATP-binding component of histidine transport ECs3190 |
| ORF02773 | 5545 & 5546 | histidine transport system membrane protein M (membrane) |
| ORF02774 | 5547 & 5548 | amino acid ABC transporter, permease protein |
| ORF02775 | 5549 & 5550 | Histidine-binding periplasmic protein precursor (HBP) |
| ORF02776 | 5551 & 5552 | Lysine-arginine-ornithine-binding periplasmic protein precursor (LAO-binding protein) |
| ORF02777 | 5553 & 5554 | 3-octaprenyl-4-hydroxybenzoate carboxy-lyase (Polyprenylp-hydroxybenzoate decarboxylase) [4.1.1.—] |
| ORF02778 | 5555 & 5556 | amidophosphoribosyltransferase (purF) [2.4.2.14] |
| ORF02779 | 5557 & 5558 | CvpA family protein (cvpA) |
| ORF02780 | 5559 & 5560 | DedD protein |
| ORF02781 | 5561 & 5562 | FolC bifunctional protein [6.3.2.17] |
| ORF02782 | 5563 & 5564 | acetyl-CoA carboxylase, carboxyl transferase, beta subunit (accD) [6.4.1.2] |
| ORF02783 | 5565 & 5566 | DedA protein |
| ORF02784 | 5567 & 5568 | tRNA pseudouridine synthase A (truA) [4.2.1.70] |
| ORF02785 | 5569 & 5570 | USG-1 protein [1.2.1.—] |
| ORF02786 | 5571 & 5572 | Erythronate-4-phosphate dehydrogenase [1.1.1.—] |
| ORF02787 | 5573 & 5574 | hypothetical protein |
| ORF02788 | 5575 & 5576 | Int |
| ORF02789 | 5577 & 5578 | Regulatory protein cox |
| ORF02790 | 5579 & 5580 | hypothetical protein |
| ORF02791 | 5581 & 5582 | unknown protein encoded by prophage CP-933T |
| ORF02792 | 5583 & 5584 | unknown protein encoded by prophage CP-933T |
| ORF02793 | 5585 & 5586 | unknown protein encoded by prophage CP-933T |
| ORF02794 | 5587 & 5588 | hypothetical protein |
| ORF02795 | 5589 & 5590 | conserved hypothetical protein |
| ORF02796 | 5591 & 5592 | unknown protein encoded by prophage CP-933T |
| ORF02797 | 5593 & 5594 | unknown protein encoded by prophage CP-933T-related protein |
| ORF02798 | 5595 & 5596 | conserved hypothetical protein |
| ORF02799 | 5597 & 5598 | Fels-2 prophage protein |
| ORF02800 | 5599 & 5600 | gpH |
| ORF02801 | 5601 & 5602 | gpU (gpG) |
| ORF02802 | 5603 & 5604 | gpU prime (gpG) |
| ORF02803 | 5605 & 5606 | DNA-invertase (pin) |
| ORF02804 | 5607 & 5608 | Fels-2 prophage protein (gpU) |

TABLE 1-continued

Annotation of ORF00001 to ORF04995

| ORFnnnnn | SEQ ID NOs | Annotation |
|---|---|---|
| ORF02805 | 5609 & 5610 | phage tail tape measure protein, TP901 family, putative |
| ORF02806 | 5611 & 5612 | probable phage tail protein-related protein |
| ORF02807 | 5613 & 5614 | probable tail protein (gpE) |
| ORF02808 | 5615 & 5616 | phage major tail tube protein |
| ORF02809 | 5617 & 5618 | Phage tail sheath protein |
| ORF02810 | 5619 & 5620 | hypothetical protein |
| ORF02811 | 5621 & 5622 | bacteriophage late gene control protein D |
| ORF02812 | 5623 & 5624 | hypothetical protein |
| ORF02813 | 5625 & 5626 | Phage transcriptional activator, Ogr-Delta |
| ORF02814 | 5627 & 5628 | conserved hypothetical protein |
| ORF02815 | 5629 & 5630 | hypothetical protein |
| ORF02816 | 5631 & 5632 | hypothetical protein |
| ORF02817 | 5633 & 5634 | DIV protein (FRAGMENT) |
| ORF02818 | 5635 & 5636 | Hypothetical UPF0226 protein yfcJ |
| ORF02819 | 5637 & 5638 | 3-oxoacyl-[acyl-carrier-protein] synthase I (Beta-ketoacyl-ACP synthase I) (KAS I) [2.3.1.41] |
| ORF02820 | 5639 & 5640 | Glycine-D-amino acid oxidases (deaminating) |
| ORF02821 | 5641 & 5642 | conserved hypothetical protein |
| ORF02822 | 5643 & 5644 | similar to [SwissProt Accession Number P44255] |
| ORF02823 | 5645 & 5646 | predicted permease (ORF9) |
| ORF02824 | 5647 & 5648 | Penicillin-insensitive murein endopeptidase precursor [3.4.99.—] |
| ORF02825 | 5649 & 5650 | chorismate synthase (aroC) [4.2.3.5] |
| ORF02826 | 5651 & 5652 | Predicted rRNA or tRNA methylase [2.1.1.72] |
| ORF02827 | 5653 & 5654 | Smr domain protein |
| ORF02828 | 5655 & 5656 | conserved hypothetical protein |
| ORF02829 | 5657 & 5658 | minor fimbrial subunit StfG |
| ORF02830 | 5659 & 5660 | minor fimbrial subunit StfF |
| ORF02831 | 5661 & 5662 | fimbrial subunit |
| ORF02832 | 5663 & 5664 | periplasmic fimbrial chaperone StfD |
| ORF02833 | 5665 & 5666 | outer membrane usher protein StfC |
| ORF02834 | 5667 & 5668 | major fimbrial subunit StfA |
| ORF02835 | 5669 & 5670 | hypothetical protein |
| ORF02836 | 5671 & 5672 | phosphohistidine phosphatase SixA (sixA) [3.1.3.—] |
| ORF02837 | 5673 & 5674 | fatty oxidation complex, alpha subunit FadJ (fadJ) [4.2.1.17 1.1.1.35 5.1.2.3] |
| ORF02838 | 5675 & 5676 | acetyl-CoA C-acyltransferase FadI (fadI) [2.3.1.16] |
| ORF02839 | 5677 & 5678 | conserved hypothetical protein superfamily |
| ORF02840 | 5679 & 5680 | Long-chain fatty acid transport protein precursor (Outer membrane fadL protein) (Outer membrane flp protein) |
| ORF02841 | 5681 & 5682 | VACJ LIPOPROTEIN PRECURSOR. (vacJ) |
| ORF02842 | 5683 & 5684 | probable transport yfdC |
| ORF02843 | 5685 & 5686 | putative prophage integrase |
| ORF02844 | 5687 & 5688 | hypothetical protein |
| ORF02845 | 5689 & 5690 | endo-alpha-sialidase [3.2.1.129] |
| ORF02846 | 5691 & 5692 | hypothetical protein |
| ORF02847 | 5693 & 5694 | endo-alpha-sialidase [3.2.1.129] |
| ORF02848 | 5695 & 5696 | Antirepressor protein ant |
| ORF02849 | 5697 & 5698 | unnamed protein product; pot. mnt-gene product (aa 1-83) |
| ORF02850 | 5699 & 5700 | DNA transfer protein |
| ORF02851 | 5701 & 5702 | hypothetical protein |
| ORF02852 | 5703 & 5704 | DNA transfer protein |
| ORF02853 | 5705 & 5706 | DNA transfer protein gp7 |
| ORF02854 | 5707 & 5708 | head assembly protein |
| ORF02855 | 5709 & 5710 | DNA stabilization protein |
| ORF02856 | 5711 & 5712 | DNA stabilization protein |
| ORF02857 | 5713 & 5714 | gene 7 protein |
| ORF02858 | 5715 & 5716 | hypothetical protein |
| ORF02859 | 5717 & 5718 | coat protein, putative |
| ORF02860 | 5719 & 5720 | P23, putative |
| ORF02861 | 5721 & 5722 | portal protein |
| ORF02862 | 5723 & 5724 | phage terminase, large subunit, PBSX family |
| ORF02863 | 5725 & 5726 | conserved hypothetical protein |
| ORF02864 | 5727 & 5728 | gene 67 protein |
| ORF02865 | 5729 & 5730 | alternate start at bp 59; ORF |
| ORF02866 | 5731 & 5732 | Bacteriophage lysis protein |
| ORF02867 | 5733 & 5734 | lysozyme [3.2.1.17] |
| ORF02868 | 5735 & 5736 | phage holin, lambda family |
| ORF02869 | 5737 & 5738 | gene 59 protein |
| ORF02870 | 5739 & 5740 | Phage NinH protein superfamily |
| ORF02871 | 5741 & 5742 | holiday-junction resolvase [3.1.22.—] |
| ORF02872 | 5743 & 5744 | Gp66 |
| ORF02873 | 5745 & 5746 | DNA-binding protein Roi (Ant1) |
| ORF02874 | 5747 & 5748 | NinF protein superfamily |
| ORF02875 | 5749 & 5750 | NinX |
| ORF02876 | 5751 & 5752 | Protein ninE-related protein |
| ORF02877 | 5753 & 5754 | Protein ninB |
| ORF02878 | 5755 & 5756 | DnaB analogue [3.6.1.—] |

TABLE 1-continued

Annotation of ORF00001 to ORF04995

| ORFnnnnn | SEQ ID NOs | Annotation |
|---|---|---|
| ORF02879 | 5757 & 5758 | Gp54 |
| ORF02880 | 5759 & 5760 | Regulatory protein Cll (cll) |
| ORF02881 | 5761 & 5762 | hypothetical protein |
| ORF02882 | 5763 & 5764 | gene 33 protein |
| ORF02883 | 5765 & 5766 | gene 33 protein |
| ORF02884 | 5767 & 5768 | Kil protein-related protein |
| ORF02885 | 5769 & 5770 | Gp42.1 |
| ORF02886 | 5771 & 5772 | Gp40 |
| ORF02887 | 5773 & 5774 | gene 25 protein |
| ORF02888 | 5775 & 5776 | hypothetical protein |
| ORF02889 | 5777 & 5778 | Gp37 |
| ORF02890 | 5779 & 5780 | Protein of unknown function (DUF551) family |
| ORF02891 | 5781 & 5782 | conserved hypothetical protein |
| ORF02892 | 5783 & 5784 | gene 18 protein-related protein |
| ORF02893 | 5785 & 5786 | D-serine deaminase transcriptional activator (dsdC) |
| ORF02894 | 5787 & 5788 | DsdX permease |
| ORF02895 | 5789 & 5790 | D-serine ammonia-lyase (dsdA) [4.3.1.18] |
| ORF02896 | 5791 & 5792 | Multidrug resistance protein Y |
| ORF02897 | 5793 & 5794 | Multidrug resistance protein K |
| ORF02898 | 5795 & 5796 | conserved hypothetical protein |
| ORF02899 | 5797 & 5798 | Positive transcription regulator evgA |
| ORF02900 | 5799 & 5800 | Sensor protein evgS precursor [2.7.3.—] |
| ORF02901 | 5801 & 5802 | CAIB-BAIF family protein |
| ORF02902 | 5803 & 5804 | similar to [SwissProt Accession Number P45869] |
| ORF02903 | 5805 & 5806 | oxcA [4.1.1.8] |
| ORF02904 | 5807 & 5808 | CAIB-BAIF family protein [2.8.3.16] |
| ORF02905 | 5809 & 5810 | YfdX protein precursor |
| ORF02906 | 5811 & 5812 | conserved hypothetical protein |
| ORF02907 | 5813 & 5814 | DDG protein |
| ORF02908 | 5815 & 5816 | transaminase [similarity] (ASPAT) [2.6.1.—] |
| ORF02909 | 5817 & 5818 | Histidine kinase family |
| ORF02910 | 5819 & 5820 | Autolysin response regulator |
| ORF02911 | 5821 & 5822 | transcription regulator VC1825 |
| ORF02912 | 5823 & 5824 | Phosphoenolpyruvate-protein phosphotransferase ptsA(Phosphotransferase system, enzyme I) (Enzyme I-Ani) [2.7.3.9] |
| ORF02913 | 5825 & 5826 | frv operon protein |
| ORF02914 | 5827 & 5828 | proline dipeptidase [3.4.—.—] |
| ORF02915 | 5829 & 5830 | PTS system, fructose specific IIABC components, putative [2.7.1.69] |
| ORF02916 | 5831 & 5832 | PTS system, fructose-like-2 IIB component 1 (phosphotransferase |
| ORF02917 | 5833 & 5834 | glucokinase (glk) [2.7.1.2] |
| ORF02918 | 5835 & 5836 | Putative ion-transport protein yfeO |
| ORF02919 | 5837 & 5838 | conserved hypothetical protein |
| ORF02920 | 5839 & 5840 | transport protein, NRAMP family |
| ORF02921 | 5841 & 5842 | Nucleoside permease nupC |
| ORF02922 | 5843 & 5844 | Nucleoside permease nupC |
| ORF02923 | 5845 & 5846 | similar to [SwissProt Accession Number P23842] start codon is not identified yet |
| ORF02924 | 5847 & 5848 | similar to [SwissProt Accession Number P27239] start codon is not identified yet |
| ORF02925 | 5849 & 5850 | similar to [SwissProt Accession Number P27239] start codon is not identified yet |
| ORF02926 | 5851 & 5852 | glutamyl-tRNA synthetase (gltX) [6.1.1.17] |
| ORF02927 | 5853 & 5854 | transcriptional regulator, LysR family, putative |
| ORF02928 | 5855 & 5856 | conserved hypothetical protein |
| ORF02929 | 5857 & 5858 | nucleoside permease NupG |
| ORF02930 | 5859 & 5860 | xanthosine phosphorylase (xapA) [2.4.2.1] |
| ORF02931 | 5861 & 5862 | hypothetical protein |
| ORF02932 | 5863 & 5864 | Protein of unknown function (DUF1384) superfamily |
| ORF02933 | 5865 & 5866 | OsmT protein |
| ORF02934 | 5867 & 5868 | similar to [SwissProt Accession Number P39836] start codon is not identified yet |
| ORF02935 | 5869 & 5870 | conserved hypothetical protein |
| ORF02936 | 5871 & 5872 | DNA ligase, NAD-dependent (ligA) [6.5.1.2] |
| ORF02937 | 5873 & 5874 | cell division protein ZipA (zipA) |
| ORF02938 | 5875 & 5876 | CysZ protein |
| ORF02939 | 5877 & 5878 | cysteine synthase A (cysK) [2.5.1.47] |
| ORF02940 | 5879 & 5880 | Phosphocarrier protein HPr (Histidine-containing protein) (ptsH) [2.7.1.69] |
| ORF02941 | 5881 & 5882 | phosphoenolpyruvate-protein phosphotransferase (ptsI) [2.7.3.9] |
| ORF02942 | 5883 & 5884 | phosphotransferase system enzyme II, glucose-specific, factor III (crr) [2.7.1.69] |
| ORF02943 | 5885 & 5886 | pyridoxal kinase [2.7.1.35] |
| ORF02944 | 5887 & 5888 | conserved hypothetical protein |
| ORF02945 | 5889 & 5890 | cysteine synthase B (cysM) [2.5.1.47] |
| ORF02946 | 5891 & 5892 | Sulfate-thiosulfate import ATP-binding protein cysA(Sulfate-transporting ATPase) (atp_bind) [3.6.3.25] |
| ORF02947 | 5893 & 5894 | sulfate ABC transporter, permease protein CysW (cysW) |
| ORF02948 | 5895 & 5896 | sulfate ABC transporter, permease protein CysT (cysT) |
| ORF02949 | 5897 & 5898 | thiosulfate binding protein |
| ORF02950 | 5899 & 5900 | 3-oxoacyl-(acyl-carrier-protein) reductase |
| ORF02951 | 5901 & 5902 | glucokinase regulator-related protein |

TABLE 1-continued

Annotation of ORF00001 to ORF04995

| ORFnnnnn | SEQ ID NOs | Annotation |
|---|---|---|
| ORF02952 | 5903 & 5904 | PTS system, sucrose-specific IIBC component (EIIBC-Scr) (Sucrose-permease IIBC component) (Phosphotransferase enzyme II, BC component)(EC 2.7.1.69) (EII-Scr) [2.7.1.69] |
| ORF02953 | 5905 & 5906 | tyrA protein VC2145 |
| ORF02954 | 5907 & 5908 | Protein of unknown function (DUF1131) superfamily |
| ORF02955 | 5909 & 5910 | conserved hypothetical protein |
| ORF02956 | 5911 & 5912 | acetyltransferase, GNAT family family |
| ORF02957 | 5913 & 5914 | N-acetylmuramoyl-l-alanine amidase I [3.5.1.28] |
| ORF02958 | 5915 & 5916 | coproporphyrinogen III oxidase, aerobic (hemF) [1.3.3.3] |
| ORF02959 | 5917 & 5918 | Ethanolamine operon Regulatory protein |
| ORF02960 | 5919 & 5920 | Ethanolamine utilization protein eutK precursor |
| ORF02961 | 5921 & 5922 | Ethanolamine utilization protein eutL (eutL) |
| ORF02962 | 5923 & 5924 | ethanolamine ammonia-lyase, light subunit, putative [4.3.1.7] |
| ORF02963 | 5925 & 5926 | ethanolamine ammonia-lyase, large subunit (eutB) [4.3.1.7] |
| ORF02964 | 5927 & 5928 | Ethanolamine utilization protein eutA |
| ORF02965 | 5929 & 5930 | Ethanolamine utilization protein eutH |
| ORF02966 | 5931 & 5932 | Ethanolamine utilization protein eutG |
| ORF02967 | 5933 & 5934 | Ethanolamine utilization protein eutJ (EutJ) |
| ORF02968 | 5935 & 5936 | aldehyde-alcohol dehydrogenase (EutE) |
| ORF02969 | 5937 & 5938 | carbon dioxide concentrating mechanism protein CcmL, putative |
| ORF02970 | 5939 & 5940 | detox protein (EutM) |
| ORF02971 | 5941 & 5942 | phosphate acetyltransferase (pta) [2.3.1.8] |
| ORF02972 | 5943 & 5944 | Ethanolamine utilization cobalamin adenosyltransferase [2.5.1.17] |
| ORF02973 | 5945 & 5946 | Ethanolamine utilization protein eutQ |
| ORF02974 | 5947 & 5948 | Ethanolamine utilization protein eutP |
| ORF02975 | 5949 & 5950 | ethanolamine utilization protein eutS |
| ORF02976 | 5951 & 5952 | NADP-dependent malic enzyme (NADP-ME) [1.1.1.40] |
| ORF02977 | 5953 & 5954 | transaldolase (tal) [2.2.1.2] |
| ORF02978 | 5955 & 5956 | transketolase (tkt) [2.2.1.1] |
| ORF02979 | 5957 & 5958 | Protein of unknown function (DUF1176) superfamily |
| ORF02980 | 5959 & 5960 | conserved hypothetical protein |
| ORF02981 | 5961 & 5962 | conserved hypothetical protein TIGR00052 |
| ORF02982 | 5963 & 5964 | similar to [SwissProt Accession Number P37127] start codon is not identified yet (GltD) [1.4.1.13] |
| ORF02983 | 5965 & 5966 | Nitrate-nitrite sensor protein narQ |
| ORF02984 | 5967 & 5968 | 1037 amino acids, 113 kDa protein |
| ORF02985 | 5969 & 5970 | Protein yffB [1.—.—.—] |
| ORF02986 | 5971 & 5972 | succinyl-diaminopimelate desuccinylase (dapE) [3.5.1.18] |
| ORF02987 | 5973 & 5974 | conserved hypothetical protein |
| ORF02988 | 5975 & 5976 | 3.1.—.—[3.1.—.—] |
| ORF02989 | 5977 & 5978 | similar to [SwissProt Accession Number P44140] |
| ORF02990 | 5979 & 5980 | metallopeptidase, zinc binding [3.4.—.—] |
| ORF02991 | 5981 & 5982 | phosphoribosylaminoimidazole-succinocarboxamide synthase (purC) [6.3.2.6] |
| ORF02992 | 5983 & 5984 | Lipoprotein-34 precursor |
| ORF02993 | 5985 & 5986 | dihydrodipicolinate synthase (dapA) [4.2.1.52] |
| ORF02994 | 5987 & 5988 | transcriptional regulation of gcv operon |
| ORF02995 | 5989 & 5990 | bcp [1.11.1.—] |
| ORF02996 | 5991 & 5992 | predicted permease |
| ORF02997 | 5993 & 5994 | Peptidase family M48 family [3.4.—.—.] |
| ORF02998 | 5995 & 5996 | arsenate reductase (arsC) [1.20.4.1] |
| ORF02999 | 5997 & 5998 | ATPase involved in DNA replication initiation |
| ORF03000 | 5999 & 6000 | Uracil permease |
| ORF03001 | 6001 & 6002 | uracil phosphoribosyltransferase (upp) [2.4.2.9] |
| ORF03002 | 6003 & 6004 | phosphoribosylformylglycinamidine cyclo-ligase (purM) [6.3.3.1] |
| ORF03003 | 6005 & 6006 | phosphoribosylglycinamide formyltransferase (purN) [2.1.2.2] |
| ORF03004 | 6007 & 6008 | polyphosphate kinase (ppk) [2.7.4.1] |
| ORF03005 | 6009 & 6010 | exopolyphosphatase [3.6.1.11] |
| ORF03006 | 6011 & 6012 | MASE1 domain family |
| ORF03007 | 6013 & 6014 | conserved hypothetical protein |
| ORF03008 | 6015 & 6016 | hypothetical protein |
| ORF03009 | 6017 & 6018 | putative outer membrane lipoprotein |
| ORF03010 | 6019 & 6020 | probable membrane protein Z3770 |
| ORF03011 | 6021 & 6022 | putative Rz-like protein |
| ORF03012 | 6023 & 6024 | endolysin |
| ORF03013 | 6025 & 6026 | holin |
| ORF03014 | 6027 & 6028 | endo-alpha-sialidase |
| ORF03015 | 6029 & 6030 | hypothetical protein |
| ORF03016 | 6031 & 6032 | endo-alpha-sialidase [3.2.1.129] |
| ORF03017 | 6033 & 6034 | hypothetical protein |
| ORF03018 | 6035 & 6036 | Gp27 |
| ORF03019 | 6037 & 6038 | hypothetical protein |
| ORF03020 | 6039 & 6040 | hypothetical protein |
| ORF03021 | 6041 & 6042 | hypothetical protein |
| ORF03022 | 6043 & 6044 | conserved hypothetical protein |
| ORF03023 | 6045 & 6046 | conserved hypothetical protein |
| ORF03024 | 6047 & 6048 | hypothetical protein |

TABLE 1-continued

Annotation of ORF00001 to ORF04995

| ORFnnnnn | SEQ ID NOs | Annotation |
|---|---|---|
| ORF03025 | 6049 & 6050 | Bbp13 |
| ORF03026 | 6051 & 6052 | gp11 |
| ORF03027 | 6053 & 6054 | Bbp20 |
| ORF03028 | 6055 & 6056 | conserved hypothetical protein |
| ORF03029 | 6057 & 6058 | Bbp16 |
| ORF03030 | 6059 & 6060 | gp08 |
| ORF03031 | 6061 & 6062 | Bbp18 |
| ORF03032 | 6063 & 6064 | hypothetical protein |
| ORF03033 | 6065 & 6066 | Bbp19 |
| ORF03034 | 6067 & 6068 | Bbp21 |
| ORF03035 | 6069 & 6070 | conserved hypothetical protein |
| ORF03036 | 6071 & 6072 | hypothetical protein |
| ORF03037 | 6073 & 6074 | hypothetical protein |
| ORF03038 | 6075 & 6076 | terminase large subunit |
| ORF03039 | 6077 & 6078 | conserved hypothetical protein |
| ORF03040 | 6079 & 6080 | putative repressor |
| ORF03041 | 6081 & 6082 | conserved hypothetical protein |
| ORF03042 | 6083 & 6084 | conserved hypothetical protein |
| ORF03043 | 6085 & 6086 | exonuclease VIII RecE [3.1.11.—] |
| ORF03044 | 6087 & 6088 | enterohemolysin 1 |
| ORF03045 | 6089 & 6090 | Prophage CP4-57 regulatory protein (AlpA) family |
| ORF03046 | 6091 & 6092 | conserved hypothetical protein |
| ORF03047 | 6093 & 6094 | adenine methylase |
| ORF03048 | 6095 & 6096 | adenine methylase |
| ORF03049 | 6097 & 6098 | integrase |
| ORF03050 | 6099 & 6100 | GMP synthase [glutamine-hydrolyzing] (Glutamineamidotransferase) (GMP synthetase) (glutamine-hydro) [6.3.5.2] |
| ORF03051 | 6101 & 6102 | inosine-5'-monophosphate dehydrogenase (guaB) [1.1.1.205] |
| ORF03052 | 6103 & 6104 | exodeoxyribonuclease VII, large subunit (xseA) [3.1.11.6] |
| ORF03053 | 6105 & 6106 | Aec4 precursor |
| ORF03054 | 6107 & 6108 | SinI homolog |
| ORF03055 | 6109 & 6110 | Aec1 precursor |
| ORF03056 | 6111 & 6112 | Protein of unknown function (DUF1407) superfamily |
| ORF03057 | 6113 & 6114 | predicted GTP-binding protein |
| ORF03058 | 6115 & 6116 | PQQ enzyme repeat domain protein [2.7.1.—] |
| ORF03059 | 6117 & 6118 | unnamed protein product |
| ORF03060 | 6119 & 6120 | histidyl-tRNA synthetase (hisS) [6.1.1.21] |
| ORF03061 | 6121 & 6122 | 4-hydroxy-3-methylbut-2-en-1-yl diphosphate synthase (ispG) [1.17.4.3] |
| ORF03062 | 6123 & 6124 | similar to [SwissProt Accession Number P27434] |
| ORF03063 | 6125 & 6126 | radical SAM enzyme, Cfr family |
| ORF03064 | 6127 & 6128 | Nucleoside diphosphate kinase (ndk) [2.7.4.6] |
| ORF03065 | 6129 & 6130 | penicillin-binding protein 1C (pbpC) |
| ORF03066 | 6131 & 6132 | Hypothetical lipoprotein yfhM precursor |
| ORF03067 | 6133 & 6134 | 3-mercaptopyruvate sulfurtransferase (AF109156) [2.8.1.1] |
| ORF03068 | 6135 & 6136 | enhanced serine sensitivity |
| ORF03069 | 6137 & 6138 | Cytosol aminopeptidase family, catalytic domain family |
| ORF03070 | 6139 & 6140 | Protein of unknown function (DUF528) superfamily |
| ORF03071 | 6141 & 6142 | ferredoxin, 2Fe—2S type, ISC system (fdx) |
| ORF03072 | 6143 & 6144 | Fe—S protein assembly chaperone HscA (hscA) |
| ORF03073 | 6145 & 6146 | Fe—S protein assembly co-chaperone HscB (hscB) |
| ORF03074 | 6147 & 6148 | iron-sulfur cluster assembly protein IscA (iscA) |
| ORF03075 | 6149 & 6150 | FeS cluster assembly scaffold IscU (iscU) |
| ORF03076 | 6151 & 6152 | cysteine desulfurase IscS (iscS) [4.4.1.—] |
| ORF03077 | 6153 & 6154 | iron-sulfur cluster assembly transcription factor IscR (iscR) |
| ORF03078 | 6155 & 6156 | RNA methyltransferase, TrmH family, group 1 |
| ORF03079 | 6157 & 6158 | Inositol-1-monophosphatase (IMPase) (Inositol-1-phosphatase) (I-1-Pase) (I-1-Pase) [3.1.3.25] |
| ORF03080 | 6159 & 6160 | conserved hypothetical protein |
| ORF03081 | 6161 & 6162 | MFS (major facilitator superfamily) transporter |
| ORF03082 | 6163 & 6164 | csiE |
| ORF03083 | 6165 & 6166 | DoxX subfamily, putative |
| ORF03084 | 6167 & 6168 | Aldose 1-epimerase superfamily |
| ORF03085 | 6169 & 6170 | oxidoreductase, zinc-binding dehydrogenase family superfamily [1.1.1.14] |
| ORF03086 | 6171 & 6172 | ribose ABC transporter, permease protein |
| ORF03087 | 6173 & 6174 | D-xylose ABC transporter, ATP-binding protein |
| ORF03088 | 6175 & 6176 | ribose ABC transporter, periplasmic ribose-binding protein, putative |
| ORF03089 | 6177 & 6178 | TPR Domain domain protein |
| ORF03090 | 6179 & 6180 | ROK family protein domain protein |
| ORF03091 | 6181 & 6182 | serine hydroxymethyltransferase (glyA) [2.1.2.1] |
| ORF03092 | 6183 & 6184 | dihydropteridine reductase (NOD) [1.5.1.34] |
| ORF03093 | 6185 & 6186 | Nitrogen regulatory protein P-II |
| ORF03094 | 6187 & 6188 | transcriptional regulatory protein |
| ORF03095 | 6189 & 6190 | unnamed protein product |
| ORF03096 | 6191 & 6192 | two-component system sensor kinase |
| ORF03097 | 6193 & 6194 | phosphoribosylformylglycinamidine synthase (purL) [6.3.5.3] |
| ORF03098 | 6195 & 6196 | transglycosylase, Slt family |

TABLE 1-continued

Annotation of ORF00001 to ORF04995

| ORFnnnnn | SEQ ID NOs | Annotation |
|---|---|---|
| ORF03099 | 6197 & 6198 | tRNA-specific adenosine deaminase [3.5.4.—] |
| ORF03100 | 6199 & 6200 | HAD superfamily (subfamily IF) hydrolase, YfhB (yfhb) |
| ORF03101 | 6201 & 6202 | Transcriptional regulator (membrane) |
| ORF03102 | 6203 & 6204 | NapF protein (fdx) |
| ORF03103 | 6205 & 6206 | holo-(acyl-carrier-protein) synthase (acpS) [2.7.8.7] |
| ORF03104 | 6207 & 6208 | pyridoxal phosphate biosynthetic protein PdxJ (pdxJ) |
| ORF03105 | 6209 & 6210 | DNA repair protein RecO (recO) |
| ORF03106 | 6211 & 6212 | GTP-binding protein Era (era) |
| ORF03107 | 6213 & 6214 | ribonuclease III (rnc) [3.1.26.3] |
| ORF03108 | 6215 & 6216 | signal peptidase I [similarity] (lep) [3.4.21.89] |
| ORF03109 | 6217 & 6218 | GTP-binding protein LepA (lepA) |
| ORF03110 | 6219 & 6220 | Sigma-E factor Regulatory protein rseC |
| ORF03111 | 6221 & 6222 | Sigma-E factor Regulatory protein rseB precursor (rseB) |
| ORF03112 | 6223 & 6224 | sigma-E factor, negative regulatory protein |
| ORF03113 | 6225 & 6226 | RNA polymerase sigma E (SIGMA) |
| ORF03114 | 6227 & 6228 | hypothetical protein |
| ORF03115 | 6229 & 6230 | unnamed protein product |
| ORF03116 | 6231 & 6232 | L-aspartate oxidase (nadB) [1.4.3.16] |
| ORF03117 | 6233 & 6234 | ATP-dependent RNA helicase (srmB) |
| ORF03118 | 6235 & 6236 | similar to [SwissProt Accession Number P33634] |
| ORF03119 | 6237 & 6238 | translocator protein, LysE family superfamily |
| ORF03120 | 6239 & 6240 | Protein yfiD |
| ORF03121 | 6241 & 6242 | uracil-DNA glycosylase (ung) [3.2.2.—] |
| ORF03122 | 6243 & 6244 | similar to [SwissProt Accession Number P33635] start codon is not identified yet |
| ORF03123 | 6245 & 6246 | hypothetical protein |
| ORF03124 | 6247 & 6248 | thioredoxin (trx) |
| ORF03125 | 6249 & 6250 | DTW domain protein |
| ORF03126 | 6251 & 6252 | Acyl-CoA synthetase (NDP forming) |
| ORF03127 | 6253 & 6254 | CDP-DIACYLGLYCEROL--SERINE O-PHOSPHATIDYLTRANSFERASE (EC 2.7.8.8) (PHOSPHATIDYLSERINE SYNTHASE). [2.7.8.8] |
| ORF03128 | 6255 & 6256 | lipoprotein, putative |
| ORF03129 | 6257 & 6258 | Alpha-ketoglutarate permease |
| ORF03130 | 6259 & 6260 | transposase |
| ORF03131 | 6261 & 6262 | transposase |
| ORF03132 | 6263 & 6264 | transposase |
| ORF03133 | 6265 & 6266 | hypothetical |
| ORF03134 | 6267 & 6268 | hypothetical protein |
| ORF03135 | 6269 & 6270 | heat shock protein [3.4.21.—] |
| ORF03136 | 6271 & 6272 | conserved hypothetical protein TIGR00726 |
| ORF03137 | 6273 & 6274 | ribosomal large subunit pseudouridine synthase D (sfhB) [4.2.1.70] |
| ORF03138 | 6275 & 6276 | unkown |
| ORF03139 | 6277 & 6278 | ribosomal subunit interface protein (yfiA) |
| ORF03140 | 6279 & 6280 | P-protein (PDT) [5.4.99.5] |
| ORF03141 | 6281 & 6282 | T-protein (PDH) [5.4.99.5] |
| ORF03142 | 6283 & 6284 | phospho-2-dehydro-3-deoxyheptonate aldolase [2.5.1.54] |
| ORF03143 | 6285 & 6286 | lipoprotein, putative |
| ORF03144 | 6287 & 6288 | conserved hypothetical protein |
| ORF03145 | 6289 & 6290 | similar to [SwissProt Accession Number P46139] |
| ORF03146 | 6291 & 6292 | unnamed protein product; unidentified reading frame (16K polypeptide) (aa 1-127) |
| ORF03147 | 6293 & 6294 | ribosomal protein L19 (rplS) |
| ORF03148 | 6295 & 6296 | tRNA (guanine-N1)-methyltransferase (trmD) [2.1.1.31] |
| ORF03149 | 6297 & 6298 | 16S rRNA processing protein RimM (rimM) |
| ORF03150 | 6299 & 6300 | 30S ribosomal protein S16 (rpS16) |
| ORF03151 | 6301 & 6302 | signal recognition particle protein (ffh) |
| ORF03152 | 6303 & 6304 | CorE |
| ORF03153 | 6305 & 6306 | unnamed protein product |
| ORF03154 | 6307 & 6308 | co-chaperone GrpE (grpE) |
| ORF03155 | 6309 & 6310 | NAD+ kinase [2.7.1.23] |
| ORF03156 | 6311 & 6312 | hypothetical protein |
| ORF03157 | 6313 & 6314 | DNA repair protein RecN (recN) |
| ORF03158 | 6315 & 6316 | Small protein A precursor |
| ORF03159 | 6317 & 6318 | Protein yfjF |
| ORF03160 | 6319 & 6320 | Streptomyces cyclase-dehydrase family |
| ORF03161 | 6321 & 6322 | SsrA-binding protein (smpB) |
| ORF03162 | 6323 & 6324 | hypothetical protein |
| ORF03163 | 6325 & 6326 | conserved hypothetical protein |
| ORF03164 | 6327 & 6328 | DinI-like protein Z3916-ECs3483 (AF175466) |
| ORF03165 | 6329 & 6330 | T4-exclusion protein stimulator gIBEGs |
| ORF03166 | 6331 & 6332 | ycfE protein (fragment) |
| ORF03167 | 6333 & 6334 | unnamed protein product; unidentified reading frame P-293 |
| ORF03168 | 6335 & 6336 | heat shock protein [3.4.21.—] |
| ORF03169 | 6337 & 6338 | heat shock protein [3.4.21.—] |
| ORF03170 | 6339 & 6340 | conserved hypothetical protein |
| ORF03171 | 6341 & 6342 | Sb36 |
| ORF03172 | 6343 & 6344 | conserved hypothetical protein |
| ORF03173 | 6345 & 6346 | hypothetical protein |

TABLE 1-continued

Annotation of ORF00001 to ORF04995

| ORFnnnnn | SEQ ID NOs | Annotation |
|---|---|---|
| ORF03174 | 6347 & 6348 | conserved hypothetical protein |
| ORF03175 | 6349 & 6350 | unnamed protein product |
| ORF03176 | 6351 & 6352 | hypothetical protein |
| ORF03177 | 6353 & 6354 | gab protein |
| ORF03178 | 6355 & 6356 | predicted dehydrogenase |
| ORF03179 | 6357 & 6358 | Succinate-semialdehyde dehydrogenase [NADP+] [1.2.1.16] |
| ORF03180 | 6359 & 6360 | 4-aminobutyrate transaminase (gabT) [2.6.1.19] |
| ORF03181 | 6361 & 6362 | GABA permease (gabP) |
| ORF03182 | 6363 & 6364 | transcriptional regulator, GntR family, putative |
| ORF03183 | 6365 & 6366 | Putative phospholipid-binding domain family |
| ORF03184 | 6367 & 6368 | Hypothetical UPF0057 protein yqaE-related protein |
| ORF03185 | 6369 & 6370 | transcriptional regulator, ArsR family (AJ001934) |
| ORF03186 | 6371 & 6372 | rhodanese family protein, putative |
| ORF03187 | 6373 & 6374 | DNA-binding protein stpA |
| ORF03188 | 6375 & 6376 | Protein of unknown function (DUF1144) superfamily |
| ORF03189 | 6377 & 6378 | similar to [SwissProt Accession Number P36931] start codon is not identified yet |
| ORF03190 | 6379 & 6380 | unnamed protein product; ORFA |
| ORF03191 | 6381 & 6382 | GntR-family transcriptional regulator (X78503) |
| ORF03192 | 6383 & 6384 | Uncharacterized ACR |
| ORF03193 | 6385 & 6386 | nrdH-related protein |
| ORF03194 | 6387 & 6388 | nrdI protein (nrdI) |
| ORF03195 | 6389 & 6390 | ribonucleoside-diphosphate reductase alpha chain |
| ORF03196 | 6391 & 6392 | ribonucleoside-diphosphate reductase, beta subunit [1.17.4.1] |
| ORF03197 | 6393 & 6394 | ATP-binding component of transport system for glycine, betaine and proline (atp_bind) |
| ORF03198 | 6395 & 6396 | Glycine betaine-L-proline transport system permease protein proW (membrane) |
| ORF03199 | 6397 & 6398 | high-affinity glycine betaine - proline transport system |
| ORF03200 | 6399 & 6400 | major facilitator family transporter (permease) |
| ORF03201 | 6401 & 6402 | AzlC family protein, putative |
| ORF03202 | 6403 & 6404 | YgaH protein |
| ORF03203 | 6405 & 6406 | Transcriptional repressor mprA (EmrR protein) |
| ORF03204 | 6407 & 6408 | Multidrug resistance protein A |
| ORF03205 | 6409 & 6410 | Multidrug resistance protein B |
| ORF03206 | 6411 & 6412 | conserved hypothetical protein |
| ORF03207 | 6413 & 6414 | conserved hypothetical protein |
| ORF03208 | 6415 & 6416 | autoinducer-2 production protein LuxS (luxS) |
| ORF03209 | 6417 & 6418 | glutamate--cysteine ligase (gshA) [6.3.2.2] |
| ORF03210 | 6419 & 6420 | gamma-glutamate-cysteine ligase (GCS) |
| ORF03211 | 6421 & 6422 | conserved hypothetical protein |
| ORF03212 | 6423 & 6424 | CbbY family protein VCA0662 (pgp) |
| ORF03213 | 6425 & 6426 | carbon storage regulator (csrA) |
| ORF03214 | 6427 & 6428 | alanyl-tRNA synthetase (alaS) [6.1.1.7] |
| ORF03215 | 6429 & 6430 | Regulatory protein recX (oraA protein) (recX) |
| ORF03216 | 6431 & 6432 | recA protein (recA) |
| ORF03217 | 6433 & 6434 | Protein ygaD |
| ORF03218 | 6435 & 6436 | Membrane-bound lytic murein transglycosylase B precursor |
| ORF03219 | 6437 & 6438 | PTS SYSTEM, GLUCITOL-SORBITOL-SPECIFIC IIBC COMPONENT (EIIBC-GUT) (GLUCITOL-SORBITOL-PERMEASE IIBC COMPONENT) (PHOSPHOTRANSFERASE ENZYME II, BC COMPONENT) (EC 2.7.1.69) (EII-GUT) [2.7.1.69] |
| ORF03220 | 6439 & 6440 | PTS SYSTEM, GLUCITOL-SORBITOL-SPECIFIC IIBC COMPONENT (EIIBC-GUT) (GLUCITOL-SORBITOL-PERMEASE IIBC COMPONENT) (PHOSPHOTRANSFERASE ENZYME II, BC COMPONENT) (EC 2.7.1.69) (EII-GUT) [2.7.1.69] |
| ORF03221 | 6441 & 6442 | PTS enzyme III glucitol [2.7.1.69] |
| ORF03222 | 6443 & 6444 | 3-oxoacyl-(acyl-carrier-protein) reductase (sorbitol) [1.1.1.140] |
| ORF03223 | 6445 & 6446 | Glucitol operon activator protein (gutM) |
| ORF03224 | 6447 & 6448 | Glucitol operon repressor (sri) |
| ORF03225 | 6449 & 6450 | GutQ protein |
| ORF03226 | 6451 & 6452 | ygaA protein (fhlA) |
| ORF03227 | 6453 & 6454 | Anaerobic nitric oxide reductase flavorubredoxin (FlRd) (FlavoRb) (fprA) [1.—.—.—] |
| ORF03228 | 6455 & 6456 | Nitric oxide reductase FlRd-NAD(+) reductase(Flavorubredoxin reductase) (FlRd-reductase) (FlavoRb reductase) (FAD) [1.18.1.—] |
| ORF03229 | 6457 & 6458 | [NiFe] hydrogenase maturation protein HypF (hypF) |
| ORF03230 | 6459 & 6460 | Electron transport protein hydN |
| ORF03231 | 6461 & 6462 | hypothetical protein |
| ORF03232 | 6463 & 6464 | ascBF operon repressor |
| ORF03233 | 6465 & 6466 | PTS system enzyme II ABC (asc) [2.7.1.69] |
| ORF03234 | 6467 & 6468 | 6-phospho-beta-glucosidase [3.2.1.86] |
| ORF03235 | 6469 & 6470 | unnamed protein product |
| ORF03236 | 6471 & 6472 | conserved hypothetical protein |
| ORF03237 | 6473 & 6474 | hydrogenase maturation protease HycI |
| ORF03238 | 6475 & 6476 | Formate hydrogenlyase maturation protein hycH (HycE) [1.—.—.—] |
| ORF03239 | 6477 & 6478 | Formate hydrogenlyase subunit 7 [1.18.99.1] |
| ORF03240 | 6479 & 6480 | Formate hydrogenlyase subunit 6 [1.18.99.1] |
| ORF03241 | 6481 & 6482 | hydrogenase 3 large subunit [1.18.99.1] |

TABLE 1-continued

Annotation of ORF00001 to ORF04995

| ORFnnnnn | SEQ ID NOs | Annotation |
|---|---|---|
| ORF03242 | 6483 & 6484 | Formate hydrogenlyase subunit 4 (hycD) [1.18.99.1] |
| ORF03243 | 6485 & 6486 | Formate hydrogenlyase subunit 3 (FHL subunit 3) (Hydrogenase-3component C) [1.18.99.1] |
| ORF03244 | 6487 & 6488 | formate hydrogenlyase subunit-7 component B (FHL) |
| ORF03245 | 6489 & 6490 | Formate hydrogenlyase regulatory protein hycA |
| ORF03246 | 6491 & 6492 | hydrogenase nickel insertion protein HypA (hypA) |
| ORF03247 | 6493 & 6494 | hydrogenase accessory protein HypB |
| ORF03248 | 6495 & 6496 | hydrogenase assembly chaperone HypC-HupF (hypC) |
| ORF03249 | 6497 & 6498 | hydrogenase expression-formation protein HypD (hypD) |
| ORF03250 | 6499 & 6500 | hydrogenase expression-formation protein HypE (hypE) |
| ORF03251 | 6501 & 6502 | Formate hydrogenlyase transcriptional activator |
| ORF03252 | 6503 & 6504 | Potential molybdenum-pterin-binding-protein |
| ORF03253 | 6505 & 6506 | conserved hypothetical protein |
| ORF03254 | 6507 & 6508 | DNA mismatch repair protein MutS (mutS) |
| ORF03255 | 6509 & 6510 | Serine-threonine protein phosphatase 2 [3.1.3.16] |
| ORF03256 | 6511 & 6512 | Transcriptional regulator of sugar metabolism |
| ORF03257 | 6513 & 6514 | 3-hydroxyisobutyrate dehydrogenase [1.1.—.—] |
| ORF03258 | 6515 & 6516 | tRNA synthase-like protein |
| ORF03259 | 6517 & 6518 | L-fuculose-1-phosphate aldolase-like protein (fucA) [4.1.2.17] |
| ORF03260 | 6519 & 6520 | Hfi protein [5.3.1.22] |
| ORF03261 | 6521 & 6522 | gluconate permease |
| ORF03262 | 6523 & 6524 | metallo-beta-lactamase superfamily domain protein |
| ORF03263 | 6525 & 6526 | tryptophan repressor binding protein |
| ORF03264 | 6527 & 6528 | sigma factor RpoS (sigma38) |
| ORF03265 | 6529 & 6530 | sigma factor RpoS (sigma38) |
| ORF03266 | 6531 & 6532 | Lipoprotein nlpD precursor |
| ORF03267 | 6533 & 6534 | protein-L-isoaspartate O-methyltransferase (pcm) [2.1.1.77] |
| ORF03268 | 6535 & 6536 | acid phosphatase SurE (surE) [3.1.3.2] |
| ORF03269 | 6537 & 6538 | conserved hypothetical protein TIGR00094 |
| ORF03270 | 6539 & 6540 | 2C-methyl-D-erythritol 2,4-cyclodiphosphate synthase (ispF) [4.6.1.12] |
| ORF03271 | 6541 & 6542 | 2-C-methyl-D-erythritol 4-phosphate cytidylyltransferase (ispD) [2.7.7.60] |
| ORF03272 | 6543 & 6544 | Cell division protein ftsB |
| ORF03273 | 6545 & 6546 | YgbE |
| ORF03274 | 6547 & 6548 | adenylylsulfate kinase (cysC) [2.7.1.25] |
| ORF03275 | 6549 & 6550 | Sulfate adenylyltransferase subunit 1 (Sulfate adenylatetransferase) (SAT) (ATP-sulfurylase large subunit) (SAT) [2.7.7.4] |
| ORF03276 | 6551 & 6552 | Sulfate adenylyltransferase subunit 2 (Sulfate adenylatetransferase) (SAT) (ATP-sulfurylase small subunit) (SAT) [2.7.7.4] |
| ORF03277 | 6553 & 6554 | hypothetical protein |
| ORF03278 | 6555 & 6556 | Alkaline phosphatase isozyme conversion protein precursor [3.4.11.—] |
| ORF03279 | 6557 & 6558 | Hok-gef family superfamily |
| ORF03280 | 6559 & 6560 | 3-phosphoadenosine 5-phosphosulfate reductase |
| ORF03281 | 6561 & 6562 | sulfite reductase (NADPH) hemoprotein, beta subunit (cysI) [1.8.1.2] |
| ORF03282 | 6563 & 6564 | sulfite reductase [NADPH] flavoprotein, alpha chain [1.8.1.2] |
| ORF03283 | 6565 & 6566 | 6-pyruvoyl-tetrahydropterin synthase |
| ORF03284 | 6567 & 6568 | Probable electron transfer flavoprotein-quinone oxidoreductase ygcN |
| ORF03285 | 6569 & 6570 | Ferredoxin-like protein ygcO |
| ORF03286 | 6571 & 6572 | glycerol uptake operon antiterminator regulatory protein, putative |
| ORF03287 | 6573 & 6574 | electron transfer flavoprotein, alpha subunit subfamily (etfA) |
| ORF03288 | 6575 & 6576 | putative transport protein |
| ORF03289 | 6577 & 6578 | sugar transporter, putative |
| ORF03290 | 6579 & 6580 | alkyl-dihydroxyacetonephosphate synthase, putative |
| ORF03291 | 6581 & 6582 | 1.—.—.—[1.1.1.—] |
| ORF03292 | 6583 & 6584 | Major Facilitator Superfamily subfamily |
| ORF03293 | 6585 & 6586 | sugar kinase, FGGY family, putative [2.7.1.17] |
| ORF03294 | 6587 & 6588 | radical activating enzyme |
| ORF03295 | 6589 & 6590 | radical activating enzyme |
| ORF03296 | 6591 & 6592 | LemA family superfamily |
| ORF03297 | 6593 & 6594 | glycine rich protein |
| ORF03298 | 6595 & 6596 | conserved hypothetical protein |
| ORF03299 | 6597 & 6598 | Domain of unknown function (DUF477) family |
| ORF03300 | 6599 & 6600 | glycine rich protein |
| ORF03301 | 6601 & 6602 | enolase (eno) [4.2.1.11] |
| ORF03302 | 6603 & 6604 | CTP synthase (pyrG) [6.3.4.2] |
| ORF03303 | 6605 & 6606 | MazG protein (mazG) |
| ORF03304 | 6607 & 6608 | PemK-like protein 1 (MazF protein) (AF027767) |
| ORF03305 | 6609 & 6610 | PemI-like protein 1 (MazE protein) |
| ORF03306 | 6611 & 6612 | GTP pyrophosphokinase (ATP: GTP 3'-pyrophosphotransferase)(ppGpp synthetase I) ((p)ppGpp synthetase) (relA) [2.7.6.5] |
| ORF03307 | 6613 & 6614 | 23S rRNA (uracil-5-)-methyltransferase RumA (rumA) [2.1.1.—] |
| ORF03308 | 6615 & 6616 | Sensor protein barA [2.7.3.—] |
| ORF03309 | 6617 & 6618 | hypothetical protein |
| ORF03310 | 6619 & 6620 | glucarate dehydratase [4.2.1.40] |
| ORF03311 | 6621 & 6622 | glucarate dehydratase [4.2.1.—] |
| ORF03312 | 6623 & 6624 | MFS transporter, phthalate permease family |
| ORF03313 | 6625 & 6626 | Exoenzyme regulation regulon (mioC) |

TABLE 1-continued

Annotation of ORF00001 to ORF04995

| ORFnnnnn | SEQ ID NOs | Annotation |
|---|---|---|
| ORF03314 | 6627 & 6628 | RNA pseudouridylate synthase family protein [4.2.1.70] |
| ORF03315 | 6629 & 6630 | tRNA pseudouridine synthase C (Pseudouridylate synthase)(Uracil hydrolyase) [4.2.1.70] |
| ORF03316 | 6631 & 6632 | interacts with secY |
| ORF03317 | 6633 & 6634 | hypothetical protein |
| ORF03318 | 6635 & 6636 | GTP cyclohydrolase I-like protein |
| ORF03319 | 6637 & 6638 | Predicted Rossmann fold nucleotide-binding protein |
| ORF03320 | 6639 & 6640 | Serine transporter |
| ORF03321 | 6641 & 6642 | L-serine ammonia-lyase (sdaA) [4.3.1.17] |
| ORF03322 | 6643 & 6644 | exodeoxyribonuclease IX |
| ORF03323 | 6645 & 6646 | Lactaldehyde reductase [1.1.1.77] |
| ORF03324 | 6647 & 6648 | L-fuculose phosphate aldolase (fucA) [4.1.2.17] |
| ORF03325 | 6649 & 6650 | conserved hypothetical protein |
| ORF03326 | 6651 & 6652 | L-fucose permease (fucP) |
| ORF03327 | 6653 & 6654 | L-fucose isomerase (fucI) [5.3.1.25] |
| ORF03328 | 6655 & 6656 | L-fuculokinase (L-fuculose kinase) (fucK) [2.7.1.51] |
| ORF03329 | 6657 & 6658 | Fucose operon fucU protein (fucU) |
| ORF03330 | 6659 & 6660 | hypothetical protein |
| ORF03331 | 6661 & 6662 | L-fucose operon activator |
| ORF03332 | 6663 & 6664 | SAM-dependent methyltransferase-like protein |
| ORF03333 | 6665 & 6666 | Uncharacterized small membrane protein |
| ORF03334 | 6667 & 6668 | transcriptional regulator, LysR family (gcvA) |
| ORF03335 | 6669 & 6670 | Bacterial protein of unknown function (DUF903) superfamily |
| ORF03336 | 6671 & 6672 | Cysteine sulfinate desulfinase |
| ORF03337 | 6673 & 6674 | Fe—S metabolism associated domain subfamily |
| ORF03338 | 6675 & 6676 | Dinucleotide-utilizing enzymes involved in molybdopterin and thiamine biosynthesis family 1 |
| ORF03339 | 6677 & 6678 | Membrane-bound lytic murein transglycosylase A precursor |
| ORF03340 | 6679 & 6680 | Protein of unknown function (DUF770) superfamily |
| ORF03341 | 6681 & 6682 | Aec18 |
| ORF03342 | 6683 & 6684 | Bacterial protein of unknown function (DUF876) superfamily |
| ORF03343 | 6685 & 6686 | Possibly conserved membrane protein |
| ORF03344 | 6687 & 6688 | unnamed protein product |
| ORF03345 | 6689 & 6690 | Secreted protein Hcp |
| ORF03346 | 6691 & 6692 | ClpB protein |
| ORF03347 | 6693 & 6694 | Rhs element Vgr protein subfamily, putative |
| ORF03348 | 6695 & 6696 | unnamed protein product; Similar to unknown protein |
| ORF03349 | 6697 & 6698 | unnamed protein product; Highly similar to unknown protein of Photorhabdus. Putative secreted protein, putative |
| ORF03350 | 6699 & 6700 | unnamed protein product |
| ORF03351 | 6701 & 6702 | unnamed protein product |
| ORF03352 | 6703 & 6704 | ImpA-related N-terminal family |
| ORF03353 | 6705 & 6706 | conserved hypothetical protein |
| ORF03354 | 6707 & 6708 | hypothetical protein |
| ORF03355 | 6709 & 6710 | Bacterial protein of unknown function (DUF879) superfamily |
| ORF03356 | 6711 & 6712 | Protein of unknown function (DUF1305) superfamily |
| ORF03357 | 6713 & 6714 | lipoprotein, putative |
| ORF03358 | 6715 & 6716 | Protein of unknown function (DUF1316) subfamily |
| ORF03359 | 6717 & 6718 | conserved hypothetical protein |
| ORF03360 | 6719 & 6720 | ImpA-related N-terminal family |
| ORF03361 | 6721 & 6722 | 2-hydroxyacid dehydrogenase (serA) |
| ORF03362 | 6723 & 6724 | Phosphosugar isomerase |
| ORF03363 | 6725 & 6726 | Beta-cystathionase |
| ORF03364 | 6727 & 6728 | PTS system, IIBC components, putative [2.7.1.69] |
| ORF03365 | 6729 & 6730 | Antiterminator |
| ORF03366 | 6731 & 6732 | N-acetylmuramoyl-L-alanine amidase amiC precursor [3.5.1.28] |
| ORF03367 | 6733 & 6734 | amino-acid N-acetyltransferase (argA) [2.3.1.1] |
| ORF03368 | 6735 & 6736 | exodeoxyribonuclease V, alpha subunit (recD) [3.1.11.5] |
| ORF03369 | 6737 & 6738 | exodeoxyribonuclease V, beta subunit (recB) [3.1.11.5] |
| ORF03370 | 6739 & 6740 | Protease III precursor (Pitrilysin) (Protease pi) (pitrilysin) [3.4.24.55] |
| ORF03371 | 6741 & 6742 | exodeoxyribonuclease V, gamma subunit (recC) [3.1.11.5] |
| ORF03372 | 6743 & 6744 | Prepilin peptidase dependent protein C precursor |
| ORF03373 | 6745 & 6746 | conserved hypothetical protein |
| ORF03374 | 6747 & 6748 | unnamed protein product; URF1 (aa 1-267) |
| ORF03375 | 6749 & 6750 | Prepilin peptidase dependent protein A precursor |
| ORF03376 | 6751 & 6752 | thymidylate synthase (thyA) [2.1.1.45] |
| ORF03377 | 6753 & 6754 | prolipoprotein diacylglyceryl transferase (lgt) [2.4.99.—] |
| ORF03378 | 6755 & 6756 | Phosphoenolpyruvate-protein phosphotransferase ptsP (Ntr) [2.7.3.9] |
| ORF03379 | 6757 & 6758 | NTP pyrophosphohydrolases including oxidative damage repair enzymes |
| ORF03380 | 6759 & 6760 | DNA mismatch repair endonuclease mutH (mutH) |
| ORF03381 | 6761 & 6762 | TerC protein |
| ORF03382 | 6763 & 6764 | lipoprotein |
| ORF03383 | 6765 & 6766 | Tas protein |
| ORF03384 | 6767 & 6768 | unnamed protein product |
| ORF03385 | 6769 & 6770 | AAS bifunctional protein |
| ORF03386 | 6771 & 6772 | Galactose operon repressor |

TABLE 1-continued

Annotation of ORF00001 to ORF04995

| ORFnnnnn | SEQ ID NOs | Annotation |
|---|---|---|
| ORF03387 | 6773 & 6774 | diaminopimelate decarboxylase (lysA) [4.1.1.20] |
| ORF03388 | 6775 & 6776 | aspartate racemase subfamily [5.1.1.13] |
| ORF03389 | 6777 & 6778 | Transcriptional activator protein lysR |
| ORF03390 | 6779 & 6780 | Arabinose-proton symporter |
| ORF03391 | 6781 & 6782 | 2-deoxy-D-gluconate 3-dehydrogenase (kduD) [1.1.1.125] |
| ORF03392 | 6783 & 6784 | 4-deoxy-L-threo-5-hexosulose-uronate ketol-isomerase |
| ORF03393 | 6785 & 6786 | Probable acetyl-CoA acetyltransferase |
| ORF03394 | 6787 & 6788 | serine transporter |
| ORF03395 | 6789 & 6790 | possible lipoprotein |
| ORF03396 | 6791 & 6792 | aldehyde oxidoreductase, putative [1.1.1.204] |
| ORF03397 | 6793 & 6794 | Xanthine dehydrogenase, FAD binding subunit (cutB) [1.1.1.204] |
| ORF03398 | 6795 & 6796 | small chain CO dehydrogenase (cutC) |
| ORF03399 | 6797 & 6798 | signal-transduction and transcriptional-control protein |
| ORF03400 | 6799 & 6800 | hypothetical protein |
| ORF03401 | 6801 & 6802 | Aspartate-ornithine carbamoyltransferase, Asp-Orn binding domain family |
| ORF03402 | 6803 & 6804 | threonine dehydratase biosynthetic [4.3.1.15] |
| ORF03403 | 6805 & 6806 | acetylornithine deacetylase, putative |
| ORF03404 | 6807 & 6808 | dihydropyrimidinase (hydA) [3.5.2.2] |
| ORF03405 | 6809 & 6810 | carbamate kinase (arcC) [2.7.2.2] |
| ORF03406 | 6811 & 6812 | xanthine dehydrogenase accessory factor, putative subfamily, putative |
| ORF03407 | 6813 & 6814 | conserved hypothetical protein |
| ORF03408 | 6815 & 6816 | hypotehtical ygfJ |
| ORF03409 | 6817 & 6818 | oxidoreductase, pyridine nucleotide-disulfide family |
| ORF03410 | 6819 & 6820 | chlorohydrolase family protein, putative |
| ORF03411 | 6821 & 6822 | FAD binding domain in molybdopterin dehydrogenase protein |
| ORF03412 | 6823 & 6824 | aldehyde oxidoreductase, putative [1.—.—.—] |
| ORF03413 | 6825 & 6826 | xanthine-urcil permease family protein |
| ORF03414 | 6827 & 6828 | Guanine deaminase |
| ORF03415 | 6829 & 6830 | xanthine-uracil permease family protein |
| ORF03416 | 6831 & 6832 | Electron transport protein hydN |
| ORF03417 | 6833 & 6834 | anaerobically expressed oxidoreductase (GltD) [1.4.1.13] |
| ORF03418 | 6835 & 6836 | xanthine permease |
| ORF03419 | 6837 & 6838 | isopentenyl-diphosphate delta-isomerase, type 1 (idi) [5.3.3.2] |
| ORF03420 | 6839 & 6840 | Iysyl-tRNA synthetase (IysS) [6.1.1.6] |
| ORF03421 | 6841 & 6842 | peptide chain release factor 2 (prfB) |
| ORF03422 | 6843 & 6844 | single-stranded-DNA-specific exonuclease RecJ (recJ) [3.1.—.—] |
| ORF03423 | 6845 & 6846 | Thiol:disulfide interchange protein dsbC precursor (DsbC) [5.3.4.1] |
| ORF03424 | 6847 & 6848 | tyrosine recombinase XerD (xerD) |
| ORF03425 | 6849 & 6850 | flavodoxin |
| ORF03426 | 6851 & 6852 | unnamed protein product |
| ORF03427 | 6853 & 6854 | Uncharacterized conserved protein |
| ORF03428 | 6855 & 6856 | Predicted aminomethyltransferase |
| ORF03429 | 6857 & 6858 | similar to hemolysin III homolog |
| ORF03430 | 6859 & 6860 | UPF0267 protein |
| ORF03431 | 6861 & 6862 | 6-phospho-beta-glucosidase |
| ORF03432 | 6863 & 6864 | glycine dehydrogenase (gcvP) [1.4.4.2] |
| ORF03433 | 6865 & 6866 | glycine cleavage system H protein (gcvH) |
| ORF03434 | 6867 & 6868 | glycine cleavage system T protein (gcvT) [2.1.2.10] |
| ORF03435 | 6869 & 6870 | Protein visC [1.—.—.—] |
| ORF03436 | 6871 & 6872 | 2-polyprenyl-6-methoxyphenol 4-hydroxylase (ubiH) [1.14.13.—] |
| ORF03437 | 6873 & 6874 | Xaa-Pro aminopeptidase (APP-II) [3.4.11.9] |
| ORF03438 | 6875 & 6876 | yecA family protein subfamily |
| ORF03439 | 6877 & 6878 | Family of unknown function (DUF710) superfamily |
| ORF03440 | 6879 & 6880 | 5-formyltetrahydrofolate cyclo-ligase family protein, putative |
| ORF03441 | 6881 & 6882 | D-3-phosphoglycerate dehydrogenase [1.1.1.95] |
| ORF03442 | 6883 & 6884 | ribose 5-phosphate isomerase A (rpiA) [5.3.1.6] |
| ORF03443 | 6885 & 6886 | conserved hypothetical protein |
| ORF03444 | 6887 & 6888 | Chromosome initiation inhibitor |
| ORF03445 | 6889 & 6890 | unnamed protein product; sbm orf (MCM) |
| ORF03446 | 6891 & 6892 | putative transcriptional regulator LYSR-type |
| ORF03447 | 6893 & 6894 | IpgG, putative |
| ORF03448 | 6895 & 6896 | possible membrane transport protein |
| ORF03449 | 6897 & 6898 | small-conductance mechanosensitive channel |
| ORF03450 | 6899 & 6900 | fructose-bisphosphate aldolase, class II (fbaA) [4.1.2.13] |
| ORF03451 | 6901 & 6902 | phosphoglycerate kinase (pgk) [2.7.2.3] |
| ORF03452 | 6903 & 6904 | D-erythrose-4-phosphate dehydrogenase (epd) [1.2.1.—] |
| ORF03453 | 6905 & 6906 | hypothetical protein |
| ORF03454 | 6907 & 6908 | Domain of unknown function (DUF296) family |
| ORF03455 | 6909 & 6910 | conserved hypothetical protein |
| ORF03456 | 6911 & 6912 | conserved hypothetical protein |
| ORF03457 | 6913 & 6914 | ABC transporter, ATP-binding protein |
| ORF03458 | 6915 & 6916 | kinase-related protein |
| ORF03459 | 6917 & 6918 | Cobalt transport ATP-binding protein cbiO |
| ORF03460 | 6919 & 6920 | unnamed protein product; ORF2 (AA 1-133) |
| ORF03461 | 6921 & 6922 | fructose-1,6-bisphosphatase, class II |
| ORF03462 | 6923 & 6924 | Putative oxidoreductase |

TABLE 1-continued

Annotation of ORF00001 to ORF04995

| ORFnnnnn | SEQ ID NOs | Annotation |
|---|---|---|
| ORF03463 | 6925 & 6926 | PTS system, mannitol (Cryptic) [2.7.1.69] |
| ORF03464 | 6927 & 6928 | PTS system, mannitol (Cryptic)-specific IIA component (EIIA-(C)Mtl)(Mannitol (Cryptic)-permease IIA component) (Phosphotranferase enzymeII, A component) (Cryptic) [2.7.1.69] |
| ORF03465 | 6929 & 6930 | putative serine protease |
| ORF03466 | 6931 & 6932 | transketolase (tkt) [2.2.1.1] |
| ORF03467 | 6933 & 6934 | Putative metalloprotease yggG |
| ORF03468 | 6935 & 6936 | agmatinase, putative [3.5.3.11] |
| ORF03469 | 6937 & 6938 | lipoprotein, putative |
| ORF03470 | 6939 & 6940 | arginine decarboxylase (speA) [4.1.1.19] |
| ORF03471 | 6941 & 6942 | conserved hypothetical protein |
| ORF03472 | 6943 & 6944 | conserved hypothetical protein |
| ORF03473 | 6945 & 6946 | S-adenosylmethionine synthetase (metK) [2.5.1.6] |
| ORF03474 | 6947 & 6948 | Galactose-proton symporter |
| ORF03475 | 6949 & 6950 | Protein sprT |
| ORF03476 | 6951 & 6952 | Endonuclease I precursor |
| ORF03477 | 6953 & 6954 | conserved hypothetical protein TIGR00046 |
| ORF03478 | 6955 & 6956 | glutathione synthase (gshB) [6.3.2.3] |
| ORF03479 | 6957 & 6958 | Uncharacterized ACR, COG1678 |
| ORF03480 | 6959 & 6960 | conserved hypothetical protein TIGR00250 |
| ORF03481 | 6961 & 6962 | Predicted ATPases involved in pili biogenesis, PilT homologs |
| ORF03482 | 6963 & 6964 | conserved hypothetical protein TIGR00044 |
| ORF03483 | 6965 & 6966 | Predicted integral membrane protein |
| ORF03484 | 6967 & 6968 | conserved hypothetical protein TIGR00251 |
| ORF03485 | 6969 & 6970 | non-canonical purine NTP pyrophosphatase, rdgB-HAM1 family (rdgB) |
| ORF03486 | 6971 & 6972 | oxygen-independent coproporphyrinogen III oxidase, putative |
| ORF03487 | 6973 & 6974 | Protein of unknown function (DUF1202) superfamily |
| ORF03488 | 6975 & 6976 | L-asparaginase II (ansB) [3.5.1.1] |
| ORF03489 | 6977 & 6978 | conserved hypothetical protein |
| ORF03490 | 6979 & 6980 | conserved hypothetical protein |
| ORF03491 | 6981 & 6982 | Protein |
| ORF03492 | 6983 & 6984 | tRNA (guanine-N(7)-)-methyltransferase (tRNA(m7G46)-methyltransferase) [2.1.1.33] |
| ORF03493 | 6985 & 6986 | A-G-specific adenine glycosylase |
| ORF03494 | 6987 & 6988 | Protein yggX |
| ORF03495 | 6989 & 6990 | yggZ protein (mltC) [3.2.1.—] |
| ORF03496 | 6991 & 6992 | nucleoside permease NupG |
| ORF03497 | 6993 & 6994 | ornithine decarboxylase isozyme (speC) [4.1.1.17] |
| ORF03498 | 6995 & 6996 | integral membrane protein |
| ORF03499 | 6997 & 6998 | transposase, truncated |
| ORF03500 | 6999 & 7000 | KpsF |
| ORF03501 | 7001 & 7002 | Capsule polysaccharide export inner-membrane protein kpsE |
| ORF03502 | 7003 & 7004 | polysaccharide biosynthesis protein, putative |
| ORF03503 | 7005 & 7006 | 3-deoxy-D-manno-octulosonate cytidylyltransferase (kdsB) [2.7.7.38] |
| ORF03504 | 7007 & 7008 | capsule polysaccharide export protein kpsC |
| ORF03505 | 7009 & 7010 | KpsS protein |
| ORF03506 | 7011 & 7012 | polysialic acid capsule biosynthesis protein SiaD, truncation; disrupted by foreign ermC, putative [2.4.—.—] |
| ORF03507 | 7013 & 7014 | NeuE protein |
| ORF03508 | 7015 & 7016 | UDP-N-acetylglucosamine 2-epimerase [5.1.3.14] |
| ORF03509 | 7017 & 7018 | acylneuraminate cytidylyltransferase, putative [2.7.7.43] |
| ORF03510 | 7019 & 7020 | neuB protein [4.1.3.—] |
| ORF03511 | 7021 & 7022 | Polysialic acid transport ATP-binding protein kpsT [3.6.3.38] |
| ORF03512 | 7023 & 7024 | Polysialic acid transport protein kpsM |
| ORF03513 | 7025 & 7026 | Putative general secretion pathway protein M-type yghD |
| ORF03514 | 7027 & 7028 | general secretion pathway protein L (gspL) |
| ORF03515 | 7029 & 7030 | General secretion pathway protein K (gspK) |
| ORF03516 | 7031 & 7032 | general secretion pathway protein J (gspJ) |
| ORF03517 | 7033 & 7034 | general secretion pathway protein I (gspI) |
| ORF03518 | 7035 & 7036 | GspH, hypothetical type II secretion protein |
| ORF03519 | 7037 & 7038 | general secretion pathway protein G (gspG) |
| ORF03520 | 7039 & 7040 | general secretion pathway protein F (gspF) |
| ORF03521 | 7041 & 7042 | general secretion pathway protein E (GSP) |
| ORF03522 | 7043 & 7044 | type II secretory pathway, component EpsD |
| ORF03523 | 7045 & 7046 | general secretion pathway protein C (gspC) |
| ORF03524 | 7047 & 7048 | YghG protein |
| ORF03525 | 7049 & 7050 | secretion protein b2972 [3.4.23.43] |
| ORF03526 | 7051 & 7052 | Accessory colonization factor AcfD precursor |
| ORF03527 | 7053 & 7054 | Glycolate permease glcA |
| ORF03528 | 7055 & 7056 | malate synthase G (glcB) [2.3.3.9] |
| ORF03529 | 7057 & 7058 | glcG protein |
| ORF03530 | 7059 & 7060 | glycolate oxidase subunits GlcE and GlcF (Fe—S) [1.1.3.15] |
| ORF03531 | 7061 & 7062 | glycolate oxidase subunits GlcE and GlcF |
| ORF03532 | 7063 & 7064 | glycolate oxidase, subunit GlcD (glcD) |
| ORF03533 | 7065 & 7066 | Glc operon transcriptional activator |
| ORF03534 | 7067 & 7068 | conserved hypothetical protein |

TABLE 1-continued

Annotation of ORF00001 to ORF04995

| ORFnnnnn | SEQ ID NOs | Annotation |
| --- | --- | --- |
| ORF03535 | 7069 & 7070 | acyl-CoA synthase |
| ORF03536 | 7071 & 7072 | conserved hypothetical protein |
| ORF03537 | 7073 & 7074 | Phosphopantetheine attachment site (ACP) |
| ORF03538 | 7075 & 7076 | 8-amino-7-oxononanoate synthase |
| ORF03539 | 7077 & 7078 | Predicted permease YjgP-YjgQ family superfamily |
| ORF03540 | 7079 & 7080 | Predicted permease YjgP-YjgQ family superfamily |
| ORF03541 | 7081 & 7082 | conserved hypothetical protein YtfJ-family, TIGR01626 |
| ORF03542 | 7083 & 7084 | conserved hypothetical protein |
| ORF03543 | 7085 & 7086 | Polysaccharide biosynthesis protein domain protein |
| ORF03544 | 7087 & 7088 | Hypothetical ATP-binding protein yghR |
| ORF03545 | 7089 & 7090 | Hypothetical ATP-binding protein yghS |
| ORF03546 | 7091 & 7092 | hypothetical protein |
| ORF03547 | 7093 & 7094 | Hypothetical ATP-binding protein yghT |
| ORF03548 | 7095 & 7096 | low-affinity phosphate transport protein |
| ORF03549 | 7097 & 7098 | Glutathionylspermidine synthase |
| ORF03550 | 7099 & 7100 | Hypothetical GST-like protein yghU |
| ORF03551 | 7101 & 7102 | hydrogenase assembly chaperone HypC-HupF (hypC) |
| ORF03552 | 7103 & 7104 | hydrogenase nickel insertion protein HypA (hypA) |
| ORF03553 | 7105 & 7106 | Hydrogenase-2 operon protein hybE |
| ORF03554 | 7107 & 7108 | hydrogenase expression-formation protein |
| ORF03555 | 7109 & 7110 | hydrogenase-2 large subunit HybC [1.18.99.1] |
| ORF03556 | 7111 & 7112 | cytochrome Ni—Fe component of hydrogenase-2 |
| ORF03557 | 7113 & 7114 | Hydrogenase-2 operon protein hybA precursor |
| ORF03558 | 7115 & 7116 | Hydrogenase-2 small chain precursor (NiFe hydrogenase)(Membrane-bound hydrogenase 2 small subunit) (HYD2) (hydA) [1.12.99.6] |
| ORF03559 | 7117 & 7118 | conserved hypothetical protein |
| ORF03560 | 7119 & 7120 | dienelactone hydrolase family protein |
| ORF03561 | 7121 & 7122 | oxidoreductase, aldo-keto reductase family |
| ORF03562 | 7123 & 7124 | conserved hypothetical protein TIGR00645 |
| ORF03563 | 7125 & 7126 | oxidoreductase, short chain dehydrogenase-reductase family [1.—.—.—] |
| ORF03564 | 7127 & 7128 | Biopolymer transport exbD protein |
| ORF03565 | 7129 & 7130 | biopolymer transport ExbB protein (uptake) |
| ORF03566 | 7131 & 7132 | cystathionine beta-lyase (metC) [4.4.1.8] |
| ORF03567 | 7133 & 7134 | unnamed protein product; Similar to DedA-family integral membrane protein YghB of Escherichia coli |
| ORF03568 | 7135 & 7136 | transcriptional regulator, AraC family |
| ORF03569 | 7137 & 7138 | uncharacterized oxidoreductase |
| ORF03570 | 7139 & 7140 | oxidoreductase, aldo-keto reductase family [1.1.1.274] |
| ORF03571 | 7141 & 7142 | conserved hypothetical protein |
| ORF03572 | 7143 & 7144 | major outer membrane lipoprotein |
| ORF03573 | 7145 & 7146 | radical SAM domain protein protein |
| ORF03574 | 7147 & 7148 | regulator for uxu operon |
| ORF03575 | 7149 & 7150 | Hypothetical oxidoreductase ydfI |
| ORF03576 | 7151 & 7152 | 2,3-butanediol dehydrogenase, putative [1.1.1.14] |
| ORF03577 | 7153 & 7154 | Ureidoglycolate dehydrogenase [1.1.1.—] |
| ORF03578 | 7155 & 7156 | TRAP-type C4-dicarboxylate transport system, periplasmic component (AP001509) |
| ORF03579 | 7157 & 7158 | unnamed protein product |
| ORF03580 | 7159 & 7160 | TRAP dicarboxylate transporter, DctM subunit |
| ORF03581 | 7161 & 7162 | suppressor of ftsI |
| ORF03582 | 7163 & 7164 | 1-acyl-sn-glycerol-3-phosphate acyltransferase (LPAAT) [2.3.1.51] |
| ORF03583 | 7165 & 7166 | DNA topoisomerase IV, A subunit (parC) [5.99.1.—] |
| ORF03584 | 7167 & 7168 | ABC superfamily (periplasm), oligopeptide transport protein with |
| ORF03585 | 7169 & 7170 | transcriptional regulator, AraC family |
| ORF03586 | 7171 & 7172 | conserved hypothetical protein TIGR00156 |
| ORF03587 | 7173 & 7174 | Transcriptional Regulatory protein qseB |
| ORF03588 | 7175 & 7176 | Sensor protein qseC [2.7.3.—] |
| ORF03589 | 7177 & 7178 | unnamed protein product; Similar to Hcp protein |
| ORF03590 | 7179 & 7180 | NAD(P)H quinone oxidoreductase, putative |
| ORF03591 | 7181 & 7182 | Protein ygiN |
| ORF03592 | 7183 & 7184 | SIS domain protein |
| ORF03593 | 7185 & 7186 | Putative iron compound-binding protein of ABC transporter |
| ORF03594 | 7187 & 7188 | iron compound ABC transporter, permease protein (III) |
| ORF03595 | 7189 & 7190 | ferric exochelin uptake (fxuC) |
| ORF03596 | 7191 & 7192 | ferric exochelin uptake (fxuB) |
| ORF03597 | 7193 & 7194 | Putative iron compound receptor |
| ORF03598 | 7195 & 7196 | DNA topoisomerase IV, B subunit (parE) [5.99.1.—] |
| ORF03599 | 7197 & 7198 | Predicted esterase |
| ORF03600 | 7199 & 7200 | Icc protein |
| ORF03601 | 7201 & 7202 | Protein of unknown function (DUF1249) superfamily |
| ORF03602 | 7203 & 7204 | conserved hypothetical protein TIGR00052 |
| ORF03603 | 7205 & 7206 | outer membrane channel specific tolerance to colicin |
| ORF03604 | 7207 & 7208 | conserved hypothetical protein |
| ORF03605 | 7209 & 7210 | glutathionylspermidine synthase (O386) |
| ORF03606 | 7211 & 7212 | arylsulfate sulfotransferase |
| ORF03607 | 7213 & 7214 | Thiol:disulfide interchange protein dsbA-like precursor [5.3.4.1] |
| ORF03608 | 7215 & 7216 | disulfide bond formation protein B (dsbB) [1.8.4.—] |

TABLE 1-continued

Annotation of ORF00001 to ORF04995

| ORFnnnnn | SEQ ID NOs | Annotation |
| --- | --- | --- |
| ORF03609 | 7217 & 7218 | Catalytic LigB subunit of aromatic ring-opening dioxygenase superfamily |
| ORF03610 | 7219 & 7220 | hypothetical protein |
| ORF03611 | 7221 & 7222 | Zinc transporter zupT |
| ORF03612 | 7223 & 7224 | conserved hypothetical protein |
| ORF03613 | 7225 & 7226 | fimbrial protein |
| ORF03614 | 7227 & 7228 | outer membrane fimbrial usher porin |
| ORF03615 | 7229 & 7230 | OUTER MEMBRANE USHER PROTEIN PMFC PRECURSOR. |
| ORF03616 | 7231 & 7232 | Hypothetical fimbrial chaperone yqiH precursor |
| ORF03617 | 7233 & 7234 | ybgO protein |
| ORF03618 | 7235 & 7236 | 3,4-dihydroxy-2-butanone 4-phosphate synthase (ribB) |
| ORF03619 | 7237 & 7238 | Protein of unknown function (DUF526) family |
| ORF03620 | 7239 & 7240 | glycogen biosynthesis, rpoS dependent-related protein |
| ORF03621 | 7241 & 7242 | YgiJ |
| ORF03622 | 7243 & 7244 | Uncharacterized BCR, putative |
| ORF03623 | 7245 & 7246 | ADP-heptose synthase [2.7.—.—] |
| ORF03624 | 7247 & 7248 | Glutamate-ammonia-ligase adenylyltransferase |
| ORF03625 | 7249 & 7250 | Adenylate cyclase, putative |
| ORF03626 | 7251 & 7252 | conserved hypothetical protein |
| ORF03627 | 7253 & 7254 | tRNA nucleotidyl transferase |
| ORF03628 | 7255 & 7256 | undecaprenol kinase, putative [2.7.1.66] |
| ORF03629 | 7257 & 7258 | dihydroneopterin aldolase (folB) [4.1.2.25] |
| ORF03630 | 7259 & 7260 | conserved hypothetical protein TIGR00023 |
| ORF03631 | 7261 & 7262 | LysR family regulatory protein |
| ORF03632 | 7263 & 7264 | hypothetical protein |
| ORF03633 | 7265 & 7266 | fumarase (fumarase) [4.2.1.32] |
| ORF03634 | 7267 & 7268 | fumarate hydratase, class I, putative [4.2.1.32] |
| ORF03635 | 7269 & 7270 | DASS family, citrate:succinate transport (antiport) |
| ORF03636 | 7271 & 7272 | O-sialoglycoprotein endopeptidase (gcp) [3.4.24.57] |
| ORF03637 | 7273 & 7274 | 30S ribosomal protein S21-related protein |
| ORF03638 | 7275 & 7276 | DNA primase [2.7.7.—] |
| ORF03639 | 7277 & 7278 | sigma D factor of RNA polymerase |
| ORF03640 | 7279 & 7280 | sigma D factor of RNA polymerase |
| ORF03641 | 7281 & 7282 | G-U mismatch-specific DNA glycosylase (Mismatch-specificuracil DNA-glycosylase) (UDG) [3.2.2.—] |
| ORF03642 | 7283 & 7284 | iron-chelator utilization protein |
| ORF03643 | 7285 & 7286 | transcriptional regulator, PadR family |
| ORF03644 | 7287 & 7288 | Aerotaxis receptor |
| ORF03645 | 7289 & 7290 | ornithine aminotransferase (rocD) [2.6.1.13] |
| ORF03646 | 7291 & 7292 | tRNA-binding protein ygjH (mets) [6.1.1.10] |
| ORF03647 | 7293 & 7294 | galactose operon repressor galR |
| ORF03648 | 7295 & 7296 | Evolved beta-galactosidase alpha-subunit |
| ORF03649 | 7297 & 7298 | EGB enzyme beta subunit [3.2.1.23] |
| ORF03650 | 7299 & 7300 | probable oxidoreductase ygjI |
| ORF03651 | 7301 & 7302 | conserved hypothetical protein |
| ORF03652 | 7303 & 7304 | conserved hypothetical protein |
| ORF03653 | 7305 & 7306 | 2,4-dienoyl-coA reductase [1.—.—.—] |
| ORF03654 | 7307 & 7308 | 2.1.1.52 [2.1.1.52] |
| ORF03655 | 7309 & 7310 | conserved hypothetical protein |
| ORF03656 | 7311 & 7312 | sanA protein |
| ORF03657 | 7313 & 7314 | oxidoreductase [1.—.—.—] |
| ORF03658 | 7315 & 7316 | Alx protein |
| ORF03659 | 7317 & 7318 | Sodium:dicarboxylate symporter family superfamily |
| ORF03660 | 7319 & 7320 | conserved hypothetical protein |
| ORF03661 | 7321 & 7322 | Altronate hydrolase [4.2.1.7] |
| ORF03662 | 7323 & 7324 | Glucuronate isomerase (uxaC) [5.3.1.12] |
| ORF03663 | 7325 & 7326 | major facilitator family transporter, putative |
| ORF03664 | 7327 & 7328 | Exu regulon transcriptional regulator |
| ORF03665 | 7329 & 7330 | unnamed protein product; Similar to DedA-family integral membrane protein YghB of *Escherichia coli* |
| ORF03666 | 7331 & 7332 | conserved hypothetical protein |
| ORF03667 | 7333 & 7334 | Protein ygjC precursor [3.4.24.13] |
| ORF03668 | 7335 & 7336 | Bacterial protein of unknown function (DUF883) superfamily |
| ORF03669 | 7337 & 7338 | conserved hypothetical protein |
| ORF03670 | 7339 & 7340 | conserved hypothetical protein |
| ORF03671 | 7341 & 7342 | predicted membrane protein |
| ORF03672 | 7343 & 7344 | Glutathione S-transferase C terminus (O328) |
| ORF03673 | 7345 & 7346 | Protein of unknown function (DUF805) superfamily |
| ORF03674 | 7347 & 7348 | lysR-family transcription regulatory protein YPO3545 |
| ORF03675 | 7349 & 7350 | Uncharacterized BCR, YhhW family COG1741 family |
| ORF03676 | 7351 & 7352 | conserved hypothetical protein |
| ORF03677 | 7353 & 7354 | Protein of unknown function (DUF1063) superfamily |
| ORF03678 | 7355 & 7356 | putative transport system permease protein |
| ORF03679 | 7357 & 7358 | L-serine ammonia-lyase (sdaA) [4.3.1.17] |
| ORF03680 | 7359 & 7360 | endoribonuclease L-PSP, putative |
| ORF03681 | 7361 & 7362 | formate acetyltransferase (pflB) [2.3.1.54] |
| ORF03682 | 7363 & 7364 | acetate kinase (ackA) [2.7.2.1] |

TABLE 1-continued

Annotation of ORF00001 to ORF04995

| ORFnnnnn | SEQ ID NOs | Annotation |
| --- | --- | --- |
| ORF03683 | 7365 & 7366 | Threonine-serine transporter |
| ORF03684 | 7367 & 7368 | Threonine dehydratase catabolic (Threonine deaminase) (tdcB) [4.3.1.19] |
| ORF03685 | 7369 & 7370 | transcriptional regulator, LysR family, putative [4.2.1.16] |
| ORF03686 | 7371 & 7372 | Glycerate kinase 2 |
| ORF03687 | 7373 & 7374 | 2-hydroxy-3-oxopropionate reductase [1.1.1.60] |
| ORF03688 | 7375 & 7376 | 2-dehydro-3-deoxyglucarate aldolase (ptpA) [4.1.2.20] |
| ORF03689 | 7377 & 7378 | MFS transporter, phthalate permease family |
| ORF03690 | 7379 & 7380 | D-galactarate dehydratase (GalcD) [4.2.1.42] |
| ORF03691 | 7381 & 7382 | DeoR-family regulatory protein (srl) |
| ORF03692 | 7383 & 7384 | PUTATIVE TAGATOSE 6-PHOSPHATE KINASE PROTEIN |
| ORF03693 | 7385 & 7386 | N-acetylgalactosamine-specific PTS system enzyme IIB component (EIIB-AGA) [2.7.1.69] |
| ORF03694 | 7387 & 7388 | N-acetylgalactosameine-specific IIC component 2 |
| ORF03695 | 7389 & 7390 | PTS system, N-acetylgalactosamine-specific IID component |
| ORF03696 | 7391 & 7392 | AgaF [2.7.1.69] |
| ORF03697 | 7393 & 7394 | N-acetylglucosamine-6-phosphate deacetylase (nagA) [3.5.1.25] |
| ORF03698 | 7395 & 7396 | sugar isomerase domain protein AgaS [5.—.—.—] |
| ORF03699 | 7397 & 7398 | class II aldolase, tagatose bisphosphate family [4.1.2.—] |
| ORF03700 | 7399 & 7400 | PTS system, N-acetylgalactosamine-specific IIB component 1 (EIIB-Aga)(N-acetylgalactosamine-permease IIB component 1) (Phosphotransferaseenzyme II, B component 1) (EIIB-AGA) [2.7.1.69] |
| ORF03701 | 7401 & 7402 | PTS system, N-acetylgalactosamine-specific IIC component 1 (EIIC-Aga)(N-acetylgalactosamine-permease IIC component 1) |
| ORF03702 | 7403 & 7404 | PTS system, N-acetylgalactosamine-specific IID component (EIID-AGA) |
| ORF03703 | 7405 & 7406 | glucosamine-6-phosphate isomerase, putative [5.3.1.—] |
| ORF03704 | 7407 & 7408 | conserved hypothetical protein TIGR00096 |
| ORF03705 | 7409 & 7410 | LppC |
| ORF03706 | 7411 & 7412 | conserved hypothetical protein TIGR00252 |
| ORF03707 | 7413 & 7414 | phosphoheptose isomerase (gmhA) |
| ORF03708 | 7415 & 7416 | Putative phospholipid-binding domain family |
| ORF03709 | 7417 & 7418 | Predicted permease superfamily |
| ORF03710 | 7419 & 7420 | conserved hypothetical protein |
| ORF03711 | 7421 & 7422 | unnamed protein product |
| ORF03712 | 7423 & 7424 | protease I |
| ORF03713 | 7425 & 7426 | ACETYLTRANSFERASE [2.3.1.—] |
| ORF03714 | 7427 & 7428 | predicted endonuclease |
| ORF03715 | 7429 & 7430 | SCP-2 sterol transfer family family |
| ORF03716 | 7431 & 7432 | collagenase |
| ORF03717 | 7433 & 7434 | peptidase, U32 family family [3.4.—.—] |
| ORF03718 | 7435 & 7436 | flavin dependant oxidoreductase |
| ORF03719 | 7437 & 7438 | Tryptophan-specific transport protein |
| ORF03720 | 7439 & 7440 | ATP-dependent RNA helicase DeaD |
| ORF03721 | 7441 & 7442 | Lipoprotein nlpI precursor |
| ORF03722 | 7443 & 7444 | Polyribonucleotide nucleotidyltransferase (CAP87K) |
| ORF03723 | 7445 & 7446 | ribosomal protein S15 (rpsO) |
| ORF03724 | 7447 & 7448 | tRNA pseudouridine synthase B [4.2.1.70] |
| ORF03725 | 7449 & 7450 | ribosome-binding factor A (rbfA) |
| ORF03726 | 7451 & 7452 | Translation initiation factor IF-2 |
| ORF03727 | 7453 & 7454 | Transcription elongation protein nusA (N utilization substance proteinA) (L factor) (nusA) |
| ORF03728 | 7455 & 7456 | YhbC-like protein |
| ORF03729 | 7457 & 7458 | argininosuccinate synthase (argG) [6.3.4.5] |
| ORF03730 | 7459 & 7460 | Outer-membrane protein yhbX precursor |
| ORF03731 | 7461 & 7462 | Protein-export membrane protein secG |
| ORF03732 | 7463 & 7464 | phosphoglucosamine mutase (glmM) [5.4.2.—] |
| ORF03733 | 7465 & 7466 | dihydropteroate synthase (folP) [2.5.1.15] |
| ORF03734 | 7467 & 7468 | ATP-binding protein [3.4.24.—] |
| ORF03735 | 7469 & 7470 | ribosomal RNA large subunit methyltransferase J (rrmJ) [2.1.1.—] |
| ORF03736 | 7471 & 7472 | conserved hypothetical protein TIGR00253 |
| ORF03737 | 7473 & 7474 | Transcription elongation factor greA (Transcript cleavage factorgreA) (greA) |
| ORF03738 | 7475 & 7476 | D-alanyl-D-alanine carboxypeptidase-D-alanyl-D-alanine-endopeptidase (dacB) [3.4.16.4] |
| ORF03739 | 7477 & 7478 | Obg protein (Obg) |
| ORF03740 | 7479 & 7480 | Obg protein (F390) |
| ORF03741 | 7481 & 7482 | RhaT protein |
| ORF03742 | 7483 & 7484 | RhaT protein |
| ORF03743 | 7485 & 7486 | ribosomal protein L27 (rpmA) |
| ORF03744 | 7487 & 7488 | 50S ribosomal protein L21 |
| ORF03745 | 7489 & 7490 | conserved hypothetical protein |
| ORF03746 | 7491 & 7492 | RhaT protein |
| ORF03747 | 7493 & 7494 | ribosomal protein L27 (rpmA) |
| ORF03748 | 7495 & 7496 | 50S ribosomal protein L21 |
| ORF03749 | 7497 & 7498 | ribosomal protein L21 (rplU) |
| ORF03750 | 7499 & 7500 | conserved hypothetical protein |
| ORF03751 | 7501 & 7502 | Octaprenyl-diphosphate synthase (Octaprenyl pyrophosphatesynthetase) (OPP synthetase) [2.5.1.—] |

TABLE 1-continued

Annotation of ORF00001 to ORF04995

| ORFnnnnn | SEQ ID NOs | Annotation |
|---|---|---|
| ORF03752 | 7503 & 7504 | Sugar fermentation stimulation protein B (Ner-like protein) |
| ORF03753 | 7505 & 7506 | UDP-N-acetylglucosamine 1-carboxyvinyltransferase (murA) [2.5.1.7] |
| ORF03754 | 7507 & 7508 | BolA-like protein |
| ORF03755 | 7509 & 7510 | conserved hypothetical protein |
| ORF03756 | 7511 & 7512 | Protein yrbC precursor (Ttg2D) |
| ORF03757 | 7513 & 7514 | conserved hypothetical protein |
| ORF03758 | 7515 & 7516 | VpsC |
| ORF03759 | 7517 & 7518 | unnamed protein product; Highly similar to ABC transporter, permease protein YrbE of *Escherichia coli* |
| ORF03760 | 7519 & 7520 | ABC transporter, ATP-binding protein (atp_bind) |
| ORF03761 | 7521 & 7522 | K+-dependent Na+-Ca+ exchanger related-protein |
| ORF03762 | 7523 & 7524 | hypothetical protein |
| ORF03763 | 7525 & 7526 | conserved hypothetical protein |
| ORF03764 | 7527 & 7528 | putative isomerase |
| ORF03765 | 7529 & 7530 | 3-deoxy-D-manno-octulosonate 8-phosphate phosphatase(KDO 8-P phosphatase) [3.1.3.45] |
| ORF03766 | 7531 & 7532 | unnamed protein product; Similar to YrbK precursor protein of *Escherichia coli* |
| ORF03767 | 7533 & 7534 | OstA-like protein family |
| ORF03768 | 7535 & 7536 | ABC transporter, ATP-binding component |
| ORF03769 | 7537 & 7538 | RNA polymerase sigma-54 factor (rpoN) |
| ORF03770 | 7539 & 7540 | ribosomal subunit interface protein (yfiA) |
| ORF03771 | 7541 & 7542 | PTS IIA-like nitrogen-regulatory protein PtsN (ptsN) |
| ORF03772 | 7543 & 7544 | unnamed protein product; ORF193 peptide fragment (AA 1-192) (1524 is 2nd base in codon) |
| ORF03773 | 7545 & 7546 | phosphocarrier protein (NPr) |
| ORF03774 | 7547 & 7548 | conserved hypothetical protein |
| ORF03775 | 7549 & 7550 | monofunctional biosynthetic peptidoglycan transglycosylase (mtgA) [2.4.2.—] |
| ORF03776 | 7551 & 7552 | sigma cross-reacting protein 27A (SCRP-27A) |
| ORF03777 | 7553 & 7554 | Aerobic respiration control sensor protein arcB [2.7.3.—] |
| ORF03778 | 7555 & 7556 | radical SAM protein, TIGR01212 family |
| ORF03779 | 7557 & 7558 | hypothetical protein |
| ORF03780 | 7559 & 7560 | Glutamate synthase [NADPH] large chain precursor [1.4.1.13] |
| ORF03781 | 7561 & 7562 | glutamate synthase (NADPH) small chain (NADPH) [1.4.1.13] |
| ORF03782 | 7563 & 7564 | conserved hypothetical protein subfamily |
| ORF03783 | 7565 & 7566 | ROK family protein domain protein, putative |
| ORF03784 | 7567 & 7568 | N-acetylmannosamine-6-phosphate 2-epimerase-N-acetylmannosamine kinase |
| ORF03785 | 7569 & 7570 | cis,cis-muconate transport protein MucK, putative |
| ORF03786 | 7571 & 7572 | N-acetylneuraminate lyase (nanA) [4.1.3.3] |
| ORF03787 | 7573 & 7574 | transcriptional regulator, GntR family, putative |
| ORF03788 | 7575 & 7576 | stringent starvation protein B (sspB) |
| ORF03789 | 7577 & 7578 | Stringent starvation protein A (Ssp) |
| ORF03790 | 7579 & 7580 | ribosomal protein S9 (rpsI) |
| ORF03791 | 7581 & 7582 | ribosomal protein L13 (rplM) |
| ORF03792 | 7583 & 7584 | Predicted ATPase |
| ORF03793 | 7585 & 7586 | Protein of unknown function (DUF1043) superfamily |
| ORF03794 | 7587 & 7588 | Protease degQ precursor |
| ORF03795 | 7589 & 7590 | periplasmic serine protease DegS (degS) [3.4.21.—] |
| ORF03796 | 7591 & 7592 | malate dehydrogenase, NAD-dependent (mdh) [1.1.1.37] |
| ORF03797 | 7593 & 7594 | arginine repressor (argR) |
| ORF03798 | 7595 & 7596 | Protein of unknown function (DUF1471) superfamily |
| ORF03799 | 7597 & 7598 | unnamed protein product; Similar to ribonuclease inhibitor (barstar) |
| ORF03800 | 7599 & 7600 | Fusaric acid resistance protein conserved region family |
| ORF03801 | 7601 & 7602 | fusaric acid resistance protein |
| ORF03802 | 7603 & 7604 | conserved hypothetical protein |
| ORF03803 | 7605 & 7606 | conserved hypothetical protein |
| ORF03804 | 7607 & 7608 | Transcriptional regulator |
| ORF03805 | 7609 & 7610 | TldD protein (CSRA) |
| ORF03806 | 7611 & 7612 | conserved hypothetical protein TIGR02099 |
| ORF03807 | 7613 & 7614 | bundles of cytoplasmic filaments |
| ORF03808 | 7615 & 7616 | maf protein (maf) |
| ORF03809 | 7617 & 7618 | rod shape-determining protein MreD (mreD) |
| ORF03810 | 7619 & 7620 | Rod shape-determining protein mreC (mreC) |
| ORF03811 | 7621 & 7622 | Rod shape-determining protein mreC (mreC) |
| ORF03812 | 7623 & 7624 | regulator of ftsI |
| ORF03813 | 7625 & 7626 | EAL domain protein |
| ORF03814 | 7627 & 7628 | Protein yhdH |
| ORF03815 | 7629 & 7630 | acetyl-CoA carboxylase, biotin carboxyl carrier protein (accB) |
| ORF03816 | 7631 & 7632 | acetyl-CoA carboxylase, biotin carboxylase (accC) [6.4.1.2] |
| ORF03817 | 7633 & 7634 | conserved hypothetical protein |
| ORF03818 | 7635 & 7636 | conserved hypothetical protein |
| ORF03819 | 7637 & 7638 | fructokinase (AB010074) [2.7.1.—] |
| ORF03820 | 7639 & 7640 | ribose ABC transporter, permease protein (permease) |
| ORF03821 | 7641 & 7642 | Ribose transport ATP-binding protein rbsA (aldose) |
| ORF03822 | 7643 & 7644 | periplasmic ribose-binding protein |
| ORF03823 | 7645 & 7646 | class II aldolase, tagatose bisphosphate family [4.1.2.—] |
| ORF03824 | 7647 & 7648 | conserved hypothetical protein |

TABLE 1-continued

Annotation of ORF00001 to ORF04995

| ORFnnnnn | SEQ ID NOs | Annotation |
|---|---|---|
| ORF03825 | 7649 & 7650 | aga operon transcriptional repressor (DeoR family) |
| ORF03826 | 7651 & 7652 | fructokinase (AB010074) [2.7.1.—] |
| ORF03827 | 7653 & 7654 | Protein of unknown function (DUF997) superfamily |
| ORF03828 | 7655 & 7656 | sodium-pantothenate symporter (panF) |
| ORF03829 | 7657 & 7658 | ribosomal protein L11 methyltransferase (prmA) [2.1.1.—] |
| ORF03830 | 7659 & 7660 | tRNA-dihydrouridine synthase B [1.—.—.—] |
| ORF03831 | 7661 & 7662 | DNA-binding protein fis (Factor-for-inversion stimulation protein)(HIN recombinational enhancer binding protein) (fis) |
| ORF03832 | 7663 & 7664 | ADENINE-SPECIFIC METHYLTRANSFERASE |
| ORF03833 | 7665 & 7666 | conserved hypothetical protein |
| ORF03834 | 7667 & 7668 | Potential acrEF-envCD operon repressor (acrEF) |
| ORF03835 | 7669 & 7670 | Acriflavine resistance protein E precursor |
| ORF03836 | 7671 & 7672 | Acriflavine resistance protein F |
| ORF03837 | 7673 & 7674 | lipoprotein, putative |
| ORF03838 | 7675 & 7676 | amino acid ABC transporter, periplasmic amino acid-binding protein |
| ORF03839 | 7677 & 7678 | L-amino acid ABC transporter permease protein |
| ORF03840 | 7679 & 7680 | L-amino acid ABC transporter permease protein |
| ORF03841 | 7681 & 7682 | L-amino acid ABC transporter ATP-binding protein |
| ORF03842 | 7683 & 7684 | glutamate decarboxylase [4.1.1.15] |
| ORF03843 | 7685 & 7686 | glutamate decarboxylase [4.1.1.15] |
| ORF03844 | 7687 & 7688 | unnamed protein product |
| ORF03845 | 7689 & 7690 | Protein yrdA |
| ORF03846 | 7691 & 7692 | shikimate 5-dehydrogenase (aroE) [1.1.1.25] |
| ORF03847 | 7693 & 7694 | Protein yrdC |
| ORF03848 | 7695 & 7696 | Protein smg |
| ORF03849 | 7697 & 7698 | Predicted Rossmann-fold nucleotide-binding protein involved in DNA |
| ORF03850 | 7699 & 7700 | peptide deformylase (def) [3.5.1.88] |
| ORF03851 | 7701 & 7702 | methionyl-tRNA formyltransferase (fmt) [2.1.2.9] |
| ORF03852 | 7703 & 7704 | sun protein (sun) [2.1.1.—] |
| ORF03853 | 7705 & 7706 | Trk system potassium uptake protein trkA (K(+)-uptake protein trkA) (trkA) |
| ORF03854 | 7707 & 7708 | large conductance mechanosensitive channel protein (mscL) |
| ORF03855 | 7709 & 7710 | Uncharacterized protein conserved in bacteria |
| ORF03856 | 7711 & 7712 | Zn(II)-responsive transcriptional regulator (zntR) |
| ORF03857 | 7713 & 7714 | conserved hypothetical protein |
| ORF03858 | 7715 & 7716 | ribosomal protein L17 (rplQ) |
| ORF03859 | 7717 & 7718 | DNA-directed RNA polymerase, alpha subunit (rpoA) [2.7.7.6] |
| ORF03860 | 7719 & 7720 | ribosomal protein S4 (rpsD) |
| ORF03861 | 7721 & 7722 | ribosomal protein S11 (rpsk) |
| ORF03862 | 7723 & 7724 | ribosomal protein S13p-S18e (rpsM) |
| ORF03863 | 7725 & 7726 | ribosomal protein L36 (rpmJ) |
| ORF03864 | 7727 & 7728 | preprotein translocase, SecY subunit |
| ORF03865 | 7729 & 7730 | Preprotein translocase secY subunit (secY) |
| ORF03866 | 7731 & 7732 | ribosomal protein L15 (rplO) |
| ORF03867 | 7733 & 7734 | ribosomal protein L30 (rpmD) |
| ORF03868 | 7735 & 7736 | ribosomal protein S5 (rpsE) |
| ORF03869 | 7737 & 7738 | ribosomal protein L18 (rplR) |
| ORF03870 | 7739 & 7740 | 50S ribosomal subunit protein L6 (rp1F) |
| ORF03871 | 7741 & 7742 | conserved hypothetical protein |
| ORF03872 | 7743 & 7744 | ribosomal protein S8 (rpsH) |
| ORF03873 | 7745 & 7746 | ribosomal protein S14p-S29e (rpsN) |
| ORF03874 | 7747 & 7748 | 50S ribosomal subunit protein L5 (rpL5) |
| ORF03875 | 7749 & 7750 | ribosomal protein L24 (rplX) |
| ORF03876 | 7751 & 7752 | ribosomal protein L14 (rplN) |
| ORF03877 | 7753 & 7754 | ribosomal protein S17 (rpsQ) |
| ORF03878 | 7755 & 7756 | ribosomal protein L29 (rpmC) |
| ORF03879 | 7757 & 7758 | ribosomal protein L16 (rplP) |
| ORF03880 | 7759 & 7760 | ribosomal protein S3 (rpsC) |
| ORF03881 | 7761 & 7762 | ribosomal protein L22 (rplV) |
| ORF03882 | 7763 & 7764 | ribosomal protein S19 (rpsS) |
| ORF03883 | 7765 & 7766 | ribosomal protein L2 (rplB) |
| ORF03884 | 7767 & 7768 | ribosomal protein L23 (rplW) |
| ORF03885 | 7769 & 7770 | ribosomal protein L4-L1 family (rplD) |
| ORF03886 | 7771 & 7772 | ribosomal protein L3 (rplC) |
| ORF03887 | 7773 & 7774 | ribosomal protein S10 (rpsJ) |
| ORF03888 | 7775 & 7776 | PioO protein (PinO protein) |
| ORF03889 | 7777 & 7778 | Probable general secretion pathway protein A (GSP) |
| ORF03890 | 7779 & 7780 | general secretion pathway protein C (gspC) |
| ORF03891 | 7781 & 7782 | General secretion pathway protein D precursor (Pullulanase secretionenvelope pulD) (GSP) |
| ORF03892 | 7783 & 7784 | General secretion pathway protein E (Type II traffic warden ATPase)(Cholera toxin secretion protein epsE) (GSP) |
| ORF03893 | 7785 & 7786 | general secretion pathway protein F (gspF) |
| ORF03894 | 7787 & 7788 | general secretion pathway protein G (gspG) |
| ORF03895 | 7789 & 7790 | General secretion pathway protein H precursor (Pullulanase secretionprotein pulH) (GSP) |
| ORF03896 | 7791 & 7792 | outer membrane secretion protein V (GSP) |

TABLE 1-continued

Annotation of ORF00001 to ORF04995

| ORFnnnnn | SEQ ID NOs | Annotation |
|---|---|---|
| ORF03897 | 7793 & 7794 | general secretion pathway protein J (gspJ) |
| ORF03898 | 7795 & 7796 | General secretion pathway protein K (gspK) |
| ORF03899 | 7797 & 7798 | general secretion pathway protein L (gspL) |
| ORF03900 | 7799 & 7800 | Putative general secretion pathway protein M (GSP) |
| ORF03901 | 7801 & 7802 | Type 4 prepilin-like proteins leader peptide processing enzyme (GSP) [3.4.23.43] |
| ORF03902 | 7803 & 7804 | bacterioferritin (bfr) |
| ORF03903 | 7805 & 7806 | Bacterioferritin-associated ferredoxin-related protein |
| ORF03904 | 7807 & 7808 | chitinase [3.2.1.14] |
| ORF03905 | 7809 & 7810 | translation elongation factor Tu (tuf) |
| ORF03906 | 7811 & 7812 | translation elongation factor G (fusA) |
| ORF03907 | 7813 & 7814 | ribosomal protein S7 (rpsG) |
| ORF03908 | 7815 & 7816 | ribosomal protein S12 (rpsL) |
| ORF03909 | 7817 & 7818 | DsrH protein |
| ORF03910 | 7819 & 7820 | Uncharacterized protein involved in the oxidation of |
| ORF03911 | 7821 & 7822 | Uncharacterized conserved protein involved in intracellular sulfur |
| ORF03912 | 7823 & 7824 | conserved hypothetical protein |
| ORF03913 | 7825 & 7826 | FKBP-type peptidyl-prolyl cis-trans isomerase fkpA precursor(EC 5.2.1.8) (PPIase) (Rotamase) (rotamase) [5.2.1.8] |
| ORF03914 | 7827 & 7828 | SlyX protein (slyX) |
| ORF03915 | 7829 & 7830 | FKBP-type peptidyl-prolyl cis-trans isomerase slyD(PPIase) (Rotamase) (Histidine-rich protein) (WHP) (rotamase) [5.2.1.8] |
| ORF03916 | 7831 & 7832 | conserved hypothetical protein |
| ORF03917 | 7833 & 7834 | Glutathione-regulated potassium-efflux system protein kefB (K(+)-H(+)antiporter) (NEM-activatable K(+)-H(+) antiporter) |
| ORF03918 | 7835 & 7836 | Glutathione-regulated potassium-efflux system ancillary protein kefG [1.6.99.2] |
| ORF03919 | 7837 & 7838 | ABC transporter ATP-binding protein |
| ORF03920 | 7839 & 7840 | Predicted hydrolase of the alpha-beta-hydrolase fold |
| ORF03921 | 7841 & 7842 | Hypothetical UPF0270 protein yheU-related protein |
| ORF03922 | 7843 & 7844 | phosphoribulokinase [2.7.1.19] |
| ORF03923 | 7845 & 7846 | no known function |
| ORF03924 | 7847 & 7848 | Catabolite gene activator (cAMP receptor protein) (cAMP-regulatoryprotein) (crp) |
| ORF03925 | 7849 & 7850 | integral membrane protein, YccS-YhfK family subfamily |
| ORF03926 | 7851 & 7852 | Acetylornithine aminotransferase (argD) [2.6.1.11] |
| ORF03927 | 7853 & 7854 | Para-aminobenzoate synthase glutamine amidotransferase component II [6.3.5.8] |
| ORF03928 | 7855 & 7856 | fic, putative |
| ORF03929 | 7857 & 7858 | Peptidyl-prolyl cis-trans isomerase A precursor (PPIaseA) (Rotamase A) (Cyclophilin A) (utu) [5.2.1.8] |
| ORF03930 | 7859 & 7860 | hypothetical protein |
| ORF03931 | 7861 & 7862 | TsgA protein |
| ORF03932 | 7863 & 7864 | nitrite reductase [NAD(P)H], large subunit (nirB) [1.7.1.4] |
| ORF03933 | 7865 & 7866 | nitrite reductase [NAD(P)H], small subunit (nirD) [1.7.1.4] |
| ORF03934 | 7867 & 7868 | Potential nitrite transporter (formate) |
| ORF03935 | 7869 & 7870 | Siroheme synthase |
| ORF03936 | 7871 & 7872 | lipoprotein, putative |
| ORF03937 | 7873 & 7874 | unnamed protein product |
| ORF03938 | 7875 & 7876 | membrane protein, putative |
| ORF03939 | 7877 & 7878 | conserved hypothetical protein |
| ORF03940 | 7879 & 7880 | parathion hydrolase, putative |
| ORF03941 | 7881 & 7882 | phosphopentomutase |
| ORF03942 | 7883 & 7884 | Alanine racemase, N-terminal domain family |
| ORF03943 | 7885 & 7886 | unnamed protein product |
| ORF03944 | 7887 & 7888 | conserved hypothetical protein |
| ORF03945 | 7889 & 7890 | tryptophanyl-tRNA synthetase (trpS) [6.1.1.2] |
| ORF03946 | 7891 & 7892 | phosphoglycolate phosphatase, bacterial (gph) [3.1.3.18] |
| ORF03947 | 7893 & 7894 | hypothetical protein |
| ORF03948 | 7895 & 7896 | Phosphoglycolate phosphatase (PGP) [3.1.3.18] |
| ORF03949 | 7897 & 7898 | ribulose-phosphate 3-epimerase (rpe) [5.1.3.1] |
| ORF03950 | 7899 & 7900 | DNA adenine methylase (dam) [2.1.1.72] |
| ORF03951 | 7901 & 7902 | DamX protein (1989) |
| ORF03952 | 7903 & 7904 | 3-dehydroquinate synthase (aroB) [4.2.3.4] |
| ORF03953 | 7905 & 7906 | shikimate kinase I |
| ORF03954 | 7907 & 7908 | Protein transport protein hofQ precursor (Tfp) |
| ORF03955 | 7909 & 7910 | conserved hypothetical protein |
| ORF03956 | 7911 & 7912 | conserved hypothetical protein |
| ORF03957 | 7913 & 7914 | Fimbrial assembly protein (PilN) superfamily |
| ORF03958 | 7915 & 7916 | conserved hypothetical protein |
| ORF03959 | 7917 & 7918 | Penicillin-binding protein 1A (PBP1a) [2.4.2.—] |
| ORF03960 | 7919 & 7920 | ADP compounds hydrolase nudE [3.6.1.—] |
| ORF03961 | 7921 & 7922 | Intracellular growth attenuator protein igaA |
| ORF03962 | 7923 & 7924 | HAD-superfamily hydrolase, subfamily IA, variant 3 protein family |
| ORF03963 | 7925 & 7926 | Heat shock protein 15 (HSP15) (HSP15) |
| ORF03964 | 7927 & 7928 | 33 kDa chaperonin (Heat shock protein 33) (HSP33) (HSP33) |
| ORF03965 | 7929 & 7930 | membrane protein, putative |
| ORF03966 | 7931 & 7932 | phosphoenolpyruvate carboxykinase (ATP) (pckA) [4.1.1.49] |
| ORF03967 | 7933 & 7934 | Osmolarity sensor protein envZ [2.7.3.—] |

TABLE 1-continued

Annotation of ORF00001 to ORF04995

| ORFnnnnn | SEQ ID NOs | Annotation |
|---|---|---|
| ORF03968 | 7935 & 7936 | response regulator (sensor, EnvZ) affecting transcription of ompC and ompF: outer membrane protein synthesis |
| ORF03969 | 7937 & 7938 | transcription elongation factor GreB (greB) |
| ORF03970 | 7939 & 7940 | Protein yhgF |
| ORF03971 | 7941 & 7942 | ferrous iron transport protein B |
| ORF03972 | 7943 & 7944 | ferrous iron transport protein B (feoB) |
| ORF03973 | 7945 & 7946 | conserved hypothetical protein |
| ORF03974 | 7947 & 7948 | transposase |
| ORF03975 | 7949 & 7950 | hypothetical protein |
| ORF03976 | 7951 & 7952 | bioH protein (bioH) |
| ORF03977 | 7953 & 7954 | hypothetical protein |
| ORF03978 | 7955 & 7956 | predicted amidophosphoribosyltransferase |
| ORF03979 | 7957 & 7958 | Protein yhgI |
| ORF03980 | 7959 & 7960 | High-affinity gluconate transporter (Gluconate permease) (Gnt-Isystem) |
| ORF03981 | 7961 & 7962 | 4-alpha-glucanotransferase (malQ) [2.4.1.25] |
| ORF03982 | 7963 & 7964 | Maltodextrin phosphorylase [2.4.1.1] |
| ORF03983 | 7965 & 7966 | transcriptional regulator, LuxR family, putative |
| ORF03984 | 7967 & 7968 | RNA 3'-terminal phosphate cyclase (rtcA) [6.5.1.4] |
| ORF03985 | 7969 & 7970 | Protein rtcB |
| ORF03986 | 7971 & 7972 | Glycerol-3-phosphate regulon repressor |
| ORF03987 | 7973 & 7974 | Transcriptional Regulatory protein rtcR |
| ORF03988 | 7975 & 7976 | Rhomboid family protein, putative |
| ORF03989 | 7977 & 7978 | unnamed protein product; glpE polypeptide (AA 1-131) |
| ORF03990 | 7979 & 7980 | Aerobic glycerol-3-phosphate dehydrogenase (aerobic) |
| ORF03991 | 7981 & 7982 | conserved hypothetical protein |
| ORF03992 | 7983 & 7984 | conserved hypothetical protein |
| ORF03993 | 7985 & 7986 | conserved hypothetical protein |
| ORF03994 | 7987 & 7988 | mannose binding protein FimH precursor |
| ORF03995 | 7989 & 7990 | fimbrial chaperone |
| ORF03996 | 7991 & 7992 | Putative minor fimbrial subunit precursor |
| ORF03997 | 7993 & 7994 | Putative minor fimbrial subunit precursor |
| ORF03998 | 7995 & 7996 | F1C fimbrial usher |
| ORF03999 | 7997 & 7998 | Chaperone protein fimC precursor |
| ORF04000 | 7999 & 8000 | Long polar fimbria protein A precursor (pilin) |
| ORF04001 | 8001 & 8002 | Glycogen phosphorylase [2.4.1.1] |
| ORF04002 | 8003 & 8004 | Glycogen synthase (Starch [bacterial glycogen]synthase) [2.4.1.21] |
| ORF04003 | 8005 & 8006 | glucose-1-phosphate adenylyltransferase (glgC) [2.7.7.27] |
| ORF04004 | 8007 & 8008 | glycogen debranching enzyme GlgX (glgX) [3.2.1.—] |
| ORF04005 | 8009 & 8010 | 1,4-alpha-glucan branching enzyme (glgB) [2.4.1.18] |
| ORF04006 | 8011 & 8012 | aspartate-semialdehyde dehydrogenase (asd) [1.2.1.11] |
| ORF04007 | 8013 & 8014 | membrane protein, putative |
| ORF04008 | 8015 & 8016 | gluconate permease, putative |
| ORF04009 | 8017 & 8018 | thermoresistant gluconokinase (gluconate kinase 2) |
| ORF04010 | 8019 & 8020 | HTH-type transcriptional regulator gntR (Gluconate utilization systemGNT-I transcriptional repressor) (gnt) |
| ORF04011 | 8021 & 8022 | Protein yhhW |
| ORF04012 | 8023 & 8024 | Putative oxidoreductase yhhX [1.—.—.—] |
| ORF04013 | 8025 & 8026 | conserved hypothetical protein |
| ORF04014 | 8027 & 8028 | acetyltransferase, GNAT family, putative [2.3.1.—] |
| ORF04015 | 8029 & 8030 | unnamed protein product; Similar to Hcp protein |
| ORF04016 | 8031 & 8032 | conserved hypothetical protein |
| ORF04017 | 8033 & 8034 | gamma-glutamyltransferase (ggt) [2.3.2.2] |
| ORF04018 | 8035 & 8036 | glycerophosphodiester phosphodiesterase [3.1.4.46] |
| ORF04019 | 8037 & 8038 | CG9973-PA |
| ORF04020 | 8039 & 8040 | SN-glycerol-3-phosphate transport ATP-binding protein ugpC |
| ORF04021 | 8041 & 8042 | SN-glycerol-3-phosphate transport system permease protein ugpE (membrane) |
| ORF04022 | 8043 & 8044 | glycerol-3-phosphate ABC transporter, permease protein (membrane) |
| ORF04023 | 8045 & 8046 | Glycerol-3-phosphate-binding periplasmic protein precursor |
| ORF04024 | 8047 & 8048 | ABC transporter domain protein |
| ORF04025 | 8049 & 8050 | High-affinity branched-chain amino acid transport ATP-binding proteinlivG (LIV-I protein G) (AJ272047) |
| ORF04026 | 8051 & 8052 | High-affinity branched-chain amino acid transport system permeaseprotein livM (LIV-I protein M) |
| ORF04027 | 8053 & 8054 | High-affinity branched-chain amino acid transport system permease protein livH |
| ORF04028 | 8055 & 8056 | Leucine-specific binding protein precursor |
| ORF04029 | 8057 & 8058 | acetyltransferase, GNAT family family |
| ORF04030 | 8059 & 8060 | Leu-Ile-Val-binding protein precursor |
| ORF04031 | 8061 & 8062 | PTS system, mannose-specific enzyme II, AB component (EIII-MAN) [2.7.1.69] |
| ORF04032 | 8063 & 8064 | PTS system, mannose-specific IIAB components, putative [2.7.1.69] |
| ORF04033 | 8065 & 8066 | PTS system, IIC component (PTS) |
| ORF04034 | 8067 & 8068 | mannose-specific PTS enzyme IID |
| ORF04035 | 8069 & 8070 | D-3-phosphoglycerate dehydrogenase (serA) [1.1.1.95] |
| ORF04036 | 8071 & 8072 | dihydrodipicolinate synthase (dapA) [4.2.1.52] |
| ORF04037 | 8073 & 8074 | alternative sigma factor RpoH (rpoH) |
| ORF04038 | 8075 & 8076 | putative protein insertion permease FtsX (ftsX) |
| ORF04039 | 8077 & 8078 | Cell division ATP-binding protein ftsE |

TABLE 1-continued

Annotation of ORF00001 to ORF04995

| ORFnnnnn | SEQ ID NOs | Annotation |
|---|---|---|
| ORF04040 | 8079 & 8080 | Cell division protein ftsY |
| ORF04041 | 8081 & 8082 | methyltransferase, putative |
| ORF04042 | 8083 & 8084 | overlaps previous ORF, probably uses downstream start |
| ORF04043 | 8085 & 8086 | conserved hypothetical protein |
| ORF04044 | 8087 & 8088 | membrane protein, putative |
| ORF04045 | 8089 & 8090 | Lead, cadmium, zinc and mercury transporting ATPase [3.6.3.3] |
| ORF04046 | 8091 & 8092 | SirA protein |
| ORF04047 | 8093 & 8094 | membrane protein (o221) |
| ORF04048 | 8095 & 8096 | DcrB protein precursor |
| ORF04049 | 8097 & 8098 | Hypothetical UPF0226 protein yhhS |
| ORF04050 | 8099 & 8100 | Domain of unknown function, putative |
| ORF04051 | 8101 & 8102 | 4'-phosphopantetheinyl transferase acpT [2.7.8.—] |
| ORF04052 | 8103 & 8104 | nickel ABC transporter, periplasmic nickel-binding protein (nikA) |
| ORF04053 | 8105 & 8106 | Nickel transport system permease protein nikB (permease) |
| ORF04054 | 8107 & 8108 | dipeptide ABC transporter, permease protein, putative |
| ORF04055 | 8109 & 8110 | Nickel transport ATP-binding protein nikD |
| ORF04056 | 8111 & 8112 | Nickel transport ATP-binding protein nikE |
| ORF04057 | 8113 & 8114 | Nickel responsive regulator |
| ORF04058 | 8115 & 8116 | transcriptional regulator, GntR family, putative |
| ORF04059 | 8117 & 8118 | PTS system IIA component, probable, putative |
| ORF04060 | 8119 & 8120 | PTS system, galactitol-specific enzyme II, B component [2.7.1.69] |
| ORF04061 | 8121 & 8122 | PTS system, sorbitol-specific IIC component |
| ORF04062 | 8123 & 8124 | probable xylulose kinase Z4878 [2.7.1.30] |
| ORF04063 | 8125 & 8126 | phosphotransferase system HPr enzyme (PTS) |
| ORF04064 | 8127 & 8128 | Tagatose-bisphosphate aldolase GatY [4.1.2.—] |
| ORF04065 | 8129 & 8130 | ABC-2 type transporter family |
| ORF04066 | 8131 & 8132 | ribosome-associated ATPase, ATP-binding domain (N-terminal) |
| ORF04067 | 8133 & 8134 | Type I antifreeze protein:HlyD family secretion protein |
| ORF04068 | 8135 & 8136 | membrane protein, putative |
| ORF04069 | 8137 & 8138 | conserved hypothetical protein TIGR00275 |
| ORF04070 | 8139 & 8140 | Low-affinity inorganic phosphate transporter 1 |
| ORF04071 | 8141 & 8142 | Universal stress protein B |
| ORF04072 | 8143 & 8144 | universal stress protein A (UspA) |
| ORF04073 | 8145 & 8146 | hypothetical protein |
| ORF04074 | 8147 & 8148 | Hypothetical transporter yhiP |
| ORF04075 | 8149 & 8150 | gtg start, alternate starts possible |
| ORF04076 | 8151 & 8152 | Oligopeptidase A |
| ORF04077 | 8153 & 8154 | Protein of unknown function (DUF519) superfamily |
| ORF04078 | 8155 & 8156 | glutathione-disulfide reductase (gor) [1.8.1.7] |
| ORF04079 | 8157 & 8158 | conserved hypothetical protein |
| ORF04080 | 8159 & 8160 | Arsenate reductase [1.20.4.1] |
| ORF04081 | 8161 & 8162 | outer membrane protein induced after carbon starvation |
| ORF04082 | 8163 & 8164 | Hypothetical transcriptional regulator yhiF |
| ORF04083 | 8165 & 8166 | Hemin transport protein hmuS |
| ORF04084 | 8167 & 8168 | outer membrane hemin receptor ChuA |
| ORF04085 | 8169 & 8170 | conserved hypothetical protein |
| ORF04086 | 8171 & 8172 | Putative Periplasmic binding protein |
| ORF04087 | 8173 & 8174 | HugW |
| ORF04088 | 8175 & 8176 | HuvX protein (fragment) |
| ORF04089 | 8177 & 8178 | conserved hypothetical protein |
| ORF04090 | 8179 & 8180 | hemin ABC transporter permease protein |
| ORF04091 | 8181 & 8182 | hemin transport system ATP-binding protein |
| ORF04092 | 8183 & 8184 | cation transport ATPase yqgG |
| ORF04093 | 8185 & 8186 | protein hdeB precursor |
| ORF04094 | 8187 & 8188 | Protein hdeA precursor, putative |
| ORF04095 | 8189 & 8190 | HdeD protein |
| ORF04096 | 8191 & 8192 | conserved hypothetical protein |
| ORF04097 | 8193 & 8194 | multidrug efflux pump SdeX |
| ORF04098 | 8195 & 8196 | RND family, acridine-multidrug efflux pump |
| ORF04099 | 8197 & 8198 | HTH-type transcriptional regulator appY (M5 polypeptide) |
| ORF04100 | 8199 & 8200 | Transcriptional regulator gadX |
| ORF04101 | 8201 & 8202 | glutamate decarboxylase [4.1.1.15] |
| ORF04102 | 8203 & 8204 | cytochrome c551 peroxidase |
| ORF04103 | 8205 & 8206 | Trehalase [3.2.1.28] |
| ORF04104 | 8207 & 8208 | virulence regulator |
| ORF04105 | 8209 & 8210 | transcriptional regulator |
| ORF04106 | 8211 & 8212 | ribonuclease, putative |
| ORF04107 | 8213 & 8214 | metabolite-proton symporter |
| ORF04108 | 8215 & 8216 | Uncharacterized protein involved in outer membrane biogenesis |
| ORF04109 | 8217 & 8218 | EAL domain, putative |
| ORF04110 | 8219 & 8220 | 2-dehydro-3-deoxygluconokinase |
| ORF04111 | 8221 & 8222 | Protein yhjJ precursor [3.4.99.—] |
| ORF04112 | 8223 & 8224 | Aerobic C4-dicarboxylate transport protein |
| ORF04113 | 8225 & 8226 | Protein yhjK |
| ORF04114 | 8227 & 8228 | Cellulose synthase operon protein C |
| ORF04115 | 8229 & 8230 | Endoglucanase precursor |

TABLE 1-continued

Annotation of ORF00001 to ORF04995

| ORFnnnnn | SEQ ID NOs | Annotation |
|---|---|---|
| ORF04116 | 8231 & 8232 | Cyclic di-GMP binding protein precursor |
| ORF04117 | 8233 & 8234 | Cellulose synthase catalytic subunit [UDP-forming] |
| ORF04118 | 8235 & 8236 | YhjQ protein family |
| ORF04119 | 8237 & 8238 | conserved hypothetical protein |
| ORF04120 | 8239 & 8240 | conserved hypothetical protein |
| ORF04121 | 8241 & 8242 | conserved hypothetical protein |
| ORF04122 | 8243 & 8244 | conserved hypothetical protein |
| ORF04123 | 8245 & 8246 | conserved hypothetical protein |
| ORF04124 | 8247 & 8248 | Hypothetical transport protein yhjV |
| ORF04125 | 8249 & 8250 | peptide ABC transporter, ATP-binding protein (atp_bind) |
| ORF04126 | 8251 & 8252 | Dipeptide transport ATP-binding protein dppD (atp_bind) |
| ORF04127 | 8253 & 8254 | Dipeptide transport system permease protein dppC (membrane) |
| ORF04128 | 8255 & 8256 | Dipeptide transport system permease protein dppB (permease) |
| ORF04129 | 8257 & 8258 | Periplasmic dipeptide transport protein precursor (DBP) |
| ORF04130 | 8259 & 8260 | conserved hypothetical protein |
| ORF04131 | 8261 & 8262 | Membrane-protein yhjW |
| ORF04132 | 8263 & 8264 | putative resistance protein |
| ORF04133 | 8265 & 8266 | conserved hypothetical protein |
| ORF04134 | 8267 & 8268 | DNA-3-methyladenine glycosylase I [3.2.2.20] |
| ORF04135 | 8269 & 8270 | Biotin sulfoxide reductase |
| ORF04136 | 8271 & 8272 | Hypothetical acetyltransferase yiaC (GNAT) [2.3.1.—] |
| ORF04137 | 8273 & 8274 | probable outer membrane protein yiaD |
| ORF04138 | 8275 & 8276 | 2-ketogluconate reductase [1.1.1.215] |
| ORF04139 | 8277 & 8278 | lipoprotein, putative |
| ORF04140 | 8279 & 8280 | Putative HTH-type transcriptional regulator yiaG |
| ORF04141 | 8281 & 8282 | cold shock-like protein |
| ORF04142 | 8283 & 8284 | probable membrane permeability altering protein Z4982-related protein |
| ORF04143 | 8285 & 8286 | glycyl-tRNA synthetase, beta subunit (glyS) [6.1.1.14] |
| ORF04144 | 8287 & 8288 | glycyl-tRNA synthetase, alpha subunit (glyQ) [6.1.1.14] |
| ORF04145 | 8289 & 8290 | conserved hypothetical protein |
| ORF04146 | 8291 & 8292 | Acyltransferase family, putative |
| ORF04147 | 8293 & 8294 | yiaA-B two helix domain family |
| ORF04148 | 8295 & 8296 | yiaA-B two helix domain family |
| ORF04149 | 8297 & 8298 | xylulokinase (xylB) [2.7.1.17] |
| ORF04150 | 8299 & 8300 | xylose isomerase (xylA) [5.3.1.5] |
| ORF04151 | 8301 & 8302 | D-xylose ABC transporter, periplasmic-D xylose binding protein |
| ORF04152 | 8303 & 8304 | sugar ABC transporter, ATP-binding protein (xylG) |
| ORF04153 | 8305 & 8306 | sugar ABC transporter, permease protein |
| ORF04154 | 8307 & 8308 | Xylose operon regulatory protein (xylR) |
| ORF04155 | 8309 & 8310 | BAX protein |
| ORF04156 | 8311 & 8312 | Alpha-amylase precursor [3.2.1.1] |
| ORF04157 | 8313 & 8314 | Valine--pyruvate aminotransferase |
| ORF04158 | 8315 & 8316 | Electron transport protein hydN |
| ORF04159 | 8317 & 8318 | lclR family transcriptional repressor |
| ORF04160 | 8319 & 8320 | 2-keto reductase [1.1.1.—] |
| ORF04161 | 8321 & 8322 | YiaL |
| ORF04162 | 8323 & 8324 | YiaX1 |
| ORF04163 | 8325 & 8326 | TRAP transporter, DctQ-like membrane protein superfamily |
| ORF04164 | 8327 & 8328 | C4-dicarboxylate transport system permease large protein (DctM) |
| ORF04165 | 8329 & 8330 | DctP protein (AP001509) |
| ORF04166 | 8331 & 8332 | sugar kinase, FGGY family, putative [2.7.1.53] |
| ORF04167 | 8333 & 8334 | hexulose-6-phosphate synthase (humps) [4.1.2.—] |
| ORF04168 | 8335 & 8336 | hexulose-6-phosphate isomerase, putative |
| ORF04169 | 8337 & 8338 | L-ribulose-5-phosphate 4-epimerase (araD) [5.1.3.4] |
| ORF04170 | 8339 & 8340 | aldehyde dehydrogenase family protein (AF029733) |
| ORF04171 | 8341 & 8342 | Fic protein family family |
| ORF04172 | 8343 & 8344 | alcohol dehydrogenase, class IV [1.1.1.1] |
| ORF04173 | 8345 & 8346 | selenocysteine-specific translation elongation factor (selB) |
| ORF04174 | 8347 & 8348 | L-seryl-tRNA selenium transferase (selA) [2.9.1.1] |
| ORF04175 | 8349 & 8350 | Hypothetical GST-like protein yibF |
| ORF04176 | 8351 & 8352 | multidrug resistance efflux pump |
| ORF04177 | 8353 & 8354 | GTPase |
| ORF04178 | 8355 & 8356 | PTS system, mannitol-specific enzyme IIABC components [2.7.1.69] |
| ORF04179 | 8357 & 8358 | Mannitol-1-phosphate 5-dehydrogenase [1.1.1.17] |
| ORF04180 | 8359 & 8360 | Mannitol operon repressor (Mannitol repressor protein) |
| ORF04181 | 8361 & 8362 | conserved hypothetical protein |
| ORF04182 | 8363 & 8364 | conserved hypothetical protein |
| ORF04183 | 8365 & 8366 | conserved hypothetical protein |
| ORF04184 | 8367 & 8368 | surface protein (partial) |
| ORF04185 | 8369 & 8370 | L-lactate permease |
| ORF04186 | 8371 & 8372 | transcriptional regulator |
| ORF04187 | 8373 & 8374 | L-lactate dehydrogenase (lctD) [1.1.2.3] |
| ORF04188 | 8375 & 8376 | RNA methyltransferase, TrmH family, group 2 |
| ORF04189 | 8377 & 8378 | Serine acetyltransferase (SAT) (SAT) [2.3.1.30] |
| ORF04190 | 8379 & 8380 | Glycerol-3-phosphate dehydrogenase [NAD(P)+] (NAD(P)H-dependent glycerol-3-phosphate dehydrogenase) (gpsA) [1.1.1.94] |

TABLE 1-continued

Annotation of ORF00001 to ORF04995

| ORFnnnnn | SEQ ID NOs | Annotation |
|---|---|---|
| ORF04191 | 8381 & 8382 | protein-export protein SecB (secB) |
| ORF04192 | 8383 & 8384 | glutaredoxin 3 (grxC) |
| ORF04193 | 8385 & 8386 | Rhodanese-like domain protein |
| ORF04194 | 8387 & 8388 | 2,3-bisphosphoglycerate-independent phosphoglycerate mutase (gpmI) [5.4.2.1] |
| ORF04195 | 8389 & 8390 | Membrane-bound metallopeptidase |
| ORF04196 | 8391 & 8392 | glycosyl transferase, group 2 family protein, putative [2.—.—.—] |
| ORF04197 | 8393 & 8394 | yibQ gene product |
| ORF04198 | 8395 & 8396 | L-threonine 3-dehydrogenase (tdh) [1.1.1.103] |
| ORF04199 | 8397 & 8398 | 2-amino-3-ketobutyrate coenzyme A ligase (kbl) [2.3.1.29] |
| ORF04200 | 8399 & 8400 | ADP-L-glycero-D-manno-heptose-6-epimerase (rfaD) [5.1.3.20] |
| ORF04201 | 8401 & 8402 | lipopolysaccharide heptosyltransferase II (rfaF) |
| ORF04202 | 8403 & 8404 | lipopolysaccharide heptosyltransferase I (rfaC) [2.—.—.—] |
| ORF04203 | 8405 & 8406 | Lipid A-core, surface polymer ligase |
| ORF04204 | 8407 & 8408 | beta-1,3-glucosyltransferase [2.4.1.166] |
| ORF04205 | 8409 & 8410 | UDP-galactose:(galactosyl)LPS alpha-1,2-galactosyltransferase (glucosyl) [2.4.1.58] |
| ORF04206 | 8411 & 8412 | heptosyl-II-kinase |
| ORF04207 | 8413 & 8414 | UDP-galactose: (glucosyl) [2.4.1.58] |
| ORF04208 | 8415 & 8416 | UDP-glucose: (glucosyl) [2.4.1.44] |
| ORF04209 | 8417 & 8418 | Lipopolysaccharide core biosynthesis protein rfaP |
| ORF04210 | 8419 & 8420 | UDP-glucose: (heptosyl) [2.4.1.—] |
| ORF04211 | 8421 & 8422 | lipopolysaccharide heptosyltransferase III, putative |
| ORF04212 | 8423 & 8424 | 3-deoxy-D-manno-octulosonic-acid transferase (KDOtransferase) (KDO) [2.—.—.—] |
| ORF04213 | 8425 & 8426 | pantetheine-phosphate adenylyltransferase (coaD) [2.7.7.3] |
| ORF04214 | 8427 & 8428 | formamidopyrimidine-DNA glycosylase (mutM) [3.2.2.23] |
| ORF04215 | 8429 & 8430 | ribosomal protein L33 (rpmG) |
| ORF04216 | 8431 & 8432 | RpmB protein (rpL28) |
| ORF04217 | 8433 & 8434 | DNA repair protein |
| ORF04218 | 8435 & 8436 | phosphopantothenoylcysteine decarboxylase-phosphopantothenate--cysteine ligase (coaBC) [4.1.1.36 6.3.2.5] |
| ORF04219 | 8437 & 8438 | Deoxyuridine 5'-triphosphate nucleotidohydrolase (dut) [3.6.1.23] |
| ORF04220 | 8439 & 8440 | Ttk protein |
| ORF04221 | 8441 & 8442 | orotate phosphoribosyltransferase (pyrE) [2.4.2.10] |
| ORF04222 | 8443 & 8444 | ribonuclease PH (rph) [2.7.7.56] |
| ORF04223 | 8445 & 8446 | conserved hypothetical protein TIGR00255 |
| ORF04224 | 8447 & 8448 | hypothetical protein |
| ORF04225 | 8449 & 8450 | DNA-damage-inducible protein D |
| ORF04226 | 8451 & 8452 | predicted membrane protein |
| ORF04227 | 8453 & 8454 | Hypothetical DNA ligase-like protein yicF |
| ORF04228 | 8455 & 8456 | conserved hypothetical protein |
| ORF04229 | 8457 & 8458 | guanylate kinase |
| ORF04230 | 8459 & 8460 | DNA-directed RNA polymerase omega chain (RNAP omegasubunit) (Transcriptase omega chain) (RNA polymerase omega subunit) (rpoZ) [2.7.7.6] |
| ORF04231 | 8461 & 8462 | Guanosine-3,5-bis(Diphosphate) 3-pyrophosphohydrolase (ppGpp) |
| ORF04232 | 8463 & 8464 | tRNA (Guanosine-2'-O-)-methyltransferase (Gm18) [2.1.1.34] |
| ORF04233 | 8465 & 8466 | ATP-dependent DNA helicase RecG (recG) [3.6.1.—] |
| ORF04234 | 8467 & 8468 | sodium-glutamate symporter (gltS) |
| ORF04235 | 8469 & 8470 | xanthine-uracil permease family protein |
| ORF04236 | 8471 & 8472 | possible exported protein |
| ORF04237 | 8473 & 8474 | Protein of unknown function (DUF1498) superfamily |
| ORF04238 | 8475 & 8476 | possible NAGC-like transcriptional regulator |
| ORF04239 | 8477 & 8478 | fructose-bisphosphate aldolase, class II family [4.1.2.13] |
| ORF04240 | 8479 & 8480 | fructose-bisphosphate aldolase, class II family [4.1.2.—] |
| ORF04241 | 8481 & 8482 | PTS system, IIbc component (PTS) [2.7.1.69] |
| ORF04242 | 8483 & 8484 | PTS system, fructose-like-2 IIB component 1 |
| ORF04243 | 8485 & 8486 | PTS system, EIIa component (PTS) [2.7.1.69] |
| ORF04244 | 8487 & 8488 | transcription antiterminator BglG family protein,, putative |
| ORF04245 | 8489 & 8490 | f772 [3.2.1.20] |
| ORF04246 | 8491 & 8492 | similar to melibiose carrier protein |
| ORF04247 | 8493 & 8494 | RhuM (partial) |
| ORF04248 | 8495 & 8496 | membrane protein |
| ORF04249 | 8497 & 8498 | Lipoprotein-28 precursor (hlpA) |
| ORF04250 | 8499 & 8500 | conserved hypothetical protein |
| ORF04251 | 8501 & 8502 | putative transport protein |
| ORF04252 | 8503 & 8504 | Protein of unknown function (DUF1198) superfamily |
| ORF04253 | 8505 & 8506 | xanthine-uracil permease family protein subfamily |
| ORF04254 | 8507 & 8508 | adenine deaminase (ade) [3.5.4.2] |
| ORF04255 | 8509 & 8510 | Hexose phosphate transport protein |
| ORF04256 | 8511 & 8512 | Regulatory protein uhpC |
| ORF04257 | 8513 & 8514 | Sensor protein uhpB |
| ORF04258 | 8515 & 8516 | hypothetical protein |
| ORF04259 | 8517 & 8518 | response regulator, positive activator of uhpT transcription |
| ORF04260 | 8519 & 8520 | acetolactate synthase, small subunit, putative [2.2.1.6] |
| ORF04261 | 8521 & 8522 | acetolactate synthase, large subunit, biosynthetic type (ilvB) [2.2.1.6] |
| ORF04262 | 8523 & 8524 | Multidrug resistance protein D |
| ORF04263 | 8525 & 8526 | f165 [1.—.—.—] |

TABLE 1-continued

Annotation of ORF00001 to ORF04995

| ORFnnnnn | SEQ ID NOs | Annotation |
|---|---|---|
| ORF04264 | 8527 & 8528 | conserved hypothetical protein |
| ORF04265 | 8529 & 8530 | Predicted membrane protein |
| ORF04266 | 8531 & 8532 | probable sulfatase yidJ [3.1.6.—] |
| ORF04267 | 8533 & 8534 | Putative sulfatase yidJ [3.1.6.—] |
| ORF04268 | 8535 & 8536 | Na+-myo-inositol cotransporter |
| ORF04269 | 8537 & 8538 | msm operon regulatory protein, putative |
| ORF04270 | 8539 & 8540 | potassium uptake protein TrkA, putative |
| ORF04271 | 8541 & 8542 | heat shock protein |
| ORF04272 | 8543 & 8544 | heat shock protein |
| ORF04273 | 8545 & 8546 | hypothetical protein |
| ORF04274 | 8547 & 8548 | o135 protein |
| ORF04275 | 8549 & 8550 | f416 |
| ORF04276 | 8551 & 8552 | MFS transporter, phthalate permease family |
| ORF04277 | 8553 & 8554 | conserved hypothetical protein |
| ORF04278 | 8555 & 8556 | mandelate racemase-muconate lactonizing enzyme family protein (partial) [4.2.1.6] |
| ORF04279 | 8557 & 8558 | 4-hydroxy-2-oxoglutarate aldolase-2-dehydro-3-deoxyphosphogluconate [4.1.2.21] |
| ORF04280 | 8559 & 8560 | 2-dehydro-3-deoxygalactonate kinase [2.7.1.58] |
| ORF04281 | 8561 & 8562 | transcriptional repressor for galactonate utilization (GntR family) (AF096293) |
| ORF04282 | 8563 & 8564 | probable replicase Z5187 |
| ORF04283 | 8565 & 8566 | Cof family protein |
| ORF04284 | 8567 & 8568 | Bacterial protein of unknown function (DUF937) family |
| ORF04285 | 8569 & 8570 | DNA gyrase, B subunit (gyrB) [5.99.1.3] |
| ORF04286 | 8571 & 8572 | DNA replication and repair protein recF [similarity] |
| ORF04287 | 8573 & 8574 | DNA polymerase III, beta subunit (dnaN) [2.7.7.7] |
| ORF04288 | 8575 & 8576 | chromosomal replication initiator protein DnaA (dnaA) |
| ORF04289 | 8577 & 8578 | ribosomal protein L34 (rpmH) |
| ORF04290 | 8579 & 8580 | ribonuclease P protein component (rnpA) [3.1.26.5] |
| ORF04291 | 8581 & 8582 | conserved hypothetical protein TIGR00278 |
| ORF04292 | 8583 & 8584 | Inner membrane protein oxaA (IMP) |
| ORF04293 | 8585 & 8586 | tRNA modification GTPase TrmE (trmE) |
| ORF04294 | 8587 & 8588 | tryptophanase (TNase) [4.1.99.1] |
| ORF04295 | 8589 & 8590 | Low affinity tryptophan permease |
| ORF04296 | 8591 & 8592 | similar to drug resistance translocases |
| ORF04297 | 8593 & 8594 | transcriptional regulator, LysR family |
| ORF04298 | 8595 & 8596 | hypothetical protein |
| ORF04299 | 8597 & 8598 | o252 |
| ORF04300 | 8599 & 8600 | YieF (putative) |
| ORF04301 | 8601 & 8602 | f445 |
| ORF04302 | 8603 & 8604 | haloacid dehalogenase-like hydrolase, putative |
| ORF04303 | 8605 & 8606 | conserved hypothetical protein |
| ORF04304 | 8607 & 8608 | pyrimidine-specific nucleoside hydrolase [3.5.99.6] |
| ORF04305 | 8609 & 8610 | Putative esterase family, putative |
| ORF04306 | 8611 & 8612 | putative xylanase |
| ORF04307 | 8613 & 8614 | f538 |
| ORF04308 | 8615 & 8616 | 6-phospho-beta-glucosidase bglB [3.2.1.86] |
| ORF04309 | 8617 & 8618 | PTS system, beta-glucoside-specific IIABC component |
| ORF04310 | 8619 & 8620 | Cryptic beta-glucoside bgl operon Antiterminator |
| ORF04311 | 8621 & 8622 | phosphate transport system regulatory protein PhoU (phoU) |
| ORF04312 | 8623 & 8624 | phosphate ABC transporter, ATP-binding protein (pstB) [3.6.3.27] |
| ORF04313 | 8625 & 8626 | phosphate ABC transporter, permease protein PstA (pstA) |
| ORF04314 | 8627 & 8628 | phosphate ABC transporter, permease protein PstC (pstC) |
| ORF04315 | 8629 & 8630 | phosphate ABC transporter, phosphate-binding protein (pstS) |
| ORF04316 | 8631 & 8632 | glucosamine--fructose-6-phosphate aminotransferase, isomerizing (glmS) [2.6.1.16] |
| ORF04317 | 8633 & 8634 | UDP-N-acetylglucosamine pyrophosphorylase (glmU) [2.7.7.23] |
| ORF04318 | 8635 & 8636 | ATP synthase F1, epsilon subunit (atpC) [3.6.3.14] |
| ORF04319 | 8637 & 8638 | ATP synthase F1, beta subunit (atpD) [3.6.3.14] |
| ORF04320 | 8639 & 8640 | ATP synthase F1, gamma subunit (atpG) [3.6.3.14] |
| ORF04321 | 8641 & 8642 | ATP synthase F1, alpha subunit (atpA) [3.6.3.14] |
| ORF04322 | 8643 & 8644 | ATP synthase F1, delta subunit (atpH) [3.6.3.14] |
| ORF04323 | 8645 & 8646 | ATP synthase F0, B subunit (atpF) [3.6.3.14] |
| ORF04324 | 8647 & 8648 | conserved hypothetical protein |
| ORF04325 | 8649 & 8650 | ATP synthase F0, C subunit [3.6.3.14] |
| ORF04326 | 8651 & 8652 | ATP synthase F0, A subunit (atpB) [3.6.3.14] |
| ORF04327 | 8653 & 8654 | ATP synthase F0, I subunit (atpI) [3.6.3.14] |
| ORF04328 | 8655 & 8656 | methyltransferase GidB (gidB) [2.1.—.—] |
| ORF04329 | 8657 & 8658 | glucose-inhibited division protein A (gidA) |
| ORF04330 | 8659 & 8660 | Protein mioC (mioC) |
| ORF04331 | 8661 & 8662 | transcriptional regulator, AsnC Family (asnC) |
| ORF04332 | 8663 & 8664 | aspartate--ammonia ligase (asnA) [6.3.1.1] |
| ORF04333 | 8665 & 8666 | conserved hypothetical protein |
| ORF04334 | 8667 & 8668 | unnamed protein product |
| ORF04335 | 8669 & 8670 | potassium uptake protein (kup) |
| ORF04336 | 8671 & 8672 | high affinity ribose transport protein rbsD |
| ORF04337 | 8673 & 8674 | ribose ABC transporter, ATP-binding protein (atp_bind) |
| ORF04338 | 8675 & 8676 | ribose ABC transporter, permease protein (rbsC) |
| ORF04339 | 8677 & 8678 | ribose ABC transporter, periplasmic D-ribose-binding protein |

TABLE 1-continued

Annotation of ORF00001 to ORF04995

| ORFnnnnn | SEQ ID NOs | Annotation |
|---|---|---|
| ORF04340 | 8679 & 8680 | ribokinase (rbsK) [2.7.1.15] |
| ORF04341 | 8681 & 8682 | drug resistance transporter, EmrB-QacA family |
| ORF04342 | 8683 & 8684 | regulator for rbs operon |
| ORF04343 | 8685 & 8686 | ProP protein |
| ORF04344 | 8687 & 8688 | yieP gene product (AF096293) |
| ORF04345 | 8689 & 8690 | hypothetical protein |
| ORF04346 | 8691 & 8692 | Transcription regulator |
| ORF04347 | 8693 & 8694 | o137 (YIFE) |
| ORF04348 | 8695 & 8696 | Mg chelatase-related protein |
| ORF04349 | 8697 & 8698 | hypothetical protein |
| ORF04350 | 8699 & 8700 | acetolactate synthase, large subunit, biosynthetic type (ilvB) [2.2.1.6] |
| ORF04351 | 8701 & 8702 | acetolactate synthase II small chain (ALS-II) [4.1.3.18] |
| ORF04352 | 8703 & 8704 | branched-chain amino acid aminotransferase (ilvE) [2.6.1.42] |
| ORF04353 | 8705 & 8706 | dihydroxy-acid dehydratase (ilvD) [4.2.1.9] |
| ORF04354 | 8707 & 8708 | threonine ammonia-lyase, biosynthetic (ilvA) [4.3.1.19] |
| ORF04355 | 8709 & 8710 | transcriptional regulator, LysR family, putative |
| ORF04356 | 8711 & 8712 | Ketol-acid reductoisomerase (ILVC) [1.1.1.86] |
| ORF04357 | 8713 & 8714 | peptidylprolyl isomerase (SPP39159) [5.2.1.8] |
| ORF04358 | 8715 & 8716 | ATP-dependent DNA helicase Rep (rep) [3.6.1.—] |
| ORF04359 | 8717 & 8718 | Guanosine-5'-triphosphate,3'-diphosphate pyrophosphatase [3.6.1.40] |
| ORF04360 | 8719 & 8720 | rhlB protein (RHLB) [3.6.1.—] |
| ORF04361 | 8721 & 8722 | thioredoxin 1 |
| ORF04362 | 8723 & 8724 | transcription termination factor Rho (rho) |
| ORF04363 | 8725 & 8726 | conserved hypothetical protein |
| ORF04364 | 8727 & 8728 | undecaprenyl-phosphate alpha-N-acetylglucosaminyl 1-phosphatetransferase (wecA) [2.7.8.—] |
| ORF04365 | 8729 & 8730 | Lipopolysaccharide biosynthesis protein wzzE |
| ORF04366 | 8731 & 8732 | UDP-N-acetylglucosamine 2-epimerase [5.1.3.14] |
| ORF04367 | 8733 & 8734 | UDP-N-acetyl-D-mannosamine dehydrogenase (ECA) [1.1.1.—] |
| ORF04368 | 8735 & 8736 | dTDP-glucose 4,6-dehydratase (rfbB) [4.2.1.46] |
| ORF04369 | 8737 & 8738 | glucose-1-phosphate thymidylyltransferase (rfbA) [2.7.7.24] |
| ORF04370 | 8739 & 8740 | TDP-D-fucosamine acetyltransferase (wecD) |
| ORF04371 | 8741 & 8742 | Lipopolysaccharide biosynthesis protein rffA (WECE) [4.2.1.—] |
| ORF04372 | 8743 & 8744 | WzxE protein (WZXE) |
| ORF04373 | 8745 & 8746 | TDP-Fuc4NAc:lipid II Fuc4Nac transferase (wecF) [2.4.1.—] |
| ORF04374 | 8747 & 8748 | ECA biosynthesis protein WzyE (wzyE) |
| ORF04375 | 8749 & 8750 | possibly rffM (ECA) [2.4.1.—] |
| ORF04376 | 8751 & 8752 | hypothetical protein |
| ORF04377 | 8753 & 8754 | similar to several amino acid transport proteins (o461) |
| ORF04378 | 8755 & 8756 | tyrosine recombinase XerC (xerC) |
| ORF04379 | 8757 & 8758 | o238 (YIGB) |
| ORF04380 | 8759 & 8760 | tyrosine recombinase XerC (xerC) |
| ORF04381 | 8761 & 8762 | o238 (YIGB) |
| ORF04382 | 8763 & 8764 | arylsulfatase regulator |
| ORF04383 | 8765 & 8766 | Arylsulfatase [3.1.6.1] |
| ORF04384 | 8767 & 8768 | hemY protein (hemY) |
| ORF04385 | 8769 & 8770 | uroporphyrinogen III methylase (HEMX) [2.1.1.107] |
| ORF04386 | 8771 & 8772 | uroporphyrinogen-III synthase (hemD) [4.2.1.75] |
| ORF04387 | 8773 & 8774 | porphobilinogen deaminase (hemC) [2.5.1.61] |
| ORF04388 | 8775 & 8776 | adenylate cyclase, class-I (cyaA) [4.6.1.1] |
| ORF04389 | 8777 & 8778 | CyaY protein (CYAY) |
| ORF04390 | 8779 & 8780 | possible exported protein |
| ORF04391 | 8781 & 8782 | lipoprotein, putative |
| ORF04392 | 8783 & 8784 | Hypothetical lipoprotein yifL precursor-related protein |
| ORF04393 | 8785 & 8786 | diaminopimelate epimerase (dapF) [5.1.1.7] |
| ORF04394 | 8787 & 8788 | Protein of unknown function, DUF484 superfamily |
| ORF04395 | 8789 & 8790 | tyrosine recombinase XerC (xerC) |
| ORF04396 | 8791 & 8792 | o238 (YIGB) |
| ORF04397 | 8793 & 8794 | DNA helicase II (uvrD) [3.6.1.—] |
| ORF04398 | 8795 & 8796 | Protein of unknown function superfamily |
| ORF04399 | 8797 & 8798 | yigE protein |
| ORF04400 | 8799 & 8800 | hypothetical protein |
| ORF04401 | 8801 & 8802 | magnesium and cobalt transport protein CorA (corA) |
| ORF04402 | 8803 & 8804 | Enterobacterial putative membrane protein (DUF943) superfamily |
| ORF04403 | 8805 & 8806 | conserved hypothetical protein |
| ORF04404 | 8807 & 8808 | hypothetical protein |
| ORF04405 | 8809 & 8810 | rarD protein (rarD) |
| ORF04406 | 8811 & 8812 | f161 (YIGI) |
| ORF04407 | 8813 & 8814 | phospholipase A1 family protein, interruption [3.1.1.32] |
| ORF04408 | 8815 & 8816 | ATP-dependent DNA helicase RecQ (recQ) [3.6.1.—] |
| ORF04409 | 8817 & 8818 | threonine efflux protein |
| ORF04410 | 8819 & 8820 | transporter, LysE family |
| ORF04411 | 8821 & 8822 | Lysophospholipase L2 (Lecithinase B) (PLDB) [3.1.1.5] |
| ORF04412 | 8823 & 8824 | Cof protein |
| ORF04413 | 8825 & 8826 | HTH-type transcriptional regulator metR (METR) |
| ORF04414 | 8827 & 8828 | Hypothetical membrane protein yigM |

TABLE 1-continued

Annotation of ORF00001 to ORF04995

| ORFnnnnn | SEQ ID NOs | Annotation |
|---|---|---|
| ORF04415 | 8829 & 8830 | 5-methyltetrahydropteroyltriglutamate--homocysteine S-methyltransferase (metE) [2.1.1.14] |
| ORF04416 | 8831 & 8832 | conserved hypothetical protein |
| ORF04417 | 8833 & 8834 | conserved hypothetical protein |
| ORF04418 | 8835 & 8836 | 6-phospho-3-hexuloisomerase (PHI) |
| ORF04419 | 8837 & 8838 | PTS system, glucose-specific IIBC component (ptsG) [2.7.1.69] |
| ORF04420 | 8839 & 8840 | transketolase (tkt) [2.2.1.1] |
| ORF04421 | 8841 & 8842 | transcriptional regulator, rpiR family domain protein |
| ORF04422 | 8843 & 8844 | transcriptional regulator, LysR family |
| ORF04423 | 8845 & 8846 | cytosine transporter, putative |
| ORF04424 | 8847 & 8848 | amidase family protein, putative |
| ORF04425 | 8849 & 8850 | Carbamate kinase-like protein yahI [2.7.2.2] |
| ORF04426 | 8851 & 8852 | YahG-YlbE-like protein |
| ORF04427 | 8853 & 8854 | YahF-FdrA-like protein |
| ORF04428 | 8855 & 8856 | conserved hypothetical protein |
| ORF04429 | 8857 & 8858 | isochorismatase family protein |
| ORF04430 | 8859 & 8860 | hypothetical protein |
| ORF04431 | 8861 & 8862 | Putative carboxymethylenebutenolidase |
| ORF04432 | 8863 & 8864 | conserved hypothetical protein |
| ORF04433 | 8865 & 8866 | uridine phosphorylase (udp) [2.4.2.3] |
| ORF04434 | 8867 & 8868 | tricarboxylate transport protein TctA, putative |
| ORF04435 | 8869 & 8870 | conserved hypothetical protein |
| ORF04436 | 8871 & 8872 | Bordetella uptake gene (bug) product superfamily |
| ORF04437 | 8873 & 8874 | 4-hydroxy-2-oxoglutarate aldolase-2-dehydro-3-deoxyphosphogluconate |
| ORF04438 | 8875 & 8876 | 2-dehydro-3-deoxygalactonate kinase |
| ORF04439 | 8877 & 8878 | transcriptional regulator, IclR family |
| ORF04440 | 8879 & 8880 | DNA recombination protein rmuC |
| ORF04441 | 8881 & 8882 | Ubiquinone-menaquinone biosynthesis methyltransferase ubiE(EC 2.1.1.—) (UBIE) [2.1.1.—] |
| ORF04442 | 8883 & 8884 | unnamed protein product |
| ORF04443 | 8885 & 8886 | 2-polyprenylphenol 6-hydroxylase (ubiB) [1.14.13.—] |
| ORF04444 | 8887 & 8888 | o261 (YIGT) |
| ORF04445 | 8889 & 8890 | o261 |
| ORF04446 | 8891 & 8892 | Sec-independent protein translocase TatC (tatC) |
| ORF04447 | 8893 & 8894 | tatD gene product (YIGW) [3.1.21.—] |
| ORF04448 | 8895 & 8896 | transcriptional activator RfaH (rfaH) |
| ORF04449 | 8897 & 8898 | 3-octaprenyl-4-hydroxybenzoate carboxy-lyase (Polyprenylp-hydroxybenzoate decarboxylase) (YIGC) [4.1.1.—] |
| ORF04450 | 8899 & 8900 | NAD(P)H-flavin reductase |
| ORF04451 | 8901 & 8902 | conserved hypothetical protein |
| ORF04452 | 8903 & 8904 | acetyl-CoA C-acyltransferase FadA (fadA) [2.3.1.16] |
| ORF04453 | 8905 & 8906 | fatty oxidation complex, alpha subunit FadB (fadB) [4.2.1.17 5.3.3.8 1.1.1.35 5.1.2.3] |
| ORF04454 | 8907 & 8908 | unnamed protein product; pepQ product, proline dipeptidase (PEPQ) [3.4.13.9] |
| ORF04455 | 8909 & 8910 | conserved hypothetical protein TIGR00257 |
| ORF04456 | 8911 & 8912 | bis(5'-nucleosyl)-tetraphosphatase, symmetrical-Trk system potassium uptake protein TrkG, fusion |
| ORF04457 | 8913 & 8914 | protoporphyrin oxidase |
| ORF04458 | 8915 & 8916 | hypothetical protein |
| ORF04459 | 8917 & 8918 | molybdopterin-guanine dinucleotide biosynthesis protein B (mobB) |
| ORF04460 | 8919 & 8920 | Molybdopterin-guanine dinucleotide biosynthesis protein A |
| ORF04461 | 8921 & 8922 | Protein yihD |
| ORF04462 | 8923 & 8924 | YihE |
| ORF04463 | 8925 & 8926 | Thiol:disulfide interchange protein dsbA precursor (por) [5.3.4.1] |
| ORF04464 | 8927 & 8928 | Bacterial protein of unknown function (DUF945) superfamily |
| ORF04465 | 8929 & 8930 | Acyltransferase domain protein |
| ORF04466 | 8931 & 8932 | DNA polymerase I (POL I) (polA) [2.7.7.7] |
| ORF04467 | 8933 & 8934 | essential GTPase for cell cycle |
| ORF04468 | 8935 & 8936 | neutrophil protein |
| ORF04469 | 8937 & 8938 | hypothetical protein |
| ORF04470 | 8939 & 8940 | oxygen-independent coproporphyrinogen III oxidase (hemN) |
| ORF04471 | 8941 & 8942 | hypothetical protein |
| ORF04472 | 8943 & 8944 | nitrogen regulation protein NR(I) (ntrC) |
| ORF04473 | 8945 & 8946 | Nitrogen regulation protein NR(II) [2.7.3.—] |
| ORF04474 | 8947 & 8948 | glutamine synthetase, type I (glnA) [6.3.1.2] |
| ORF04475 | 8949 & 8950 | GTP-binding protein TypA (typA) |
| ORF04476 | 8951 & 8952 | hypothetical protein |
| ORF04477 | 8953 & 8954 | Glycerol-3-phosphate regulon repressor |
| ORF04478 | 8955 & 8956 | Hypothetical sugar kinase yihV |
| ORF04479 | 8957 & 8958 | 3-hydroxyisobutyrate dehydrogenase |
| ORF04480 | 8959 & 8960 | Tagatose 1,6-diphosphate aldolase 2 (Tagatose-bisphosphate aldolase 2) (D-tagotase-1,6-bisphophate aldolase 2) [4.1.—.—.] |
| ORF04481 | 8961 & 8962 | 2,3-butanediol dehydrogenase, putative |
| ORF04482 | 8963 & 8964 | major facilitator family transporter, truncation, putative |
| ORF04483 | 8965 & 8966 | major facilitator family transporter |
| ORF04484 | 8967 & 8968 | Aldose 1-epimerase superfamily |

TABLE 1-continued

Annotation of ORF00001 to ORF04995

| ORFnnnnn | SEQ ID NOs | Annotation |
|---|---|---|
| ORF04485 | 8969 & 8970 | haloacid dehalogenase-like hydrolase, putative |
| ORF04486 | 8971 & 8972 | ribonuclease BN, putative [3.1.—.—] |
| ORF04487 | 8973 & 8974 | D-tyrosyl-tRNA(Tyr) deacylase (dtd) [3.1.—.—] |
| ORF04488 | 8975 & 8976 | conserved membrane protein [2.3.1.18] |
| ORF04489 | 8977 & 8978 | lipase, GDXG family VCA0490 |
| ORF04490 | 8979 & 8980 | transcriptional regulator, Cro-Cl family |
| ORF04491 | 8981 & 8982 | Ribbon-helix-helix protein, copG family domain protein |
| ORF04492 | 8983 & 8984 | formate dehydrogenase accessory protein FdhE (fdhE) |
| ORF04493 | 8985 & 8986 | formate dehydrogenase, gamma subunit [1.2.1.2] |
| ORF04494 | 8987 & 8988 | formate dehydrogenase, beta subunit (FdxH) [1.2.1.2] |
| ORF04495 | 8989 & 8990 | formate dehydrogenase, alpha subunit [1.2.1.2] |
| ORF04496 | 8991 & 8992 | formate dehydrogenase, alpha subunit, selenocysteine-containing [1.2.1.2] |
| ORF04497 | 8993 & 8994 | formate dehydrogenase family accessory protein FdhD (fdhD) |
| ORF04498 | 8995 & 8996 | conserved hypothetical protein |
| ORF04499 | 8997 & 8998 | conserved hypothetical protein |
| ORF04500 | 8999 & 9000 | Putative glycoporin |
| ORF04501 | 9001 & 9002 | B. subtilis YulD protein homolog lin2978, putative |
| ORF04502 | 9003 & 9004 | Rhamnulose-1-phosphate aldolase |
| ORF04503 | 9005 & 9006 | L-rhamnose isomerase (rhaA) [5.3.1.14] |
| ORF04504 | 9007 & 9008 | sugar kinase [2.7.1.5] |
| ORF04505 | 9009 & 9010 | hypothetical protein |
| ORF04506 | 9011 & 9012 | L-rhamnose operon Regulatory protein rhaS |
| ORF04507 | 9013 & 9014 | positive regulator for rhaRS operon |
| ORF04508 | 9015 & 9016 | L-rhamnose-proton symport |
| ORF04509 | 9017 & 9018 | Superoxide dismutase [Mn] (sodA) [1.15.1.1] |
| ORF04510 | 9019 & 9020 | conserved hypothetical protein |
| ORF04511 | 9021 & 9022 | 2-keto-3-deoxygluconate transporter (kdgT) |
| ORF04512 | 9023 & 9024 | MOSC domain protein |
| ORF04513 | 9025 & 9026 | Sensor protein cpxA [2.7.3.—] |
| ORF04514 | 9027 & 9028 | Transcriptional Regulatory protein cpxR |
| ORF04515 | 9029 & 9030 | Periplasmic protein cpxP precursor |
| ORF04516 | 9031 & 9032 | protein p34 |
| ORF04517 | 9033 & 9034 | 6-phosphofructokinase I |
| ORF04518 | 9035 & 9036 | Sulfate-binding protein precursor |
| ORF04519 | 9037 & 9038 | CDP-diacylglycerol pyrophosphatase |
| ORF04520 | 9039 & 9040 | triosephosphate isomerase (tpiA) [5.3.1.1] |
| ORF04521 | 9041 & 9042 | Protein of unknown function (DUF1454) superfamily |
| ORF04522 | 9043 & 9044 | conserved membrane protein |
| ORF04523 | 9045 & 9046 | conserved hypothetical protein superfamily |
| ORF04524 | 9047 & 9048 | Universal stress protein D (UspA) |
| ORF04525 | 9049 & 9050 | Ferredoxin--NADP reductase (DA1) [1.18.1.2] |
| ORF04526 | 9051 & 9052 | fructose-1,6-bisphosphatase, class II (glpX) [3.1.3.11] |
| ORF04527 | 9053 & 9054 | glycerol kinase (glpk) [2.7.1.30] |
| ORF04528 | 9055 & 9056 | Glycerol uptake facilitator protein (Aquaglyceroporin) (glpF) |
| ORF04529 | 9057 & 9058 | Protein of unknown function (DUF904) superfamily |
| ORF04530 | 9059 & 9060 | regulator of ribonuclease activity A (rraA) |
| ORF04531 | 9061 & 9062 | 1,4-dihydroxy-2-naphthoate octaprenyltransferase (menA) [2.5.—.—] |
| ORF04532 | 9063 & 9064 | heat shock protein HsIVU, ATPase subunit HsIU (hsIU) |
| ORF04533 | 9065 & 9066 | peptidase component of the HsIUV protease |
| ORF04534 | 9067 & 9068 | cell division protein FtsN (ftsN) |
| ORF04535 | 9069 & 9070 | regulator for deo operon, udp, cdd, tsx |
| ORF04536 | 9071 & 9072 | Primosomal protein N' |
| ORF04537 | 9073 & 9074 | ribosomal protein L31 (rpmE) |
| ORF04538 | 9075 & 9076 | Protein of unknown function (DUF1105) superfamily |
| ORF04539 | 9077 & 9078 | Met repressor |
| ORF04540 | 9079 & 9080 | O-succinylhomoserine (thiol)-lyase (metB) [2.5.1.48] |
| ORF04541 | 9081 & 9082 | AKII-HDII protein [2.7.2.4] |
| ORF04542 | 9083 & 9084 | Nucleoside-specific channel-forming protein tsx precursor |
| ORF04543 | 9085 & 9086 | 5-nucleotidase family protein, putative |
| ORF04544 | 9087 & 9088 | 5'-nucleotidase, C-terminal domain protein |
| ORF04545 | 9089 & 9090 | 5-nucleotidase, putative |
| ORF04546 | 9091 & 9092 | conserved hypothetical protein |
| ORF04547 | 9093 & 9094 | 5-nucleotidase family protein, putative |
| ORF04548 | 9095 & 9096 | 5,10-methylenetetrahydrofolate reductase (metF) [1.7.99.5] |
| ORF04549 | 9097 & 9098 | catalase-peroxidase HPI (katG) [1.11.1.6] |
| ORF04550 | 9099 & 9100 | Hypothetical transport protein yijE |
| ORF04551 | 9101 & 9102 | Protein of unknown function (DUF1287) superfamily |
| ORF04552 | 9103 & 9104 | conserved hypothetical protein |
| ORF04553 | 9105 & 9106 | Glycerol dehydrogenase (NAD) [1.1.1.6] |
| ORF04554 | 9107 & 9108 | transaldolase, putative |
| ORF04555 | 9109 & 9110 | Phosphoenolpyruvate-protein phosphotransferase ptsA [2.7.3.9] |
| ORF04556 | 9111 & 9112 | PTS system, fructose-specific IIABC components |
| ORF04557 | 9113 & 9114 | PTS system, fructose-like-2 IIB component 1 (Phosphotransferase enzymeII, B component) [2.7.1.69] |
| ORF04558 | 9115 & 9116 | pyruvate formate-lyase [2.3.1.54] |
| ORF04559 | 9117 & 9118 | similar to E. coli pyruvate formate-lyase activating enzyme |

TABLE 1-continued

Annotation of ORF00001 to ORF04995

| ORFnnnnn | SEQ ID NOs | Annotation |
|---|---|---|
| ORF04560 | 9119 & 9120 | AraC-type DNA-binding domain-containing protein |
| ORF04561 | 9121 & 9122 | PTS system fructose-like IIB component 2 (phosphotransfer) [2.7.1.69] |
| ORF04562 | 9123 & 9124 | integral membrane protein, putative |
| ORF04563 | 9125 & 9126 | phosphoenolpyruvate carboxylase (ppc) [4.1.1.31] |
| ORF04564 | 9127 & 9128 | acetylornithine deacetylase (ArgE) (argE) [3.5.1.16] |
| ORF04565 | 9129 & 9130 | N-acetyl-gamma-glutamyl-phosphate reductase (argC) [1.2.1.38] |
| ORF04566 | 9131 & 9132 | acetylglutamate kinase (argB) [2.7.2.8] |
| ORF04567 | 9133 & 9134 | argininosuccinate lyase (argH) [4.3.2.1] |
| ORF04568 | 9135 & 9136 | Starvation sensing protein rspA |
| ORF04569 | 9137 & 9138 | major facilitator family transporter |
| ORF04570 | 9139 & 9140 | soluble pyridine nucleotide transhydrogenase (STH) [1.6.1.1] |
| ORF04571 | 9141 & 9142 | Hydrogen peroxide-inducible genes activator (oxyR) |
| ORF04572 | 9143 & 9144 | hippurate hydolase |
| ORF04573 | 9145 & 9146 | major facilitator family transporter |
| ORF04574 | 9147 & 9148 | transcriptional regulator, TetR family |
| ORF04575 | 9149 & 9150 | ATPase of the AAA+ class |
| ORF04576 | 9151 & 9152 | tRNA (uracil-5-)-methyltransferase (trmA) [2.1.1.35] |
| ORF04577 | 9153 & 9154 | TonB-dependent vitamin B12 receptor (btuB) |
| ORF04578 | 9155 & 9156 | glutamate racemase (murI) [5.1.1.3] |
| ORF04579 | 9157 & 9158 | hypothetical protein |
| ORF04580 | 9159 & 9160 | UDP-N-acetylenolpyruvoylglucosamine reductase (murB) [1.1.1.158] |
| ORF04581 | 9161 & 9162 | BirA bifunctional protein (BIRA) [6.3.4.15] |
| ORF04582 | 9163 & 9164 | pantothenate kinase (coaA) [2.7.1.33] |
| ORF04583 | 9165 & 9166 | translation elongation factor EF-Tu.B |
| ORF04584 | 9167 & 9168 | translation elongation factor EF-Tu.B |
| ORF04585 | 9169 & 9170 | protein chain elongation factor EF-Tu |
| ORF04586 | 9171 & 9172 | preprotein translocase SecE subunit (SecE) |
| ORF04587 | 9173 & 9174 | transcription termination-antitermination factor NusG (nusG) |
| ORF04588 | 9175 & 9176 | ribosomal protein L11 (rplK) |
| ORF04589 | 9177 & 9178 | ribosomal protein L1 (rplA) |
| ORF04590 | 9179 & 9180 | 50S ribosomal subunit protein L10 (RPLJ) |
| ORF04591 | 9181 & 9182 | ribosomal protein L7-L12 (rplL) |
| ORF04592 | 9183 & 9184 | DNA-directed RNA polymerase, beta subunit (rpoB) [2.7.7.6] |
| ORF04593 | 9185 & 9186 | DNA-directed RNA polymerase, beta' subunit (rpoC) [2.7.7.6] |
| ORF04594 | 9187 & 9188 | thiazole biosynthesis protein ThiH (thiH) |
| ORF04595 | 9189 & 9190 | 4-methyl-5-(beta-hydroxyethyl)thiazole monophosphate synthesis protein ThiG |
| ORF04596 | 9191 & 9192 | thiamine biosynthesis protein ThiS (thiS) |
| ORF04597 | 9193 & 9194 | thiazole biosynthesis adenylyltransferase ThiF (thiF) |
| ORF04598 | 9195 & 9196 | thiamine-phosphate pyrophosphorylase (thiE) [2.5.1.3] |
| ORF04599 | 9197 & 9198 | Thiamine biosynthesis protein thiC |
| ORF04600 | 9199 & 9200 | Regulator of sigma D |
| ORF04601 | 9201 & 9202 | MutT-nudix family protein [3.6.1.—] |
| ORF04602 | 9203 & 9204 | uroporphyrinogen decarboxylase (hemE) [4.1.1.37] |
| ORF04603 | 9205 & 9206 | endonuclease V (deoxyinosine 3endoduclease) |
| ORF04604 | 9207 & 9208 | Protein of unknown function, DUF superfamily |
| ORF04605 | 9209 & 9210 | DNA-binding protein HU-alpha (NS2) (HU-2) (HU) |
| ORF04606 | 9211 & 9212 | unnamed protein product |
| ORF04607 | 9213 & 9214 | Zinc resistance-associated protein precursor |
| ORF04608 | 9215 & 9216 | sensor kinase for HydG, hydrogenase 3 activity [2.7.3.—] |
| ORF04609 | 9217 & 9218 | Transcriptional Regulatory protein zraR (sigma54) |
| ORF04610 | 9219 & 9220 | phosphoribosylamine--glycine ligase (purD) [6.3.4.13] |
| ORF04611 | 9221 & 9222 | bifunctional purine biosynthesis protein PurH (purH) |
| ORF04612 | 9223 & 9224 | conserved hypothetical protein |
| ORF04613 | 9225 & 9226 | hypothetical protein |
| ORF04614 | 9227 & 9228 | conserved hypothetical protein |
| ORF04615 | 9229 & 9230 | acetyltransferase, GNAT family (putative) [2.3.1.—] |
| ORF04616 | 9231 & 9232 | homoserine O-succinyltransferase (metA) [2.3.1.46] |
| ORF04617 | 9233 & 9234 | malate synthase A (aceB) [2.3.3.9] |
| ORF04618 | 9235 & 9236 | isocitrate lyase (aceA) [4.1.3.1] |
| ORF04619 | 9237 & 9238 | Isocitrate dehydrogenase kinase-phosphatase(EC 3.1.3.—) (IDH kinase-phosphatase) (IDHK-P) [2.7.1.116] |
| ORF04620 | 9239 & 9240 | transcriptional regulator, putative |
| ORF04621 | 9241 & 9242 | hypothetical protein |
| ORF04622 | 9243 & 9244 | 5-methyltetrahydrofolate--homocysteine methyltransferase (metH) [2.1.1.13] |
| ORF04623 | 9245 & 9246 | conserved hypothetical protein |
| ORF04624 | 9247 & 9248 | Na-Pi-cotransporter II-related protein, putative |
| ORF04625 | 9249 & 9250 | Peptidase E (Alpha-aspartyl dipeptidase) (Asp-specificdipeptidase) (Dipeptidase E) (alpha) [3.4.13.21] |
| ORF04626 | 9251 & 9252 | L-sorbose 1-phosphate reductase [1.1.1.—] |
| ORF04627 | 9253 & 9254 | PTS system, mannose-specific IID component |
| ORF04628 | 9255 & 9256 | PTS system, mannose-specific IIC component [2.7.1.69] |
| ORF04629 | 9257 & 9258 | sorbose-permease PTS system IIB component (EIII-MAN) [2.7.1.69] |
| ORF04630 | 9259 & 9260 | PTS system, sorbose-specific IIA component (EIIA-Sor) (Sorbose-permease IIA component) (Phosphotransferase enzyme II, A component)(EC 2.7.1.69) (EIII-F-Sor) [2.7.1.69] |
| ORF04631 | 9261 & 9262 | D-glucitol-6-phosphate dehydrogenase [1.1.1.140] |

TABLE 1-continued

Annotation of ORF00001 to ORF04995

| ORFnnnnn | SEQ ID NOs | Annotation |
|---|---|---|
| ORF04632 | 9263 & 9264 | Putative transcriptional regulator of sorbose uptake and |
| ORF04633 | 9265 & 9266 | RNA pseudouridylate synthase family protein [4.2.1.70] |
| ORF04634 | 9267 & 9268 | conserved hypothetical protein |
| ORF04635 | 9269 & 9270 | asparate kinase, monofunctional class [2.7.2.4] |
| ORF04636 | 9271 & 9272 | glucose-6-phosphate isomerase (pgi) [5.3.1.9] |
| ORF04637 | 9273 & 9274 | conserved hypothetical protein |
| ORF04638 | 9275 & 9276 | lipoprotein, putative |
| ORF04639 | 9277 & 9278 | Protein of unknown function (DUF1017) superfamily |
| ORF04640 | 9279 & 9280 | otnG protein (o698) |
| ORF04641 | 9281 & 9282 | conserved hypothetical protein |
| ORF04642 | 9283 & 9284 | PsiE protein homolog |
| ORF04643 | 9285 & 9286 | Maltose transport system permease protein malG (malG) |
| ORF04644 | 9287 & 9288 | Maltose transport system permease protein malF (membrane) |
| ORF04645 | 9289 & 9290 | Maltose-binding periplasmic protein precursor |
| ORF04646 | 9291 & 9292 | Maltose-maltodextrin transport ATP-binding protein malK |
| ORF04647 | 9293 & 9294 | Maltoporin precursor (Maltose-inducible porin) (malL) |
| ORF04648 | 9295 & 9296 | Maltose operon periplasmic protein precursor (MalM) superfamily |
| ORF04649 | 9297 & 9298 | conserved hypothetical protein |
| ORF04650 | 9299 & 9300 | chorismate lyase [4.—.—.—] |
| ORF04651 | 9301 & 9302 | 4-hydroxybenzoate polyprenyl transferase (ubiA) [2.5.1.—] |
| ORF04652 | 9303 & 9304 | glycerol-3-phosphate O-acyltransferase [2.3.1.15] |
| ORF04653 | 9305 & 9306 | diacylglycerol kinase (DGK) [2.7.1.107] |
| ORF04654 | 9307 & 9308 | LexA repressor (lexA) [3.4.21.88] |
| ORF04655 | 9309 & 9310 | DNA-damage-inducible protein F, truncation |
| ORF04656 | 9311 & 9312 | Protein yjbJ-related protein |
| ORF04657 | 9313 & 9314 | Zinc uptake regulation protein |
| ORF04658 | 9315 & 9316 | tRNA-dihydrouridine synthase A [1.—.—.—] |
| ORF04659 | 9317 & 9318 | conserved hypothetical protein |
| ORF04660 | 9319 & 9320 | quinone oxidoreductase |
| ORF04661 | 9321 & 9322 | Putative oxidoreductase |
| ORF04662 | 9323 & 9324 | metabolite-proton symporter |
| ORF04663 | 9325 & 9326 | enoyl-CoA hydratase-isomerase family protein |
| ORF04664 | 9327 & 9328 | acetyl-CoA-transferase subunit, putative [2.8.3.—] |
| ORF04665 | 9329 & 9330 | LACI-FAMILY TRANSCRIPTION REGULATOR |
| ORF04666 | 9331 & 9332 | replicative DNA helicase (dnaB) [3.6.1.—] |
| ORF04667 | 9333 & 9334 | alanine racemase (alr) [5.1.1.1] |
| ORF04668 | 9335 & 9336 | transporter, putative |
| ORF04669 | 9337 & 9338 | NadR homolog |
| ORF04670 | 9339 & 9340 | Aromatic-amino-acid aminotransferase |
| ORF04671 | 9341 & 9342 | 2-oxoglutarate dehydrogenase, E1 component (sucA) [1.2.4.2] |
| ORF04672 | 9343 & 9344 | 2-oxoglutarate dehydrogenase, E2 component, dihydrolipoamide succinyltransferase (sucB) [2.3.1.61] |
| ORF04673 | 9345 & 9346 | dihydrolipoamide dehydrogenase (lpdA) [1.8.1.4] |
| ORF04674 | 9347 & 9348 | Succinyl-CoA synthetase beta chain (AF326913) [6.2.1.5] |
| ORF04675 | 9349 & 9350 | Succinyl-CoA synthetase alpha chain [6.2.1.5] |
| ORF04676 | 9351 & 9352 | anion transporter family protein |
| ORF04677 | 9353 & 9354 | two-component response regulator |
| ORF04678 | 9355 & 9356 | Putative lactate dehydrogenase |
| ORF04679 | 9357 & 9358 | Putative transport sensor protein |
| ORF04680 | 9359 & 9360 | HAD superfamily (subfamily IIIB) phosphatase, TIGR01672 (AphA) [3.1.3.—] |
| ORF04681 | 9361 & 9362 | conserved hypothetical protein TIGR00149 |
| ORF04682 | 9363 & 9364 | Protein yjbR |
| ORF04683 | 9365 & 9366 | excinuclease ABC, A subunit (uvrA) |
| ORF04684 | 9367 & 9368 | ssDNA-binding protein |
| ORF04685 | 9369 & 9370 | conserved hypothetical protein |
| ORF04686 | 9371 & 9372 | EAL domain protein |
| ORF04687 | 9373 & 9374 | regulatory protein soxS |
| ORF04688 | 9375 & 9376 | redox-sensitive transcriptional activator SoxR (soxR) |
| ORF04689 | 9377 & 9378 | xanthine-uracil permease family protein |
| ORF04690 | 9379 & 9380 | Na+-H+ antiporter |
| ORF04691 | 9381 & 9382 | transcriptional regulator, LysR family, putative |
| ORF04692 | 9383 & 9384 | conserved hypothetical protein |
| ORF04693 | 9385 & 9386 | murein hydrolase exporter |
| ORF04694 | 9387 & 9388 | LrgB-like family superfamily |
| ORF04695 | 9389 & 9390 | Sodium, solute symporter family protein (PutP) |
| ORF04696 | 9391 & 9392 | Protein of unknown function, DUF485 superfamily |
| ORF04697 | 9393 & 9394 | acetate--CoA ligase (acsA) [6.2.1.1] |
| ORF04698 | 9395 & 9396 | nitrite reductase (cytochrome; ammonia-forming (nrfA) [1.7.2.2] |
| ORF04699 | 9397 & 9398 | formate-dependent nitrite reductase NrfB |
| ORF04700 | 9399 & 9400 | NrfC protein (NrfC) [1.—.—.—] |
| ORF04701 | 9401 & 9402 | NrfD protein (NrfD) [1.—.—.—] |
| ORF04702 | 9403 & 9404 | cytochrome c-type biogenesis protein CcmF (ccmF) |
| ORF04703 | 9405 & 9406 | formate-dependent nitrite reductase |
| ORF04704 | 9407 & 9408 | Formate-dependent nitrite reductase complex nrfG subunit (nrfF) |
| ORF04705 | 9409 & 9410 | conserved hypothetical protein |
| ORF04706 | 9411 & 9412 | glutamate-aspartate symport protein (gltP) |

TABLE 1-continued

Annotation of ORF00001 to ORF04995

| ORFnnnnn | SEQ ID NOs | Annotation |
| --- | --- | --- |
| ORF04707 | 9413 & 9414 | conserved hypothetical protein |
| ORF04708 | 9415 & 9416 | ABC transporter, ATP-binding protein |
| ORF04709 | 9417 & 9418 | ABC transporter, nucleotide binding-ATPase protein [dipeptide] |
| ORF04710 | 9419 & 9420 | ABC transporter, permease protein (AE006058) |
| ORF04711 | 9421 & 9422 | ABC transporter permease protein (AE005357) |
| ORF04712 | 9423 & 9424 | ABC transporter, periplasmic oligo-dipeptide-nickel binding protein (AE005357) |
| ORF04713 | 9425 & 9426 | formate dehydrogenase, alpha subunit [1.2.1.2] |
| ORF04714 | 9427 & 9428 | formate dehydrogenase, alpha subunit, putative [1.2.1.2] |
| ORF04715 | 9429 & 9430 | matches PS00443: Glutamine amidotransferases class-II active site; similar to Pseudomonas cepacia fusaric acid resistance protein FusA |
| ORF04716 | 9431 & 9432 | Fusaric acid resistance protein conserved region family |
| ORF04717 | 9433 & 9434 | HlyD family secretion protein, putative |
| ORF04718 | 9435 & 9436 | conserved hypothetical protein |
| ORF04719 | 9437 & 9438 | metallo-beta-lactamase superfamily protein |
| ORF04720 | 9439 & 9440 | glucokinase (EC 2.7.1.2), putative [2.7.1.2] |
| ORF04721 | 9441 & 9442 | ribulose-phosphate 3-epimerase (rpe) [5.1.3.1] |
| ORF04722 | 9443 & 9444 | ribose ABC transporter, permease protein (permease) |
| ORF04723 | 9445 & 9446 | ribose ABC transporter, permease protein (ECOWU89) |
| ORF04724 | 9447 & 9448 | D-allose transport ATP-binding protein alsA (aldose) |
| ORF04725 | 9449 & 9450 | hypothetical protein |
| ORF04726 | 9451 & 9452 | D-allose-binding periplasmic protein precursor (ALBP) |
| ORF04727 | 9453 & 9454 | Transcriptional regulator, putative |
| ORF04728 | 9455 & 9456 | hypothetical protein |
| ORF04729 | 9457 & 9458 | ribose 5-phosphate isomerase B (rpiB) [5.3.1.6] |
| ORF04730 | 9459 & 9460 | conserved hypothetical protein |
| ORF04731 | 9461 & 9462 | PhnP protein (phnp) |
| ORF04732 | 9463 & 9464 | PhnO protein |
| ORF04733 | 9465 & 9466 | phosphonate metabolism protein-1,5-bisphosphokinase (PRPP-forming) PhnN (phnN) |
| ORF04734 | 9467 & 9468 | phosphonate metabolism protein PhnM (phnM) |
| ORF04735 | 9469 & 9470 | phosphonate C-P lyase system protein PhnL (phnL) |
| ORF04736 | 9471 & 9472 | phosphonate C-P lyase system protein PhnK (phnK) |
| ORF04737 | 9473 & 9474 | Phosphonate metabolism protein PhnJ |
| ORF04738 | 9475 & 9476 | Bacterial phosphonate metabolism protein (PhnI) |
| ORF04739 | 9477 & 9478 | Bacterial phosphonate metabolism protein (PhnH) |
| ORF04740 | 9479 & 9480 | PhnG protein |
| ORF04741 | 9481 & 9482 | phosphonates metabolism transcriptional regulator PhnF (phnF) |
| ORF04742 | 9483 & 9484 | membrane channel protein component of Pn transporter |
| ORF04743 | 9485 & 9486 | phosphonate ABC transporter, substrate-binding protein, putative |
| ORF04744 | 9487 & 9488 | phosphonate ABC transporter, ATP-binding protein (phnC) |
| ORF04745 | 9489 & 9490 | PhnB protein |
| ORF04746 | 9491 & 9492 | alkylphosphonate utilization operon protein PhnA |
| ORF04747 | 9493 & 9494 | conserved hypothetical protein |
| ORF04748 | 9495 & 9496 | conserved hypothetical protein |
| ORF04749 | 9497 & 9498 | amino acid MFS transporter (PPII) |
| ORF04750 | 9499 & 9500 | Sensor protein basS-pmrB |
| ORF04751 | 9501 & 9502 | Transcriptional Regulatory protein basR-pmrA |
| ORF04752 | 9503 & 9504 | predicted membrane-associated, metal-dependent hydrolase |
| ORF04753 | 9505 & 9506 | Arginine-agmatine antiporter |
| ORF04754 | 9507 & 9508 | HTH-type transcriptional regulator adiY |
| ORF04755 | 9509 & 9510 | arginine decarboxylase [4.1.1.19] |
| ORF04756 | 9511 & 9512 | arginine decarboxylase adi, biodegradative (ldc) [4.1.1.19] |
| ORF04757 | 9513 & 9514 | Melibiose operon regulatory protein (AF049243) |
| ORF04758 | 9515 & 9516 | glycosyl hydrolase, family 4, putative [3.2.1.22] |
| ORF04759 | 9517 & 9518 | membrane protein, putative |
| ORF04760 | 9519 & 9520 | fumarate hydratase class I, anaerobic [4.2.1.2] |
| ORF04761 | 9521 & 9522 | anaerobic C4-dicarboxylate membrane transporter |
| ORF04762 | 9523 & 9524 | conserved hypothetical protein |
| ORF04763 | 9525 & 9526 | response regulator VC1604 (partial) |
| ORF04764 | 9527 & 9528 | Sensor protein dcuS [2.7.3.—] |
| ORF04765 | 9529 & 9530 | hypothetical protein |
| ORF04766 | 9531 & 9532 | YjdL-like protein |
| ORF04767 | 9533 & 9534 | acetyltransferase, GNAT family (GNAT) |
| ORF04768 | 9535 & 9536 | lysyl-tRNA synthetase (lysS) [6.1.1.6] |
| ORF04769 | 9537 & 9538 | PTR2-family transport protein STY0750 (POT) |
| ORF04770 | 9539 & 9540 | CadA (ldc) [4.1.1.18] |
| ORF04771 | 9541 & 9542 | transport of lysine-cadaverine |
| ORF04772 | 9543 & 9544 | transcriptional activator |
| ORF04773 | 9545 & 9546 | hypothetical protein |
| ORF04774 | 9547 & 9548 | transcriptional regulator, TetR family domain protein, putative |
| ORF04775 | 9549 & 9550 | Thiol: disulfide interchange protein dsbD precursor (dsbD) [1.8.1.8] |
| ORF04776 | 9551 & 9552 | divalent cation tolerance protein cytochrome c biogenesis |
| ORF04777 | 9553 & 9554 | Anaerobic C4-dicarboxylate transporter dcuA (DcuA) |
| ORF04778 | 9555 & 9556 | aspartate ammonia-lyase (aspA) [4.3.1.1] |
| ORF04779 | 9557 & 9558 | suppressor of F exclusion of bacteriophage T7 |
| ORF04780 | 9559 & 9560 | Amino acid permease superfamily |

TABLE 1-continued

Annotation of ORF00001 to ORF04995

| ORFnnnnn | SEQ ID NOs | Annotation |
|---|---|---|
| ORF04781 | 9561 & 9562 | chaperonin, 10 kDa (groES) |
| ORF04782 | 9563 & 9564 | chaperonin GroEL (groL) |
| ORF04783 | 9565 & 9566 | conserved hypothetical protein |
| ORF04784 | 9567 & 9568 | conserved hypothetical protein |
| ORF04785 | 9569 & 9570 | lysine 2; 3-aminomutase |
| ORF04786 | 9571 & 9572 | translation elongation factor P (efp) |
| ORF04787 | 9573 & 9574 | Entericidin B precursor-related protein |
| ORF04788 | 9575 & 9576 | Entericidin B precursor-related protein |
| ORF04789 | 9577 & 9578 | SugEL |
| ORF04790 | 9579 & 9580 | Outer membrane lipoprotein blc precursor |
| ORF04791 | 9581 & 9582 | beta-lactamase |
| ORF04792 | 9583 & 9584 | fumarate reductase, anaerobic, membrane anchor polypeptide |
| ORF04793 | 9585 & 9586 | Fumarate reductase subunit C (Fumarate reductase 15 kDa hydrophobicprotein) (frdC) [1.3.99.1] |
| ORF04794 | 9587 & 9588 | fumarate reductase, anaerobic, iron-sulfur protein subunit |
| ORF04795 | 9589 & 9590 | fumarate reductase, flavoprotein subunit (frdA) [1.3.99.1] |
| ORF04796 | 9591 & 9592 | Iysyl-tRNA synthetase-related protein GenX |
| ORF04797 | 9593 & 9594 | amino acid permease |
| ORF04798 | 9595 & 9596 | conserved hypothetical protein |
| ORF04799 | 9597 & 9598 | conserved hypothetical protein |
| ORF04800 | 9599 & 9600 | unnamed protein product |
| ORF04801 | 9601 & 9602 | phosphatidylserine decarboxylase phospholipid synthesis |
| ORF04802 | 9603 & 9604 | Predicted GTPases |
| ORF04803 | 9605 & 9606 | Oligoribonuclease |
| ORF04804 | 9607 & 9608 | unnamed protein product |
| ORF04805 | 9609 & 9610 | predicted sugar kinase |
| ORF04806 | 9611 & 9612 | conserved hypothetical protein TIGR00150 |
| ORF04807 | 9613 & 9614 | N-acetylmuramoyl-l-alanine amidase II a murein hydrolase |
| ORF04808 | 9615 & 9616 | DNA mismatch repair protein mutL |
| ORF04809 | 9617 & 9618 | tRNA delta(2)-isopentenylpyrophosphate transferase (miaA) [2.5.1.8] |
| ORF04810 | 9619 & 9620 | host factor I (HF-I) |
| ORF04811 | 9621 & 9622 | GTP-binding protein hflX |
| ORF04812 | 9623 & 9624 | HflK protein (hflK) [3.4.—.—] |
| ORF04813 | 9625 & 9626 | HflC protein (hflC) |
| ORF04814 | 9627 & 9628 | hypothetical protein |
| ORF04815 | 9629 & 9630 | conserved hypothetical protein |
| ORF04816 | 9631 & 9632 | hypothetical protein |
| ORF04817 | 9633 & 9634 | adenylosuccinate synthetase (purA) [6.3.4.4] |
| ORF04818 | 9635 & 9636 | Predicted transcriptional regulator |
| ORF04819 | 9637 & 9638 | ribonuclease R (rnr) [3.1.—.—] |
| ORF04820 | 9639 & 9640 | RNA methyltransferase, TrmH family, group 3 |
| ORF04821 | 9641 & 9642 | conserved hypothetical protein |
| ORF04822 | 9643 & 9644 | PspA-IM30 family protein |
| ORF04823 | 9645 & 9646 | conserved hypothetical protein |
| ORF04824 | 9647 & 9648 | predicted membrane protein (o132) |
| ORF04825 | 9649 & 9650 | Protein of unknown function (DUF1190) superfamily |
| ORF04826 | 9651 & 9652 | glutathionylspermidine synthase (O386) |
| ORF04827 | 9653 & 9654 | fadE8 |
| ORF04828 | 9655 & 9656 | Protein of unknown function (DUF1471) superfamily |
| ORF04829 | 9657 & 9658 | Protein of unknown function (DUF1471) family |
| ORF04830 | 9659 & 9660 | Hydrolases of the alpha-beta superfamily (putative) |
| ORF04831 | 9661 & 9662 | transcriptional regulator, DeoR family, putative |
| ORF04832 | 9663 & 9664 | Predicted Zn-dependent hydrolase of the beta-lactamase fold |
| ORF04833 | 9665 & 9666 | Putative sugar-specific permease, SgaT-UlaA superfamily, putative |
| ORF04834 | 9667 & 9668 | putative IIB protein of PTS system |
| ORF04835 | 9669 & 9670 | protein-Npi-phosphohistidine-sugar phosphotransferase (Ntr-type) [2.7.1.69] |
| ORF04836 | 9671 & 9672 | hexulose-6-phosphate synthase (humps) |
| ORF04837 | 9673 & 9674 | hexulose-6-phosphate isomerase, putative |
| ORF04838 | 9675 & 9676 | AraD |
| ORF04839 | 9677 & 9678 | Protein of unknown function (DUF1471) superfamily |
| ORF04840 | 9679 & 9680 | 30S ribosomal protein (rpS6) |
| ORF04841 | 9681 & 9682 | Single-strand binding protein family |
| ORF04842 | 9683 & 9684 | ribosomal protein S18 (rpsR) |
| ORF04843 | 9685 & 9686 | ribosomal protein L9 (rpll) |
| ORF04844 | 9687 & 9688 | conserved hypothetical protein |
| ORF04845 | 9689 & 9690 | MFS transporter, phthalate permease family, putative |
| ORF04846 | 9691 & 9692 | Putative oxidoreductase |
| ORF04847 | 9693 & 9694 | acetyl-CoA-transferase subunit, putative |
| ORF04848 | 9695 & 9696 | enoyl-CoA hydratase-isomerase FadB1x, putative [4.2.1.55] |
| ORF04849 | 9697 & 9698 | 3-dehydroshikimate dehydratase |
| ORF04850 | 9699 & 9700 | conserved hypothetical protein |
| ORF04851 | 9701 & 9702 | 3-oxoacyl-(acyl-carrier-protein) reductase |
| ORF04852 | 9703 & 9704 | Opacity-associated protein A superfamily |
| ORF04853 | 9705 & 9706 | Putative conserved protein |
| ORF04854 | 9707 & 9708 | FKBP-type 22 kDa peptidyl-prolyl cis-trans isomerase (rotamase) [5.2.1.8] |
| ORF04855 | 9709 & 9710 | D-serine-D-alanine-glycine transporter |

TABLE 1-continued

Annotation of ORF00001 to ORF04995

| ORFnnnnn | SEQ ID NOs | Annotation |
|---|---|---|
| ORF04856 | 9711 & 9712 | ScdA protein, putative |
| ORF04857 | 9713 & 9714 | integral membrane protein (f324) |
| ORF04858 | 9715 & 9716 | conserved hypothetical protein |
| ORF04859 | 9717 & 9718 | Predicted transcriptional regulators |
| ORF04860 | 9719 & 9720 | 2',3'-cyclic-nucleotide 2'-phosphodiesterase (cpdB) [3.1.4.16] |
| ORF04861 | 9721 & 9722 | conserved hypothetical protein YtfJ-family, TIGR01626 |
| ORF04862 | 9723 & 9724 | 3'(2'),5'-bisphosphate nucleotidase (cysQ) [3.1.3.7] |
| ORF04863 | 9725 & 9726 | Protein of unknown function (DUF1107) superfamily |
| ORF04864 | 9727 & 9728 | Hypothetical UPF0053 protein ytfL |
| ORF04865 | 9729 & 9730 | peptide methionine sulfoxide reductase |
| ORF04866 | 9731 & 9732 | unnamed protein product |
| ORF04867 | 9733 & 9734 | Family of unknown function (DUF490) family |
| ORF04868 | 9735 & 9736 | Hypothetical UPF0131 protein ytfP |
| ORF04869 | 9737 & 9738 | inorganic pyrophosphatase (ppa) [3.6.1.1] |
| ORF04870 | 9739 & 9740 | periplasmic ribose-binding protein |
| ORF04871 | 9741 & 9742 | ATP binding protein of ABC transporter |
| ORF04872 | 9743 & 9744 | ribose ABC transporter, permease protein VCA0129 |
| ORF04873 | 9745 & 9746 | ribose ABC transporter, permease protein |
| ORF04874 | 9747 & 9748 | fructose-1,6-bisphosphatase (fbp) [3.1.3.11] |
| ORF04875 | 9749 & 9750 | conserved hypothetical protein |
| ORF04876 | 9751 & 9752 | UDP-N-acetylmuramate: L-alanyl-gamma-D-glutamyl-meso-diaminopimelate ligase (mpl) |
| ORF04877 | 9753 & 9754 | Hypothetical UPF0307 protein yjgA (x96 protein) |
| ORF04878 | 9755 & 9756 | PmbA protein (pmbA) |
| ORF04879 | 9757 & 9758 | Soluble cytochrome b562 precursor (562) |
| ORF04880 | 9759 & 9760 | Anaerobic ribonucleoside-triphosphate reductase activating protein(EC 1.97.1.4) (Class III anaerobic ribonucleotide reductase smallcomponent) [1.97.1.4] |
| ORF04881 | 9761 & 9762 | anaerobic ribonucleoside-triphosphate reductase [1.17.4.2] |
| ORF04882 | 9763 & 9764 | hypothetical protein |
| ORF04883 | 9765 & 9766 | alpha, alpha-phosphotrehalase (treC) [3.2.1.93] |
| ORF04884 | 9767 & 9768 | PTS system, trehalose-specific IIBC component (treP) [2.7.1.69] |
| ORF04885 | 9769 & 9770 | trehalose operon repressor (treR) |
| ORF04886 | 9771 & 9772 | magnesium-translocating P-type ATPase (mgtA) [3.6.3.2] |
| ORF04887 | 9773 & 9774 | endoribonuclease L-PSP, putative |
| ORF04888 | 9775 & 9776 | aspartate carbamoyltransferase, regulatory subunit (pyrI) |
| ORF04889 | 9777 & 9778 | aspartate carbamoyltransferase (pyrB) [2.1.3.2] |
| ORF04890 | 9779 & 9780 | arginine repressor |
| ORF04891 | 9781 & 9782 | membrane protein, putative |
| ORF04892 | 9783 & 9784 | ornithine carbamoyltransferase (argF) [2.1.3.3] |
| ORF04893 | 9785 & 9786 | carbamate kinase (arcC) [2.7.2.2] |
| ORF04894 | 9787 & 9788 | arginine deiminase (arcA) [3.5.3.6] |
| ORF04895 | 9789 & 9790 | Protein yjgK |
| ORF04896 | 9791 & 9792 | ornithine carbamoyltransferase (argF) [2.1.3.3] |
| ORF04897 | 9793 & 9794 | Protein |
| ORF04898 | 9795 & 9796 | hypothetical protein |
| ORF04899 | 9797 & 9798 | acetyltransferase, GNAT family family |
| ORF04900 | 9799 & 9800 | probable innner membrane protein STY4813 |
| ORF04901 | 9801 & 9802 | valyl-tRNA synthetase (valS) [6.1.1.9] |
| ORF04902 | 9803 & 9804 | DNA polymerase III, chi subunit [2.7.7.7] |
| ORF04903 | 9805 & 9806 | Cytosol aminopeptidase (Leucine aminopeptidase) (LAP)(Leucyl aminopeptidase) (Aminopeptidase A-I) (LAP) [3.4.11.1] |
| ORF04904 | 9807 & 9808 | conserved hypothetical protein |
| ORF04905 | 9809 & 9810 | unnamed protein product |
| ORF04906 | 9811 & 9812 | hypothetical protein |
| ORF04907 | 9813 & 9814 | predicted permease |
| ORF04908 | 9815 & 9816 | conserved ATP-binding protein |
| ORF04909 | 9817 & 9818 | L-idonate Regulatory protein (gnt) |
| ORF04910 | 9819 & 9820 | Gnt-II system L-idonate transporter |
| ORF04911 | 9821 & 9822 | PROBABLE GLUCONATE 5-DEHYDROGENASE OXIDOREDUCTASE PROTEIN [1.1.1.69] |
| ORF04912 | 9823 & 9824 | 2,3-butanediol dehydrogenase [1.1.1.264] |
| ORF04913 | 9825 & 9826 | thermoresistant gluconokinase [2.7.1.12] |
| ORF04914 | 9827 & 9828 | NADP-dependent alcohol dehydrogenase [1.1.1.—] |
| ORF04915 | 9829 & 9830 | Integrase |
| ORF04916 | 9831 & 9832 | CII protein |
| ORF04917 | 9833 & 9834 | Beta protein |
| ORF04918 | 9835 & 9836 | Polarity suppression protein (Amber mutation-suppressing protein) |
| ORF04919 | 9837 & 9838 | Transactivation protein |
| ORF04920 | 9839 & 9840 | Glycoprotein 3 (Capsid size determination protein) |
| ORF04921 | 9841 & 9842 | phage DNA binding protein |
| ORF04922 | 9843 & 9844 | unnamed protein product; cI gene product (AA 1-137) |
| ORF04923 | 9845 & 9846 | conserved hypothetical protein |
| ORF04924 | 9847 & 9848 | conserved hypothetical protein |
| ORF04925 | 9849 & 9850 | Bacteriophage P4 DNA primase [2.7.7.—] |
| ORF04926 | 9851 & 9852 | hypothetical protein |
| ORF04927 | 9853 & 9854 | hypothetical protein |

TABLE 1-continued

Annotation of ORF00001 to ORF04995

| ORFnnnnn | SEQ ID NOs | Annotation |
| --- | --- | --- |
| ORF04928 | 9855 & 9856 | ATP-dependent protease La |
| ORF04929 | 9857 & 9858 | conserved hypothetical protein |
| ORF04930 | 9859 & 9860 | conserved hypothetical protein |
| ORF04931 | 9861 & 9862 | unnamed protein product; ORF616 |
| ORF04932 | 9863 & 9864 | Kelch motif domain protein |
| ORF04933 | 9865 & 9866 | Oligogalacturonate-specific porin protein (KdgM) superfamily |
| ORF04934 | 9867 & 9868 | FimB protein |
| ORF04935 | 9869 & 9870 | recombinase involved in phase variation regulator for |
| ORF04936 | 9871 & 9872 | type 1 fimbrial protein fimA precursor |
| ORF04937 | 9873 & 9874 | fimbrial protein |
| ORF04938 | 9875 & 9876 | Chaperone protein fimC precursor |
| ORF04939 | 9877 & 9878 | Outer membrane usher protein fimD precursor |
| ORF04940 | 9879 & 9880 | FimF protein precursor |
| ORF04941 | 9881 & 9882 | fimbrial morphology |
| ORF04942 | 9883 & 9884 | FimH |
| ORF04943 | 9885 & 9886 | mannonate dehydratase (uxuA) [4.2.1.8] |
| ORF04944 | 9887 & 9888 | D-mannonate oxidoreductase [1.1.1.57[ |
| ORF04945 | 9889 & 9890 | regulator of uxu operon |
| ORF04946 | 9891 & 9892 | Protein of unknown function (DUF1316) subfamily |
| ORF04947 | 9893 & 9894 | phosphoenolpyruvate-protein phosphotransferase, EI-HPr-EIIA components |
| ORF04948 | 9895 & 9896 | dihydroxyacetone kinase, L subunit [2.7.1.—] |
| ORF04949 | 9897 & 9898 | dihydroxyacetone kinase, DhaK subunit (dhaK) [2.7.1.—] |
| ORF04950 | 9899 & 9900 | hypothetical protein |
| ORF04951 | 9901 & 9902 | glycerol dehydrogenase CgrD (NAD) [1.1.1.6] |
| ORF04952 | 9903 & 9904 | putative transporter CgxT |
| ORF04953 | 9905 & 9906 | invasion protein IbeA |
| ORF04954 | 9907 & 9908 | choline-glycine betaine transporter |
| ORF04955 | 9909 & 9910 | Glycerate kinase [2.7.1.31] |
| ORF04956 | 9911 & 9912 | 2-hydroxy-3-oxopropionate reductase [1.1.1.60] |
| ORF04957 | 9913 & 9914 | hydroxypyruvate isomerase [5.3.1.22] |
| ORF04958 | 9915 & 9916 | hypothetical protein |
| ORF04959 | 9917 & 9918 | glyoxylate carboligase [4.1.1.47] |
| ORF04960 | 9919 & 9920 | glyoxylate carboligase [4.1.1.47] |
| ORF04961 | 9921 & 9922 | NtrC family Transcriptional regulator, ATPase domain |
| ORF04962 | 9923 & 9924 | invasion protein IbeA |
| ORF04963 | 9925 & 9926 | hypothetical protein |
| ORF04964 | 9927 & 9928 | Na+-H+ antiporter NhaC (nhaC) |
| ORF04965 | 9929 & 9930 | Hypothetical transcriptional regulator yjiE |
| ORF04966 | 9931 & 9932 | hypothetical protein |
| ORF04967 | 9933 & 9934 | isoaspartyl dipeptidase (iadA) [3.4.19.—] |
| ORF04968 | 9935 & 9936 | uncharacterized membrane protein |
| ORF04969 | 9937 & 9938 | Nucleoside recognition domain protein |
| ORF04970 | 9939 & 9940 | RNA 2'-phosphotransferase, Tpt1 - KptA family domain protein |
| ORF04971 | 9941 & 9942 | conserved hypothetical protein |
| ORF04972 | 9943 & 9944 | membrane protein, putative |
| ORF04973 | 9945 & 9946 | SrgB |
| ORF04974 | 9947 & 9948 | conserved hypothetical protein |
| ORF04975 | 9949 & 9950 | Activator of 2-hydroxyglutaryl-CoA dehydratase (HSP70-class ATPase domain) |
| ORF04976 | 9951 & 9952 | 2-hydroxyglutaryl-CoA dehydratase subunit beta homolog |
| ORF04977 | 9953 & 9954 | Protein of unknown function (DUF445) superfamily |
| ORF04978 | 9955 & 9956 | transposase |
| ORF04979 | 9957 & 9958 | conserved protein |
| ORF04980 | 9959 & 9960 | conserved hypothetical protein |
| ORF04981 | 9961 & 9962 | Type I restriction enzyme EcokI specificity protein (S protein)(S.EcoKI) [3.1.21.3] |
| ORF04982 | 9963 & 9964 | Type I restriction enzyme EcokI M protein (M.EcoKI) [2.1.1.72] |
| ORF04983 | 9965 & 9966 | Type I restriction enzyme EcokI R protein (R.EcoKI) [3.1.21.3] |
| ORF04984 | 9967 & 9968 | Mrr restriction system protein (EcoKMrr) |
| ORF04985 | 9969 & 9970 | CobW-P47K family protein domain protein |
| ORF04986 | 9971 & 9972 | Uncharacterized small protein |
| ORF04987 | 9973 & 9974 | YjiY |
| ORF04988 | 9975 & 9976 | Methyl-accepting chemotaxis protein I (MCP-I) (Serine chemoreceptorprotein) (MCP-I) |
| ORF04989 | 9977 & 9978 | C4-dicarboxylate transporter large subunit (DctM) |
| ORF04990 | 9979 & 9980 | TRAP transporter, DctQ-like membrane protein superfamily |
| ORF04991 | 9981 & 9982 | DctP protein |
| ORF04992 | 9983 & 9984 | Na+-H+ antiporter |
| ORF04993 | 9985 & 9986 | yjjM gene product |
| ORF04994 | 9987 & 9988 | sorbitol dehydrogenase, putative [1.1.1.14] |
| ORF04995 | 9989 & 9990 | hypothetical protein |

TABLE 2

142 preferred antigens

| | | | | |
|---|---|---|---|---|
| ORF00010 | ORF00017 | ORF00029 | ORF00041 | ORF00130 |
| ORF00250 | ORF00251 | ORF00252 | ORF00332 | ORF00333 |
| ORF00342 | ORF00353 | ORF00394 | ORF00405 | ORF00469 |
| ORF00631 | ORF00773 | ORF00905 | ORF00908 | ORF01034 |
| ORF01037 | ORF01056 | ORF01090 | ORF01103 | ORF01104 |
| ORF01108 | ORF01115 | ORF01118 | ORF01119 | ORF01194 |
| ORF01202 | ORF01207 | ORF01208 | ORF01214 | ORF01228 |
| ORF01236 | ORF01337 | ORF01338 | ORF01339 | ORF01340 |
| ORF01341 | ORF01342 | ORF01344 | ORF01348 | ORF01349 |
| ORF01350 | ORF01351 | ORF01365 | ORF01371 | ORF01462 |
| ORF01477 | ORF01491 | ORF01503 | ORF01506 | ORF01589 |
| ORF01590 | ORF01592 | ORF01656 | ORF01660 | ORF01705 |
| ORF01722 | ORF01723 | ORF01855 | ORF01932 | ORF02307 |
| ORF02314 | ORF02392 | ORF02412 | ORF02424 | ORF02470 |
| ORF02554 | ORF02735 | ORF02816 | ORF02828 | ORF02829 |
| ORF02830 | ORF02831 | ORF02832 | ORF02833 | ORF02834 |
| ORF02847 | ORF02866 | ORF02868 | ORF02878 | ORF02888 |
| ORF03011 | ORF03020 | ORF03021 | ORF03025 | ORF03044 |
| ORF03166 | ORF03174 | ORF03176 | ORF03235 | ORF03252 |
| ORF03262 | ORF03300 | ORF03348 | ORF03349 | ORF03364 |
| ORF03459 | ORF03501 | ORF03504 | ORF03507 | ORF03512 |
| ORF03515 | ORF03516 | ORF03517 | ORF03518 | ORF03519 |
| ORF03520 | ORF03522 | ORF03535 | ORF03539 | ORF03540 |
| ORF03541 | ORF03542 | ORF03575 | ORF03576 | ORF03579 |
| ORF03580 | ORF03613 | ORF04162 | ORF04163 | ORF04184 |
| ORF04203 | ORF04204 | ORF04282 | ORF04390 | ORF04391 |
| ORF04402 | ORF04477 | ORF04608 | ORF04693 | ORF04694 |
| ORF04844 | ORF04845 | ORF04849 | ORF04851 | ORF04922 |
| ORF04924 | ORF04925 | | | |

Cytoplasmic location: ORF00252, ORF01056, ORF01337, ORF01341, ORF01344, ORF01348, ORF01371, ORF01477, ORF02424, ORF02833, ORF03348, ORF03504, ORF03542, ORF04162, ORF04844.
Inner membrane location: ORF00010, ORF00017, ORF00029, ORF00041, ORF00130, ORF00332, ORF00333, ORF00342, ORF00353, ORF00394, ORF00405, ORF00631, ORF00773, ORF00905, ORF01034, ORF01037, ORF01090, ORF01103, ORF01104, ORF01108, ORF01115, ORF01118, ORF01119, ORF01194, ORF01202, ORF01207, ORF01208, ORF01214, ORF01338, ORF01339, ORF01349, ORF01350, ORF01365, ORF01462, ORF01491, ORF01503, ORF01506, ORF01590, ORF01705, ORF01722, ORF01723, ORF01855, ORF01932, ORF02314, ORF02392, ORF02412, ORF02470, ORF02554, ORF02735, ORF02847, ORF02868, ORF02878, ORF02888, ORF03020, ORF03021, ORF03025, ORF03044, ORF03174, ORF03176, ORF03235, ORF03300, ORF03349, ORF03364, ORF03459, ORF03501, ORF03507, ORF03512, ORF03519, ORF03520, ORF03535, ORF03539, ORF03540, ORF03575, ORF03576, ORF03579, ORF03580, ORF04163, ORF04184, ORF04203, ORF04204, ORF04402, ORF04477, ORF04608, ORF04693, ORF04694, ORF04845, ORF04849, ORF04851, ORF04922, ORF04924, ORF04925.
Outer membrane location: ORF00250, ORF00251, ORF00469, ORF01228, ORF01236, ORF01340, ORF01342, ORF01351, ORF01592, ORF01656, ORF02829, ORF02831, ORF02834, ORF03166, ORF03517, ORF03613, ORF04282.
Periplasmic location: ORF00908, ORF01589, ORF01660, ORF02307, ORF02816, ORF02828, ORF02830, ORF02832, ORF02866, ORF03011, ORF03252, ORF03262, ORF03515, ORF03516, ORF03518, ORF03522, ORF03541, ORF04390, ORF04391

TABLE 3 low homology with commensal strains

ORF00010, ORF00016, ORF00017, ORF00018, ORF00019, ORF00020, ORF00025, ORF00028, ORF00029, ORF00030, ORF00031, ORF00032, ORF00034, ORF00035, ORF00036, ORF00037, ORF00041, ORF00042, ORF00043, ORF00044, ORF00045, ORF00046, ORF00047, ORF00048, ORF00049, ORF00050, ORF00051, ORF00052, ORF00053, ORF00054, ORF00055, ORF00056, ORF00057, ORF00058, ORF00059, ORF00060, ORF00061, ORF00062, ORF00064, ORF00065, ORF00067, ORF00068, ORF00069, ORF00070, ORF00089, ORF00090, ORF00106, ORF00107, ORF00119, ORF00120, ORF00121, ORF00130, ORF00134, ORF00150, ORF00151, ORF00152, ORF00163, ORF00169, ORF00198, ORF00222, ORF00223, ORF00224, ORF00225, ORF00226, ORF00231, ORF00232, ORF00233, ORF00250, ORF00251, ORF00252, ORF00253, ORF00254, ORF00255, ORF00256, ORF00257, ORF00330, ORF00331, ORF00332, ORF00333, ORF00334, ORF00335, ORF00336, ORF00337, ORF00338, ORF00339, ORF00340, ORF00341, ORF00342, ORF00343, ORF00344, ORF00345, ORF00346, ORF00347, ORF00348, ORF00349, ORF00350, ORF00351, ORF00352, ORF00353, ORF00361, ORF00379, ORF00380, ORF00381, ORF00382, ORF00383, ORF00394, ORF00395, ORF00396, ORF00397, ORF00399, ORF00400, ORF00401, ORF00402, ORF00403, ORF00404, ORF00407, ORF00415, ORF00416, ORF00417, ORF00418, ORF00419, ORF00433, ORF00434, ORF00435, ORF00436, ORF00437, ORF00442, ORF00444, ORF00455, ORF00587, ORF00588, ORF00591, ORF00597, ORF00598, ORF00599, ORF00600, ORF00631, ORF00644, ORF00646, ORF00647, ORF00648, ORF00649, ORF00650, ORF00655, ORF00656, ORF00657, ORF00659, ORF00660, ORF00661, ORF00662, ORF00663, ORF00664, ORF00665, ORF00666, ORF00667, ORF00668, ORF00669, ORF00670, ORF00671, ORF00672, ORF00673, ORF00674, ORF00675, ORF00676, ORF00677, ORF00678, ORF00680, ORF00681, ORF00682, ORF00683, ORF00685, ORF00687, ORF00773, ORF00786, ORF00787, ORF00788, ORF00789, ORF00790, ORF00791, ORF00792, ORF00793, ORF00794, ORF00795, ORF00796, ORF00798, ORF00803, ORF00804, ORF00809, ORF00810, ORF00838, ORF00839, ORF00857, ORF00864, ORF00883, ORF00884, ORF00885, ORF00886, ORF00887, ORF00888, ORF00889, ORF00890, ORF00891, ORF00892, ORF00893, ORF00894, ORF00895, ORF00896, ORF00897, ORF00898, ORF00899, ORF00900, ORF00901, ORF00902, ORF00903, ORF00904, ORF00905, ORF00906, ORF00907, ORF00908, ORF00909, ORF00910, ORF00924, ORF00925, ORF00926, ORF00948, ORF00956, ORF01031, ORF01032, ORF01033, ORF01034, ORF01035, ORF01036, ORF01037, ORF01038, ORF01039, ORF01040, ORF01041, ORF01042, ORF01043, ORF01044, ORF01045, ORF01046, ORF01047, ORF01048, ORF01052, ORF01053, ORF01054, ORF01055, ORF01056, ORF01057, ORF01058, ORF01063, ORF01078, ORF01079, ORF01080, ORF01081, ORF01084, ORF01085, ORF01086, ORF01087, ORF01088, ORF01089, ORF01090, ORF01091, ORF01092, ORF01093, ORF01094, ORF01095, ORF01096, ORF01097, ORF01098, ORF01099, ORF01100, ORF01101, ORF01102, ORF01103, ORF01104, ORF01105, ORF01106, ORF01107, ORF01108, ORF01109, ORF01110, ORF01111, ORF01112, ORF01113, ORF01114, ORF01115, ORF01116, ORF01117, ORF01118, ORF01119, ORF01156, ORF01186, ORF01187, ORF01188, ORF01190, ORF01191, ORF01192, ORF01193, ORF01194, ORF01195, ORF01196, ORF01199, ORF01200, ORF01201, ORF01202, ORF01203, ORF01204, ORF01205, ORF01206, ORF01207, ORF01208, ORF01209, ORF01210, ORF01211, ORF01212, ORF01213, ORF01214, ORF01215, ORF01216, ORF01217, ORF01218, ORF01219, ORF01220, ORF01222, ORF01223, ORF01224, ORF01225, ORF01226, ORF01227, ORF01228, ORF01236, ORF01252, ORF01253, ORF01254, ORF01255, ORF01256, ORF01257, ORF01258, ORF01259, ORF01260, ORF01261, ORF01283, ORF01313, ORF01314, ORF01315, ORF01316, ORF01317, ORF01318, ORF01319, ORF01320, ORF01321, ORF01322, ORF01323, ORF01325, ORF01330, ORF01331, ORF01332, ORF01333, ORF01334, ORF01335, ORF01336, ORF01337, ORF01338, ORF01339, ORF01340, ORF01341, ORF01342, ORF01343, ORF01344, ORF01345, ORF01346, ORF01347, ORF01348, ORF01349, ORF01350,

TABLE 3-continued low homology with commensal strains

ORF01351, ORF01352, ORF01353, ORF01354, ORF01355, ORF01356, ORF01357, ORF01359, ORF01360,
ORF01361, ORF01365, ORF01366, ORF01367, ORF01368, ORF01371, ORF01373, ORF01374, ORF01375,
ORF01376, ORF01394, ORF01456, ORF01462, ORF01477, ORF01479, ORF01480, ORF01483, ORF01484,
ORF01485, ORF01486, ORF01487, ORF01488, ORF01490, ORF01491, ORF01492, ORF01493, ORF01494,
ORF01498, ORF01499, ORF01500, ORF01501, ORF01502, ORF01503, ORF01504, ORF01505, ORF01506,
ORF01507, ORF01508, ORF01509, ORF01510, ORF01511, ORF01512, ORF01513, ORF01514, ORF01518,
ORF01523, ORF01524, ORF01525, ORF01526, ORF01527, ORF01528, ORF01529, ORF01530, ORF01531,
ORF01532, ORF01533, ORF01534, ORF01535, ORF01536, ORF01537, ORF01538, ORF01539, ORF01540,
ORF01541, ORF01542, ORF01543, ORF01550, ORF01551, ORF01552, ORF01553, ORF01554, ORF01555,
ORF01556, ORF01557, ORF01558, ORF01559, ORF01560, ORF01561, ORF01562, ORF01563, ORF01564,
ORF01565, ORF01566, ORF01567, ORF01568, ORF01569, ORF01570, ORF01571, ORF01572, ORF01573,
ORF01574, ORF01575, ORF01576, ORF01577, ORF01578, ORF01583, ORF01588, ORF01589, ORF01590,
ORF01591, ORF01592, ORF01593, ORF01609, ORF01610, ORF01611, ORF01612, ORF01613, ORF01630,
ORF01631, ORF01637, ORF01651, ORF01655, ORF01656, ORF01657, ORF01658, ORF01659, ORF01660,
ORF01665, ORF01705, ORF01722, ORF01723, ORF01724, ORF01725, ORF01766, ORF01767, ORF01768,
ORF01769, ORF01770, ORF01790, ORF01810, ORF01812, ORF01813, ORF01815, ORF01816, ORF01817,
ORF01818, ORF01819, ORF01820, ORF01821, ORF01822, ORF01823, ORF01824, ORF01825, ORF01826,
ORF01827, ORF01828, ORF01829, ORF01830, ORF01831, ORF01832, ORF01833, ORF01834, ORF01835,
ORF01836, ORF01837, ORF01838, ORF01840, ORF01842, ORF01843, ORF01844, ORF01845, ORF01846,
ORF01847, ORF01848, ORF01849, ORF01850, ORF01852, ORF01853, ORF01854, ORF01855, ORF01856,
ORF01857, ORF01861, ORF01862, ORF01865, ORF01891, ORF01923, ORF01926, ORF01927, ORF01928,
ORF01929, ORF01930, ORF01931, ORF01932, ORF01946, ORF01953, ORF01955, ORF01956, ORF01987,
ORF02112, ORF02266, ORF02289, ORF02295, ORF02296, ORF02297, ORF02298, ORF02299, ORF02300,
ORF02301, ORF02302, ORF02303, ORF02304, ORF02305, ORF02306, ORF02307, ORF02308, ORF02309,
ORF02310, ORF02311, ORF02312, ORF02313, ORF02314, ORF02315, ORF02327, ORF02338, ORF02351,
ORF02352, ORF02353, ORF02354, ORF02355, ORF02356, ORF02358, ORF02359, ORF02361, ORF02362,
ORF02363, ORF02364, ORF02365, ORF02366, ORF02367, ORF02368, ORF02369, ORF02370, ORF02371,
ORF02372, ORF02373, ORF02374, ORF02375, ORF02382, ORF02383, ORF02384, ORF02385, ORF02386,
ORF02387, ORF02388, ORF02389, ORF02390, ORF02392, ORF02393, ORF02394, ORF02395, ORF02396,
ORF02397, ORF02398, ORF02399, ORF02400, ORF02401, ORF02402, ORF02403, ORF02404, ORF02405,
ORF02413, ORF02414, ORF02415, ORF02419, ORF02420, ORF02421, ORF02422, ORF02423, ORF02424,
ORF02425, ORF02429, ORF02432, ORF02436, ORF02437, ORF02438, ORF02439, ORF02440, ORF02441,
ORF02442, ORF02443, ORF02444, ORF02445, ORF02446, ORF02447, ORF02448, ORF02449, ORF02450,
ORF02451, ORF02452, ORF02453, ORF02454, ORF02455, ORF02456, ORF02457, ORF02458, ORF02459,
ORF02460, ORF02461, ORF02462, ORF02464, ORF02465, ORF02466, ORF02467, ORF02468, ORF02469,
ORF02470, ORF02471, ORF02472, ORF02501, ORF02502, ORF02503, ORF02504, ORF02505, ORF02506,
ORF02507, ORF02533, ORF02534, ORF02552, ORF02553, ORF02554, ORF02555, ORF02582, ORF02583,
ORF02595, ORF02614, ORF02628, ORF02633, ORF02699, ORF02735, ORF02788, ORF02789, ORF02790,
ORF02791, ORF02792, ORF02793, ORF02794, ORF02795, ORF02796, ORF02797, ORF02798, ORF02799,
ORF02800, ORF02801, ORF02802, ORF02803, ORF02804, ORF02805, ORF02806, ORF02807, ORF02808,
ORF02809, ORF02810, ORF02811, ORF02812, ORF02813, ORF02814, ORF02815, ORF02816, ORF02828,
ORF02829, ORF02830, ORF02831, ORF02832, ORF02833, ORF02834, ORF02835, ORF02844, ORF02845,
ORF02846, ORF02847, ORF02848, ORF02849, ORF02850, ORF02851, ORF02852, ORF02853, ORF02854,
ORF02855, ORF02856, ORF02857, ORF02858, ORF02859, ORF02860, ORF02861, ORF02862, ORF02863,
ORF02864, ORF02865, ORF02866, ORF02867, ORF02868, ORF02869, ORF02870, ORF02871, ORF02872,
ORF02873, ORF02874, ORF02875, ORF02876, ORF02877, ORF02878, ORF02879, ORF02880, ORF02881,
ORF02882, ORF02883, ORF02884, ORF02885, ORF02886, ORF02887, ORF02888, ORF02889, ORF02890,
ORF02891, ORF02931, ORF03011, ORF03012, ORF03013, ORF03014, ORF03015, ORF03016, ORF03017,
ORF03018, ORF03019, ORF03020, ORF03021, ORF03022, ORF03023, ORF03024, ORF03025, ORF03026,
ORF03027, ORF03028, ORF03029, ORF03030, ORF03031, ORF03032, ORF03033, ORF03034, ORF03035,
ORF03036, ORF03037, ORF03038, ORF03039, ORF03040, ORF03041, ORF03042, ORF03043, ORF03044,
ORF03045, ORF03046, ORF03047, ORF03048, ORF03049, ORF03053, ORF03054, ORF03055, ORF03056,
ORF03114, ORF03130, ORF03131, ORF03132, ORF03133, ORF03162, ORF03163, ORF03164, ORF03165,
ORF03166, ORF03167, ORF03173, ORF03174, ORF03175, ORF03176, ORF03191, ORF03192, ORF03206,
ORF03207, ORF03235, ORF03236, ORF03252, ORF03262, ORF03263, ORF03279, ORF03296, ORF03297,
ORF03298, ORF03299, ORF03300, ORF03325, ORF03340, ORF03341, ORF03342, ORF03343, ORF03344,
ORF03345, ORF03346, ORF03347, ORF03348, ORF03349, ORF03350, ORF03351, ORF03352, ORF03353,
ORF03354, ORF03355, ORF03356, ORF03357, ORF03358, ORF03359, ORF03360, ORF03361, ORF03362,
ORF03363, ORF03364, ORF03365, ORF03400, ORF03415, ORF03453, ORF03454, ORF03455, ORF03456,
ORF03457, ORF03458, ORF03459, ORF03465, ORF03469, ORF03499, ORF03500, ORF03501, ORF03502,
ORF03503, ORF03504, ORF03505, ORF03506, ORF03507, ORF03508, ORF03509, ORF03510, ORF03511,
ORF03512, ORF03515, ORF03516, ORF03517, ORF03518, ORF03519, ORF03520, ORF03521, ORF03522,
ORF03526, ORF03535, ORF03536, ORF03537, ORF03538, ORF03539, ORF03540, ORF03541, ORF03542,
ORF03574, ORF03575, ORF03576, ORF03577, ORF03578, ORF03579, ORF03580, ORF03589, ORF03592,
ORF03593, ORF03594, ORF03595, ORF03596, ORF03597, ORF03606, ORF03607, ORF03608, ORF03610,
ORF03612, ORF03613, ORF03614, ORF03615, ORF03616, ORF03617, ORF03619, ORF03695, ORF03696,
ORF03817, ORF03818, ORF03819, ORF03820, ORF03821, ORF03822, ORF03823, ORF03824, ORF03825,
ORF03826, ORF03975, ORF03991, ORF03992, ORF03993, ORF03994, ORF03995, ORF03996, ORF03997,
ORF03998, ORF03999, ORF04000, ORF04031, ORF04032, ORF04033, ORF04034, ORF04035, ORF04036,
ORF04058, ORF04059, ORF04060, ORF04061, ORF04062, ORF04063, ORF04064, ORF04073, ORF04083,
ORF04084, ORF04085, ORF04086, ORF04087, ORF04088, ORF04089, ORF04090, ORF04091, ORF04130,
ORF04162, ORF04163, ORF04164, ORF04171, ORF04183, ORF04184, ORF04203, ORF04204, ORF04205,
ORF04206, ORF04207, ORF04208, ORF04209, ORF04211, ORF04224, ORF04225, ORF04237, ORF04238,
ORF04239, ORF04240, ORF04241, ORF04242, ORF04243, ORF04244, ORF04247, ORF04250, ORF04282,
ORF04302, ORF04390, ORF04391, ORF04398, ORF04402, ORF04403, ORF04404, ORF04416, ORF04417,
ORF04418, ORF04419, ORF04420, ORF04421, ORF04422, ORF04423, ORF04424, ORF04425, ORF04426,
ORF04427, ORF04428, ORF04429, ORF04430, ORF04434, ORF04435, ORF04436, ORF04437, ORF04438,
ORF04439, ORF04451, ORF04476, ORF04477, ORF04478, ORF04479, ORF04480, ORF04481, ORF04482,

TABLE 3-continued low homology with commensal strains

ORF04483, ORF04484, ORF04489, ORF04490, ORF04500, ORF04542, ORF04543, ORF04544, ORF04545,
ORF04546, ORF04547, ORF04552, ORF04569, ORF04572, ORF04573, ORF04608, ORF04612, ORF04623,
ORF04626, ORF04627, ORF04628, ORF04629, ORF04630, ORF04631, ORF04632, ORF04661, ORF04662,
ORF04663, ORF04664, ORF04665, ORF04668, ORF04669, ORF04671, ORF04672, ORF04673, ORF04674,
ORF04675, ORF04676, ORF04677, ORF04678, ORF04679, ORF04691, ORF04692, ORF04693, ORF04694,
ORF04708, ORF04709, ORF04710, ORF04711, ORF04712, ORF04728, ORF04844, ORF04845, ORF04846,
ORF04847, ORF04848, ORF04849, ORF04850, ORF04851, ORF04882, ORF04890, ORF04891, ORF04892,
ORF04893, ORF04894, ORF04895, ORF04898, ORF04900, ORF04915, ORF04916, ORF04917, ORF04918,
ORF04919, ORF04920, ORF04921, ORF04922, ORF04923, ORF04924, ORF04925, ORF04926, ORF04927,
ORF04928, ORF04929, ORF04930, ORF04946, ORF04947, ORF04948, ORF04949, ORF04950, ORF04951,
ORF04952, ORF04953, ORF04954, ORF04955, ORF04956, ORF04957, ORF04958, ORF04959, ORF04960,
ORF04961, ORF04962, ORF04963, ORF04964, ORF04966, ORF04974, ORF04978, ORF04979, ORF04981,
ORF04989, ORF04990, ORF04991, ORF04992, ORF04993, ORF04995

TABLE 4

| Protein | SEQ ID | Annotation | Psort | TMD | CFT073 | % ID |
| --- | --- | --- | --- | --- | --- | --- |
| ORF03526 | 7051 + 7052 | Accessory colonization factor AcfD precursor | I | 0 | upec-2704 | 45.3 |
| ORF01339 | 2677 + 2678 | F1C fimbrial usher | I | 1 | upec-1199 | 99.4 |
| ORF00256 | 511 + 512 | pilin chaperone ecpD2 | I | 1 | upec-0166 | 100 |
| ORF01346 | 2691 + 2692 | IroN protein | O | 0 | upec-1207 | 99.3 |
| ORF04084 | 8167 + 8168 | outer membrane hemin receptor ChuA | O | 0 | upec-4213 | 99.7 |
| ORF02374 | 4747 + 4748 | OMR family pesticin-yersiniabactin receptor protein (IRPC) | O | 0 | upec-2371 | 100 |
| ORF03502 | 7003 + 7004 | polysaccharide biosynthesis protein, putative | O | 0 | upec-3606 | 99.5 |
| ORF02298 | 4595 + 4596 | hypothetical protein | C | 0 | upec-5009 | 30 |
| ORF01228 | 2455 + 2456 | CdtC | O | 0 | upec-1086 | 30.3 |
| ORF01227 | 2453 + 2454 | CdtB | I | 1 | upec-0679 | 31.9 |
| ORF02314 | 4627 + 4628 | gpH | I | 1 | upec-0941 | 48.8 |
| ORF02850 | 5699 + 5700 | DNA transfer protein | C | 0 | upec-4881 | 21.2 |

Columns:
PSORT: predicted location by the PSORT algorithm. I = inner membrane; O = outer membrane; P = periplasm; C = cytoplasm
TMD: number of transmembrane domains
% ID: percentage identitical residues over length of alignment

REFERENCES

The Contents of which are Hereby Incorporated by Reference

[1] Russo & Johnson (2000) *J Infect Dis* 181:1753-1754.
[2] Uehling et al. (1997) *J Urol* 157:2049-2052.
[3] Tammen (1990) *Br J Urol* 65:6-9.
[4] Langermann et al. (1997) *Science* 276:607-611.
[5] WO03/074553.
[6] WO01/66572.
[7] Janke et al. (2001) *FEMS Microbiol Lett* 199:61-66.
[8] WO2004/005535.
[9] Dobrindt et al (2002) *Infect Immun* 70:6365-6372.
[10] US2003/0165870.
[11] Welch et al. (2002) *Proc Natl Acad Sci USA* 99:17020-17024.
[12] American Type Culture Collection: ATCC 700928.
[13] *European Journal of Biochemistry* 2003; 1 Supplement 1 July: abstract P1.3-11.
[14] Geysen et al. (1984) *PNAS USA* 81:3998-4002.
[15] Carter (1994) *Methods Mol Biol* 36:207-223.
[16] Jameson, B A et al. 1988, *CABIOS* 4(1):181-186.
[17] Raddrizzani & Hammer (2000) *Brief Bioinform* 1(2):179-189.
[18] De Lalla et al. (1999) *J. Immunol.* 163:1725-1729.
[19] Brusic et al. (1998) *Bioinformatics* 14(2):121-130
[20] Meister et al. (1995) *Vaccine* 13(6):581-591.
[21] Roberts et al. (1996) *AIDS Res Hum Retroviruses* 12(7): 593-610.
[22] Maksyutov & Zagrebelnaya (1993) *Comput Appl Biosci* 9(3):291-297.
[23] Feller & de la Cruz (1991) *Nature* 349(6311):720-1.
[24] Hopp (1993) *Peptide Research* 6:183-190.
[25] Welling et al. (1985) *FEBS Lett.* 188:215-218.
[26] Davenport et al. (1995) *Immunogenetics* 42:392-297.
[27] Bodanszky (1993) *Principles of Peptide Synthesis* (ISBN: 0387564314).
[28] Fields et al. (1997) *Meth Enzymol* 289: *Solid-Phase Peptide Synthesis.* ISBN: 0121821900.
[29] Chan & White (2000) *Fmoc Solid Phase Peptide Synthesis.* ISBN: 0199637245.
[30] Kullmann (1987) *Enzymatic Peptide Synthesis.* ISBN: 0849368413.
[31] Ibba (1996) *Biotechnol Genet Eng Rev* 13:197-216.
[32] Breedveld (2000) *Lancet* 355(9205):735-740.
[33] Gorman & Clark (1990) *Semin. Immunol.* 2:457-466.
[34] Sambrook et al. (2001) *Molecular Cloning: A Laboratory Manual,* 3rd edition (Cold Spring Harbor Laboratory Press).
[35] Ausubel et al. (eds) (2002) *Short protocols in molecular biology,* 5th edition (Current Protocols).
[36] U.S. Pat. No. 5,707,829
[37] *Current Protocols in Molecular Biology* (F. M. Ausubel et al. eds., 1987) Supplement 30.
[38] EP-B-0509612.
[39] EP-B-0505012.

[40] Johnson & Stell (2001) *J Clin Microbiol* 39:3712-33717.
[41] Tang et al. (1997) *Clin. Chem.* 43:2021-2038.
[42] PCT/IB2005/003494.
[43] Bemadac et al. (1998) *J Bacteriol* 180(18):4872-4878.
[44] EP-1441036.
[45] Sorensen & Mortensen (2005) *Journal of Biotechnology* 115:113-128.
[46] Meynial-Salles et al. (2005) *Applied and Environmental Microbiology* 71:2140-2144.
[47] US2004/0209370.
[48] WO00/68253.
[49] WO97/04110.
[50] Alper et al. (2005) *Proc. Natl. Acad. Sci. USA* 102: 12678-12683.
[51] WO 01/09350.
[52] European patent 0624376.
[53] *Vaccine Design* . . . (1995) eds. Powell & Newman. ISBN: 030644867X. Plenum.
[54] WO00/23105.
[55] WO90/14837.
[56] Podda (2001) *Vaccine* 19:2673-2680.
[57] Frey et al. (2003) *Vaccine* 21:4234-4237.
[58] *Vaccine Adjuvants: Preparation Methods and Research Protocols* (Volume 42 of *Methods in Molecular Medicine* series). ISBN: 1-59259-083-7. Ed. O'Hagan.
[59] U.S. Pat. No. 6,299,884.
[60] U.S. Pat. No. 6,451,325.
[61] Allison & Byars (1992) *Res Immunol* 143:519-525.
[62] Hariharan et al. (1995) *Cancer Res* 55:3486-3489.
[63] U.S. Pat. No. 5,057,540.
[64] WO96/33739.
[65] EP-A-0109942.
[66] WO96/11711.
[67] WO00/07621.
[68] Barr et al. (1998) *Advanced Drug Delivery Reviews* 32:247-271.
[69] Sjolanderet et al. (1998) *Advanced Drug Delivery Reviews* 32:321-338.
[70] Niikura et al. (2002) *Virology* 293:273-280.
[71] Lenz et al. (2001) *J Immunol* 166:5346-5355.
[72] Pinto et al. (2003) *J Infect Dis* 188:327-338.
[73] Gerber et al. (2001) *Virol* 75:4752-4760.
[74] WO03/024480
[75] WO03/024481
[76] Gluck et al. (2002) *Vaccine* 20:B10-B16.
[77] EP-A-0689454.
[78] Johnson et al. (1999) *Bioorg Med Chem Lett* 9:2273-2278.
[79] Evans et al. (2003) *Expert Rev Vaccines* 2:219-229.
[80] Meraldi et al. (2003) *Vaccine* 21:2485-2491.
[81] Pajak et al. (2003) *Vaccine* 21:836-842.
[82] Kandimalla et al. (2003) *Nucleic Acids Research* 31:2393-2400.
[83] WO02/26757.
[84] WO99/62923.
[85] Krieg (2003) *Nature Medicine* 9:831-835.
[86] McCluskie et al. (2002) *FEMS Immunology and Medical Microbiology* 32:179-185.
[87] WO98/40100.
[88] U.S. Pat. No. 6,207,646.
[89] U.S. Pat. No. 6,239,116.
[90] U.S. Pat. No. 6,429,199.
[91] Kandimalla et al. (2003) *Biochemical Society Transactions* 31 (part 3):654-658.
[92] Blackwell et al. (2003) *J Immunol* 170:4061-4068.
[93] Krieg (2002) *Trends Immunol* 23:64-65.
[94] WO01/95935.
[95] Kandimalla et al. (2003) *BBRC* 306:948-953.
[96] Bhagat et al. (2003) *BBRC* 300:853-861.
[97] WO03/035836.
[98] WO95/17211.
[99] WO98/42375.
[100] Beignon et al. (2002) *Infect Immnun* 70:3012-3019.
[101] Pizza et al. (2001) *Vaccine* 19:2534-2541.
[102] Pizza et al. (2000) *Int J Med Microbiol* 290:455-461.
[103] Scharton-Kersten et al. (2000) *Infect Immun* 68:5306-5313.
[104] Ryan et al. (1999) *Infect Immun* 67:6270-6280.
[105] Partidos et al. (1999) *Immunol Lett* 67:209-216.
[106] Peppoloni et al. (2003) *Expert Rev Vaccines* 2:285-293.
[107] Pine et al. (2002) *J Control Release* 85:263-270.
[108] Domenighini et al. (1995) *Mol Microbiol* 15:1165-1167.
[109] WO03/011223.
[110] WO99/40936.
[111] WO99/44636.
[112] Lillard J W et al., (2003) *Blood* 101(3):807-14. Epub Sep. 12, 2002.
[113] Singh et al] (2001) *J Cont Release* 70:267-276.
[114] WO99/27960.
[115] U.S. Pat. No. 6,090,406
[116] U.S. Pat. No. 5,916,588
[117] EP-A-0626169.
[118] WO99/52549.
[119] WO01/21207.
[120] WO01/21152.
[121] Andrianov et al. (1998) *Biomaterials* 19:109-115.
[122] Payne et al. (1998) *Adv Drug Delivery Review* 31:185-196.
[123] U.S. Pat. No. 4,680,338.
[124] U.S. Pat. No. 4,988,815.
[125] WO92/15582.
[126] Stanley (2002) *Clin Exp Dermatol* 27:571-577.
[127] Wu et al. (2004) *Antiviral Res.* 64(2):79-83.
[128] Vasilakos et al. (2000) *Cell Immunol.* 204(1):64-74.
[129] U.S. Pat. Nos. 4,689,338, 4,929,624, 5,238,944, 5,266,575, 5,268,376, 5,346,905, 5,352,784, 5,389,640, 5,395,937, 5,482,936, 5,494,916, 5,525,612, 6,083,505, 6,440,992, 6,627,640, 6,656,938, 6,660,735, 6,660,747, 6,664,260, 6,664,264, 6,664,265, 6,667,312, 6,670,372, 6,677,347, 6,677,348, 6,677,349, 6,683,088, 6,703,402, 6,743,920, 6,800,624, 6,809,203, 6,888,000 and 6,924,293.
[130] Jones (2003) *Curr Opin Inivestig Drugs* 4:214-218.
[131] WO04/60308
[132] WO04/64759.
[133] U.S. Pat. No. 6,924,271.
[134] US2005/0070556.
[135] U.S. Pat. No. 5,658,731.
[136] Wong et al. (2003) *J Clin Pharmacol* 43(7):735-742.
[137] US2005/0215517.
[138] WO02/072012.
[139] Signorelli & Hadden (2003) *Int Immunopharmacol* 3(8):1177-1186.
[140] WO2004/064715.
[141] Cooper (1995) *Pharm Biotechnol* 6:559-580.
[142] PCT/US2005/022769.
[143] WO2004/87153.
[144] U.S. Pat. No. 6,605,617.
[145] WO02/18383.
[146] WO2004/018455.
[147] WO03/082272.
[148] U.S. Pat. No. 5,011,828.
[149] U.S. Pat. No. 6,586,409.
[150] WO99/11241.

[151] WO94/00153.
[152] WO98/57659.
[153] European patent applications 0835318, 0735898 and 0761231.
[154] WO03/009869.
[155] Glezen & Alpers (1999) *Clin. Infect. Dis.* 28:219-224.
[156] Johnson et al. (2001) *Infect Immun* 69:1306-1314.
[157] Johnson et al. (2001) *J Infect Dis* 183:897-906 (see also 183:1546).
[158] Almeida & Alpar (1996) *J. Drug Targeting* 3:455-467.
[159] Agarwal & Mishra (1999) *Indian J Exp Biol* 37:6-16.
[160] Costantino et al. (1992) *Vaccine* 10:691-698.
[161] Costantino et al. (1999) *Vaccine* 17:1251-1263.
[162] International patent application WO03/007985.
[163] WO 99/24578.
[164] WO 99/36544.
[165] WO 99/57280.
[166] WO 00/66791.
[167] WO 01/64922.
[168] WO 01/64920.
[169] WO 03/020756.
[170] WO 2004/032958.
[171] WO 2004/048404.
[172] Watson (2000) *Pediatr Infect J* 19:331-332.
[173] Rubin (2000) *Pediatr Clin North Am* 47:269-285, v.
[174] Jedrzejas (2001) *Microbiol Mol Biol Rev* 65:187-207.
[175] Bell (2000) *Pediatr Infect Dis J* 19:1187-1188.
[176] Iwarson (1995) *APMIS* 103:321-326.
[177] Gerlich et al. (1990) *Vaccine* 8 Suppl:S63-S68 & S79-S80.
[178] *Vaccines* (1988) eds. Plotkin & Mortimer. ISBN 0-7216-1946-0.
[179] Del Guidice et al. (1998) *Molecular Aspects of Medicine* 19:1-70.
[180] Hsu et al. (1999) *Clin Liver Dis* 3:901-915.
[181] Stratov et al. (2004) *Curr Drug Tgts* 5(1):71-88.
[182] Gustafsson et al. (1996) *N. Engl. J. Med.* 334:349-355.
[183] Rappuoli et al. (1991) *TIBTECH* 9:232-238.
[184] Sutter et al. (2000) *Pediatr Clin North Am* 47:287-308.
[185] Zimmerman & Spann (1999) *Am Fam Physician* 59:113-118, 125-126.
[186] McMichael (2000) *Vaccine* 19 Suppl 1:S101-S107.
[187] Schuchat (1999) *Lancet* 353(9146):51-56.
[188] International patent application WO02/34771.
[189] WO 99/24578.
[190] WO 99/36544.
[191] WO 99/57280.
[192] WO 02/079243.
[193] WO 02/02606.
[194] Kalman et al. (1999) *Nature Genetics* 21:385-389.
[195] Read et al. (2000) *Nucleic Acids Res* 28:1397-406.
[196] Shirai et al. (2000) *J. Infect. Dis.* 181(Suppl 3):S524-S527.
[197] WO 99/27105.
[198] WO 00/27994.
[199] WO 00/37494.
[200] WO2005/084306.
[201] WO2005/002619.
[202] Ross et al. (2001) *Vaccine* 19:4135-4142.
[203] Dreesen (1997) *Vaccine* 15 Suppl:S2-S6.
[204] *MMWR Morb Mortal Wkly Rep* Jan. 16, 1998; 47(1): 12,19.
[205] Anderson (2000) *Vaccine* 19 Suppl 1:S59-S65.
[206] Kahn (2000) *Curr Opin Pediatr* 12:257-262.
[207] Crowe (1995) *Vaccine* 13:415-421.
[208] Modlin et al. (2001) *J Toxicol Clin Toxicol* 39:85-100.
[209] Demicheli et al. (1998) *Vaccine* 16:880-884.
[210] Stepanov et al. (1996) *J Biotechnol* 44:155-160.
[211] Dale (1999) *Infect Dis Clin North Am* 13:227-243, viii.
[212] Ferretti et al. (2001) *PNAS USA* 98: 4658-4663.
[213] Kuroda et al. (2001) *Lancet* 357(9264):1225-1240; see also pages 1218-1219.
[214] WO 00/09699.
[215] EP-A-0372501
[216] EP-A-0378881
[217] EP-A-0427347
[218] WO93/17712
[219] WO94/03208
[220] WO98/58668
[221] EP-A-0471177
[222] EP-A-0594610.
[223] WO00/56360
[224] WO91/01146
[225] WO00/61761
[226] WO01/72337
[227] Falugi et al. (2001) *Eur J Immunol* 31:3816-3824.
[228] Baraldo et al, (2004) *Infect Immun.* 72:4884-4887
[229] WO02/091998.
[230] Kuo et al. (1995) *Infect Immun* 63:2706-2713.
[231] *Research Disclosure*, 453077 (January 2002)
[232] Donnelly et al. (1997) *Annu Rev Immunol* 15:617-648.
[233] Strugnell et al. (1997) *Immunol Cell Biol* 75(4):364-369.
[234] Cui (2005) *Adv Genet* 54:257-89.
[235] Robinson & Torres (1997) *Seminars in Immunol* 9:271-283.
[236] Brunham et al. (2000) *J Infect Dis* 181 Suppl 3:S538-S543.
[237] Svanholm et al. (2000) *Scand J Immunol* 51(4):345-353.
[238] *DNA Vaccination—Genetic Vaccination* (1998) eds. Koprowski et al. (ISBN 3540633928).
[239] *Gene Vaccination: Theory and Practice* (1998) ed. Raz (ISBN 3540644288).
[240] Findeis et al., *Trends Biotechnol.* (1993) 11:202.
[241] Chiou et al. (1994) *Gene Therapeutics: Methods And Applications Of Direct Gene Transfer.* ed. Wolff.
[242] Wu et al, *J. Biol. Chem.* (1988) 263:621.
[243] Wu et al., *J. Biol. Chem.* (1994) 269:542.
[244] Zenke et al., *Proc. Natl. Acad. Sci. (USA)* (1990) 87:3655.
[245] Wu et al., *J. Biol Chem.* (1991) 266:338.
[246] Jolly, *Cancer Gene Therapy* (1994) 1:51.
[247] Kimura, *Human Gene Therapy* (1994) 5:845.
[248] Connelly, *Human Gene Therapy* (1995) 1:185.
[249] Kaplitt, *Nature Genetics* (1994) 6:148.
[250] WO 90/07936.
[251] WO 94/03622.
[252] WO 93/25698.
[253] WO 93/25234.
[254] U.S. Pat. No. 5,219,740.
[255] WO 93/11230.
[256] WO 93/10218.
[257] U.S. Pat. No. 4,777,127.
[258] GB 2,200,651.
[259] EP-A-0 345 242.
[260] WO 91/02805.
[261] WO 94/12649.
[262] WO 93/03769.
[263] WO 93/19191.
[264] WO 94/28938.
[265] WO 95/11984.
[266] WO 95/00655.
[267] Curiel, *Hum. Gene Ther.* (1992) 3:147.

[268] Wu, *J. Biol. Chem.* (1989) 264:16985.
[269] U.S. Pat. No. 5,814,482.
[270] WO 95/07994.
[271] WO 96/17072.
[272] WO 95/30763.
[273] WO 97/42338.
[274] WO 90/11092.
[275] U.S. Pat. No. 5,580,859.
[276] U.S. Pat. No. 5,422,120.
[277] WO 95/13796.
[278] WO 94/23697.
[279] WO 91/14445.
[280] EP 0524968.
[281] Philip, *Mol. Cell Biol.* (1994) 14:2411.
[282] Woffendin, *Proc. Natl. Acad. Sci.* (1994) 91:11581.
[283] U.S. Pat. No. 5,206,152.
[284] WO 92/11033.
[285] U.S. Pat. No. 5,149,655.
[286] WO 92/11033.
[287] Needleman & Wunsch (1970) *J. Mol. Biol.* 48:443-453.
[288] Rice et al. (2000) *Trends Genet* 16:276-277.
[289] Gennaro (2000) *Remington: The Science and Practice of Pharmacy.* 20th edition, ISBN: 0683306472.
[290] *Method In Enzymology* (S. Colowick and N. Kaplan, eds., Academic Press, Inc.)
[291] *Handbook of Experimental Immunology*, Vols. I-IV (D. M. Weir and C. C. Blackwell, eds., 1986, Blackwell Scientific Publications)
[292] Sambrook et al. (2001) *Molecular Cloning: A Laboratory Manual,* 3rd edition (Cold Spring Harbor Laboratory Press).
[293] *Handbook of Surface and Colloidal Chemistry* (Birdi, K. S. ed., CRC Press, 1997)
[294] Ausubel et al. (eds) (2002) *Short protocols in molecular biology,* 5th edition (Current Protocols).
[295] *Molecular Biology Techniques: An Intensive Laboratory Course,* (Ream et al., eds., 1998, Academic Press)
[296] *PCR (Introduction to Biotechniques Series),* 2nd ed. (Newton & Graham eds., 1997, Springer Verlag)
[297] Dobrindt et al. (2003) *J Bacteriol* 185:1831-1840.
[298] Murphy (1998) *J. Bacteriol* 180:2063-2071.
[299] Huang et al. (2001) *J Infect Dis* 183:1071-1078.
[300] Russo et al. (2002) *Infect Immun* 70:7156-7160.
[301] Russo et al. (2002) *Infect Immun* 71:7164-7169.

SEQUENCE LISTING (10274 sequences)

SEQ ID NO: 1 - DNA, 2292 bp, Escherichia coli
ttgtcagaactactctctttcgccctttttctcgcctctgtgctgatttacgcatggaaagcgggacgtaacacctggtggtttgcagccacattaacggtactggggctatttgtcgttttaaatatcaccctgtttgccagcgactattttactggcgatggtattaacgacgcggttctctataccttaaccaacagcctgaccggtgctggtgtcagcaaatacatcctgcctggtatcggcattgtgctggggctggcggcggtgttcggtgcgctgggctggatcctgcgccgtcgtcgtcatcatccgcaccattttggttacagcctgctggcactcttactggcgctgggttcagtggatgccagcccggcatttcgtcagataacggaactggtgaaatcccagtcacgcgacggcgacccggactttgcggcttattataaagagccgtcgaaaactatccctgacccgaaactcaacctggtttatatctacggcgaaagtctcgagcggacctattttgataacgaggctttcccggatctcacgcctgaactgggcgcgttgaaaaatgaaggcctggatttcagccacacgcagcagctgccaggaacggattacacgattgcgggcatggtggcttctcagtgcggcataccgctgtttgccccatttgaaggcaacgcctccgcttctgtttccagcttcttcccgcagaacatctgtctgggcgatattatgaaaaactcgggttatcagaactatttcgtgcagggcgcgaatctgcgttttgccggtaaagatgtgttcctgaaatcgcacggcttcgaccacttatacggctcagaagagctgaaaagcgtggtggccgacccgcactatcgcaacgactggggattctacgacgataccgttctcgatgaagcgtggaaaaaatttgaagagctttcccgctcaggtcagcgattctcactgtttaccctgacagtcgatacccatcacccggatggttttatctcgcgcacctgtaaccgcaaaaaatatgattttgacggtaagccgaatcagtcattcagcgcggtaagttgcagccaggagaatattgcgacgtttatcaacaaaatcaaagcgtcaccgtggtttaaagataccgtcatcgtcgtctcttctgaccatttagcgatgaacaatacggcgtggaaataccttaataagcaggatcgcaataacctgttttttgtcatccgtggcgacaagccgcagcaagagacgctggcagtgaagcgtaatacgatggataacggcgcgacggtgctggacattctcggtggcgataactatctcggacttggccgtagcagtttatccgggcagtcgatgtcggaaatcttcctcaatatcaaagagaaaacattggcgtggaagccggatatcatccgcctgtggaaattccctaaagagatgaaagagttcaccatcgaccagcagaaaaacatgattgccttctcaggtagccatttccgtttgccgctgctgttgcgggtttcagacaaacgcgtggaaccgctgccggaaagcgaatactcagcaccgctgcgtttccagctggcagatttcgctccacgcgacaatttcgtctgggttgaccgttgctacaagatggcacaactctgggctccggaactggcactctccaccgactggtgtgtctcgcaagggcagcttggcggtcagcaaattgttcagcatgttgacaaagcaatatggaagggaaaaacggcatttaaagatacggtcatcgacatggcgcgttacaaaggcaatgtcgatacgctaaagattgttgataacgatattcgctacaaagccgacagtttcatctttaacgtcgctggtgcgccagaagaggtgaaacagtttagcgggatttctcgtccagagtcgtggggccgctggtccaacgcacagctgggcgatgaagtaaaaatcgagtacaagcatccgctgccgaagaaatttgacctggtgattaccgccaaagcatacggcaataacgccagccgtcctattccggtacgcgtaggcaatgaagaacaaacccttgtgctgggcaatgaagtgaccaccaccacactgcatttcgataacccaaccgatgccgacacactggtaattgtgccaccggaacctgtctcaaccaacgaagggaatatcctcgggcactcgccgcgtaagctcgggatcggcatggtggaaattaaagtggtagaacgtgaagggtaa

SEQ ID NO: 2 - protein, 763 aa, Escherichia coli
MSELLSFALFLASVLIYAWKAGRNTWWFAATLTVLGLFVVLNITLFASDYFTGDGINDAVLYTLTNSLTGAGVSKYILPGIGIVLGLAAVFGALGWILRRRRHHPHHFGYSLLALLLALGSVDASPAFRQITELVKSQSRDGDPDFAAYYKEPSKTIPDPKLNLVYIYGESLERTYFDNEAFPDLTPELGALKNEGLDFSHTQQLPGTDYTIAGMVASQCGIPLFAPFEGNASASVSSFFPQNICLGDIMKNSGYQNYFVQGANLRFAGKDVFLKSHGFDHLYGSEELKSVVADPHYRNDWGFYDDTVLDEAWKKFEELSRSGQRFSLFTLTVDTHHPDGFISRTCNRKKYDFDGKPNQSFSAVSCSQENIATFINKIKASPWFKDTVIVVSSDHLAMNNTAWKYLNKQDRNNLFFVIRGDKPQQETLAVKRNTMDNGATVLDILGGDNYLGLGRSSLSGQSMSEIFLNIKEKTLAWKPDIIRLWKFPKEMKEFTIDQQKNMIAFSGSHFRLPLLLRVSDKRVEPLPESEYSAPLRFQLADFAPRDNFVWVDRCYKMAQLWAPELALSTDWCVSQGQLGGQQIVQHVDKAIWKGKTAFKDTVIDMARYKGNVDTLKIVDNDIRYKADSFIFNVAGAPEEVKQFSGISRPESWGRWSNAQLGDEVKIEYKHPLPKKFDLVITAKAYGNNASRPIPVRVGNEEQTLVLGNEVTTTTLHFDNPTDADTLVIVPPEPVSTNEGNILGHSPRKLGIGMVEIKVVEREG

SEQ ID NO: 3 - DNA, 498 bp, Escherichia coli
atgatgatgaaaactattaaacatcttctgtgctgtgccattgccgccagcgcattaatttccaccggggtgcatgctgcgtcctggaaagatgcgctctccagcgccgccagcgaacttggcaaccaaaacaacacgacacaggaaggcggttggtcgctcgcgtcattaactaacttgcttagcaacgggaaccaggccttaagcgcagataacatgaacaacgccgcaggcattctgcaatactgcgcgaagcaaaagctggcttcggtaaccgatgccgaaaacatcaagaatcaggtactggaaaaactgggcctgaacagtgaagagcaaaaagaagacaccaactatctggatggcattcagggtttgctgaaaaccaaagatggtcagcaactcaatctggataatattggaacgactccgctggcagaaaaggtgaaaaccaaagcctgcgatctggtgttaaagcaggggctgaacttcatttcctga

SEQ ID NO: 4 - protein, 165 aa, Escherichia coli
MMMKTIKHLLCCAIAASALISTGVHAASWKDALSSAASELGNQNNTTQEGGWSLASLTNLLSNGNQALSADNMNNAAGILQYCAKQKLASVTDAENIKNQVLEKLGLNSEEQKEDTNYLDGIQGLLKTKDGQQLNLDNIGTTPLAEKVKTKACDLVLKQGLNFIS

SEQ ID NO: 5 - DNA, 738 bp, Escherichia coli
atgaaaaacgttggcgacctgatgcaacgcctgcaaaaaatgatgcctgcccatatcaaacctgctttcaaaacgggtgaagaattactggcctggcagaaagaacaaggggcgatccgctccgccgctctcgaacgtgaaaatcgggcgatgaaaatgcagcgcacctttaaccgctccggtattcgtccactgcatcagaactgctcctttgagaactatcgcgttgagtgtgaagggcaaatgaatgcgttaagcaaagcgcgccagtatgtcgaagagtttgacggcaacatcgccagcttcatcttttctggcaagccaggaaccggcaaaaaccatctggcggcggcaatctgcaacgagctgctgctacgcggtaaatccgtattgatcatcaccgtggccgatattatgtcggcgatgaaagataccttcaggaatagcggtaccagcgaagaacaactgcttaacgatctgagtaacgttgatctgctggtgatcgatgagatcggcgtgcagaccgaatcgaaatacgaaaaagtgatcatcaaccagatcgtcgatcgccgctcttcttccaaacgcccaaccgggatgctgaccaacagtaatatggaagagatgaccaagttgctgggcgaacgcgtgatggaccgtatgcgcctgggtaacagtttgtgggtgatcttcaactgggatagctaccgtagccgtgtaacaggtaaagagtattaa

SEQ ID NO: 6 - protein, 245 aa, Escherichia coli
MKNVGDLMQRLQKMMPAHIKPAFKTGEELLAWQKEQGAIRSAALERENRAMKMQRTFNRSGIRPLHQNCSFENYRVECEGQMNALSKARQYVEEFDGNIASFIFSGKPGTGKNHLAAAICNELLLRGKSVLIITVADIMSAMKDTFRNSGTSEEQLLNDLSNVDLLVIDEIGVQTESKYEKVIINQIVDRRSSSKRPTGMLTNSNMEEMTKLLGERVMDRMRLGNSLWVIFNWDSYRSRVTGKEY

SEQ ID NO: 7 - DNA, 552 bp, Escherichia coli
ttgagaaacagtatgtcttccagagttttgaccccggacgtcgttggtattgacgccctggtacacgatcaccaaaccgttctggcaaaagctgaaggcggtgtggttgccgtatttgctaacaatgccccggcgttttatgccatcactcctgcacgcctggctgaactgctggcgctggaagaaaagctggcgcgtccgggaagcgatgtcgctctggacgatcaactctatcaggaaccgcaaaccgctcccgttgccgtacccatggggaaatttgccatgtacccagactggcaacccgatgccgactttatccgcctggcggcgctatggggcgtggcactaagagagtcggtgaccgccgaagaactggcgtcattcattgcctactggcaggcggaaggcaaagtctttcaccatgtgcagtggcaacaaaaactggcgcgcagcctgcaaatcggtcgtgccagcaacggcggactgccgaaacgagatgtgaatacggtcagtgaacctgacagccaaattccaccaggattcagagggtaa

SEQ ID NO: 8 - protein, 183 aa, Escherichia coli
MRNSMSSRVLTPDVVGIDALVHDHQTVLAKAEGGVVAVFANNAPAFYAITPARLAELLALEEKLARPGSDVALDDQLYQEPQTAPVAVPMGKFAMYPDWQPDADFIRLAALWGVALRESVTAEELASFIAYWQAEGKVFHHVQWQQKLARSLQIGRASNGGLPKRDVNTVSEPDSQIPPGFRG

SEQ ID NO: 9 - DNA, 474 bp, Escherichia coli
atgggtgtgatcgaatttctgttagcgttggcgcaggatatgatcctcgccgccattcctgcggtcggctttgcgatggtgttcaacgttcccgttcgagcgttacgctggtgtgcgctgcttggtgcgataggtcatggttcccgaatgatcttaatgaccagcgggctgaatattgaatggtcaacctttatggcctctatgctggtcggcaccattggtattcaatggtcgcgctggtatctggcgcatccgaaagtgtttaccgtggcggctgttatccctatgttccctggcatatcagcttataccgcaatgatttcggcggtaaaaatcagccagctaggttacagcgaaccgttgatgattaccctgttaaccaactttcttacagcttcatcgattgttggtgcgttatccatcggtctttccattcctggattatggttgtaccgcaagcgccctcgcgtataa

SEQ ID NO: 10 - protein, 157 aa, Escherichia coli
MGVIEFLLALAQDMILAAIPAVGFAMVFNVPVRALRWCALLGAIGHGSRMILMTSGLNIEWSTFMASMLVGTIGIQWSRWYLAHPKVFTVAAVIPMFPGISAYTAMISAVKISQLGYSEPLMITLLTNFLTASSIVGALSIGLSIPGLWLYRKRPRV

SEQ ID NO: 11 - DNA, 834 bp, Escherichia coli
atgatacaaatggattctcattatctgaacaatacgcagcacgtctatgacaaagggcgagttatgcaaactgagcaacagcgagccgtaacacggctttgtatccagtgtggattatttcttttgcaacatggtgcggaaagcgcgttggttgatgagctttcctcacgactgggtcgggcgttgggaatggacagcgtcgaaagttctatctcttcgaacgccatagtgctgacaaccattaaagatgggcaatgcctgacatcgacacgtaaaaatcacgatcgcggcattaatatgcatgtggtgactgaagtccagcacattgtaattctggcggagcatcatctgctggattacaaaggcgtagagaaacgatttagccaaattcagccattacgttacccaagatggctggtagccttaatggttggcctttcctgcgcctgtttctgtaaactcaataaaggtggctgggatggtgccgtcatcaccttcctggccagtacggccgcgatgtatatccgccagctgctggcacaacgtcatcttcatccacagatcaacttttgcctcaccgctttcgccgccaccaccatttccggattgcttttgcaacttcccactttcagcaatacccccaccattgcgatggccgccagcgttctgctgctggtgccgggctttccgttgataaatgccgtcgccgatatgtttaaaggccacatcaataccggactggcacgctgggcaatcgccagtctgctgacactggctacctgtgtcggcgtagtaatggcactgacgatttgggggctacgcggatgggtgtga

SEQ ID NO: 12 - protein, 277 aa, Escherichia coli
MIQMDSHYLNNTQHVYDKGRVMQTEQQRAVTRLCIQCGLFLLQHGAESALVDELSSRLGRALGMDSVESSISSNAIVLTTIKDGQCLTSTRKNHDRGINMHVVTEVQHIVILAEHHLLDYKGVEKRFSQIQPLRYPRWLVALMVGLSCACFCKLNKGGWDGAVITFLASTAAMYIRQLLAQRHLHPQINFCLTAFAATTISGLLLQLPTFSNTPTIAMAASVLLLVPGFPLINAVADMFKGHINTGLARWAIASLLTLATCVGVVMALTIWGLRGWV

SEQ ID NO: 13 - DNA, 726 bp, Escherichia coli
atgttgccaggatgctgcaaaaatggaattgttatcagtaaaatacctgttatgcaagcagggttaaaagaggtcatgaggactcacttccctgaatatgaaataatatccagcgcctctgcggaggaccttaccttattacaattacgtcgttccggattagtcattgctgatttggccggtgaaagtgaagatccacgttccgtttgtgagcattattactctttaatctcacaatatcgggaaattcactgggttttcatggtgtcacgctcctggtattcccaggcagtagaattgctcatgtgccctacggcgacgttattgtctgatgttgaacccattgagaatctggtcaagaccgtacgttccggcaatacgcactcagagcgtatcagcgccatgctgacctctccggcaatgactgaaactcatgattttagctatcgctccgtcattctcactctttcagagcgcaaggtactgcggctattaggtaaaggatggggcatcaaccagatagcttcattgcttaagaaaagtaataaaactattagcgcccaaaaaaacagtgcgatgcgtcgactggcaattcacagcaacgctgaaatgtatgcatggataaatagcgcgcagggtgcaagagaacttaacttgccttctgtttatggagatgccgcagaatggaacacagccgaattaagaagagaaatgtcgcactcatag

SEQ ID NO: 14 - protein, 241 aa, Escherichia coli
MLPGCCKNGIVISKIPVMQAGLKEVMRTHFPEYEIISSASAEDLTLLQLRRSGLVIADLAGESEDPRSVCEHYYSLISQYREIHWVFMVSRSWYSQAVELLMCPTATLLSDVEPIENLVKTVRSGNTHSERISAMLTSPAMTETHDFSYRSVILTLSERKVLRLLGKGWGINQIASLLKKSNKTISAQKNSAMRRLAIHSNAEMYAWINSAQGARELNLPSVYGDAAEWNTAELRREMSHS

SEQ ID NO: 15 - DNA, 678 bp, Escherichia coli
atggaacacagccgaattaagaagagaaatgtcgcactcatagaaaaatgcgtcatgagtcgtatcggtattgagagtttattcagaaagtttgcaggtaacccttataagctccatacctataccagtcaggagtcatttcaggatgccatgtcgcggatctcgtttgcagcggtcattttttctttttctgccatgagaagtgcgcgcagagagggattatcctgcctgactgaactggcgattaagtttccgcgtacccggcgtttagttattgcggatgatgatattgaagctcggctgattggttcattgtcgccatcaccgctggacggtgtattaagtaaagcgtcaacgctggagatttttcatcaggaactctttttgtcattaaatggtgtacgtcaggcgaccgatcgactgaacaatcagtggtacattaaccaaagccggacgttaagcccgacggagagagaaatattgcgctttatgtcgcgtggctactcaatgacacaaattgccgagcagcttaaacgcaatattaaaacgatccgtgcacataaatttaatgtgatgtcgaaactgggcgtcagttctgatgcagggttgttggaggccgcagatattctgttatgtatgcggcattgcgaaacaagtaatgtgttgcatccttattaa

SEQ ID NO: 16 - protein, 225 aa, Escherichia coli
MEHSRIKKRNVALIEKCVMSRIGIESLFRKFAGNPYKLHTYTSQESFQDAMSRISFAAVIFSFSAMRSARREGLSCLTELAIKFPRTRRLVIADDDIEARLIGSLSPSPLDGVLSKASTLEIFHQELFLSLNGVRQATDRLNNQWYINQSRTLSPTEREILRFMSRGYSMTQIAEQLKRNIKTIRAHKFNVMSKLGVSSDAGLLEAADILLCMRHCETSNVLHPY

SEQ ID NO: 17 - DNA, 789 bp, Escherichia coli
atggcctatcgttccgcaccgctctatgaagatgttatctggcgaacgcatctccagccgcaggatgctgggcttgcacaagccgtgcgggcaacgatcgccgaacatcgtgaacatttgctggagtttatccgcctggatgaacccgccccacttaacgccatgacgctggcgcaatggtcatcaccgaatgcgctaagttctctactcgcggtctattccgatcatatctaccgcaaccaacctttgatgatccgcgaaaacaaaccgcttatctcactgtgggcgcaatggtatatcggcctgatggtaccaccattaatgctggcgctgctgactcaggaaaaagcattagatgtgtcgccggaacatgtccacgttgagtttcacgaaaccggacgcgccgcctgtttctgggtcgatgtgtgtgaagataaaaacgcaacactacattcgccgcagcagcgaatggaaacgttaatcagccaggcgctggttccggttctgcaggcactagaagcaacgggagagattaacggcaaacttatctggagcaataccggttatttgatcaactggtatctgactgagatgaaacagctgctcggcgaggcgacggttgaatcgctgcgctatgccctcttttttgagaaaacgcttactaccggtgaagataatccactctggcgtaccgtggtgctacgcgacggcctgctggtgcgccgcacttgctgccagcgttatcgcttaccggatgtgcagcaatgtggcgattgtacgctgaaatga

SEQ ID NO: 18 - protein, 262 aa, Escherichia coli
MAYRSAPLYEDVIWRTHLQPQDAGLAQAVRATIAEHREHLLEFIRLDEPAPLNAMTLAQWSSPNALSSLLAVYSDHIYRNQPLMIRENKPLISLWAQWYIGLMVPPLMLALLTQEKALDVSPEHVHVEFHETGRAACFWVDVCEDKNATLHSPQQRMETLISQALVPVLQALEATGEINGKLIWSNTGYLINWYLTEMKQLLGEATVESLRYALFFEKTLTTGEDNPLWRTVVLRDGLLVRRTCCQRYRLPDVQQCGDCTLK

SEQ ID NO: 19 - DNA, 348 bp, Escherichia coli
ttgctaatcctatcgataggtttacccgatagcaaggaatttctctggcttgcaaatgataaaaattatcatatgatattagttatcattatcaatgaaagagatgaaaccatgttgcaacgtacgctgggcagtggctggggagtgttgctgccgggattgctgattgcagggctgatgtatgcggatttatcgccggatcaatggcggattgtcattctgatgggattggtattgacgccggtgatgctgtatcacaaacagttacggcattacgttttgctaccatcgtgcctggcgcttattgctggcatcatgctgatgataatgaatttgaatcaggggtga

SEQ ID NO: 20 - protein, 115 aa, Escherichia coli
MLILSIGLPDSKEFLWLANDKNYHMILVIIINERDETMLQRTLGSGWGVLLPGLLIAGLMYADLSPDQWRIVILMGLVLTPVMLYHKQLRHYVLLPSCLALIAGIMLMIMNLNQG

SEQ ID NO: 21 - DNA, 123 bp, Escherichia coli
atgtcgccgcataccgtgtcggatgcggcgtacacgccttatctgaccgacaaacgaattatccacaatccgctgatggatatttttccagcaattacacctctgtcgataattaactattga

SEQ ID NO: 22 - protein, 40 aa, Escherichia coli
MSPHTVSDAAYTPYLTDKRIIHNPLMDIFPAITPLSIINY

SEQ ID NO: 23 - DNA, 1032 bp, Escherichia coli
atgtctgcatttaccccggcaagtgaagtcttgctgcgtcacagtgatgatttcgaacaaagccgtattctgtttgccggagacttacaggatgacctgcccgcgcgtttagataccgcggccagccgtgctcatacccagcaattccaccactggcaggtgttaagccgccagatgggggataacgcccgttttagcctggtcgccacggcgaatgatgtcgcagattgcgatacgctgatctactactggccgaagaacaaaccggaagcccagttccagttgatgaatttactttctctgcttccggtgggcacggatatttttgtcgttggcgagaaccgcagcggcgtgcgcatcgccgagcagatgctggccgattatgcgccgttgaataaggtagacagcgcccgtcgctgcggcctctattttggtcgtctggaaaagcagccggtatttgatgccaataaattctggggcgaatacagcgtcgatggcttgacggtcaaaacactgccgggcgtgtttagccgcgacggtctggatgtcggcagtcagttgctgctctcgacgctaactccacacacgaaaggtaaagtgctggatgtcggctgcggcgcgggagtgctttccgttgcttttgcgcgccattcaccgaagatccgcctcactctgtgtgatgtttctgcaccagcggtagaagccagccgcgcaacacttgcgaccaacggtgttgaaggtgaagtctttgccagcaacgtcttttccgaggtgaaaggtcgctttgatatgataatctccaacccgccgttccacgatgggatgcaaaccagcctggatgccgcgcaaacgctgattcgcggcgcggtgcgtcatctgaacagcggcggcgagttgcgaattgtagcgaacgccttcctgccttacccggacgtgctggatgagacatttggcttccatgaagtgatcgcgcaaaccgggcgcttcaaggtgtatcgcgccattatgacccgccaggcgaagaaaggttga

SEQ ID NO: 24 - protein, 343 aa, Escherichia coli
MSAFTPASEVLLRHSDDFEQSRILFAGDLQDDLPARLDTAASRAHTQQFHHWQVLSRQMGDNARFSLVATANDVADCDTLIYYWPKNKPEAQFQLMNLLSLLPVGTDIFVVGENRSGVRIAEQMLADYAPLNKVDSARRCGLYFGRLEKQPVFDANKFWGEYSVDGLTVKTLPGVFSRDGLDVGSQLLLSTLTPHTKGKVLDVGCGAGVLSVAFARHSPKIRLTLCDVSAPAVEASRATLATNGVEGEVFASNVFSEVKGRFDMIISNPPFHDGMQTSLDAAQTLIRGAVRHLNSGGELRIVANAFLPYPDVLDETFGFHEVIAQTGRFKVYRAIMTRQAKKG

SEQ ID NO: 25 - DNA, 414 bp, Escherichia coli
atgacatcccgacgagactggcagttacagcaactgggcattacccagtggtcgctgcgtcgccctggcgcgttgcagggggagattgccattgcgatcccgccacacgtccgtctggtgatggtggcaaacgatcttcccgccctgaccgatcctctggtgagcgatgttctgcgtgcgttaactgtcagccccgatcaagtgctgcaactgacgccagaaaaaatcgcgatgctgccgcaaggcagccgctgcaacagctggcggttgggtactgacgaaccgctatcactggaaggcgctcaggtggcatcaccggcgctcaccgaattacgggcaaacccaacggcacgcgccgcgttatggcaacaaatttgcacatatgaacacgatttcttccctcgaaacgactga

SEQ ID NO: 26 - protein, 137 aa, Escherichia coli
MTSRRDWQLQQLGITQWSLRRPGALQGEIAIAIPPHVRLVMVANDLPALTDPLVSDVLRALTVSPDQVLQLTPEKIAMLPQGSRCNSWRLGTDEPLSLEGAQVASPALTELRANPTARAALWQQICTYEHDFFPRND

SEQ ID NO: 27 - DNA, 447 bp, Escherichia coli
atgaacacgatttcttccctcgaaacgactgatttaccagcggcttaccacattgaacaacgcgcccacgcctttccgtggagtgaaaaaacctttgccagcaaccagggcgagcgttatctcaactttcagttaacgcaaaacggcaaaatggcggcgtttgcgattacgcaagtggtgctggatgaagctacattgttcaatattgcggtcgatcctgactatcagcgtcagggattgggaagggcgctgctggaacatctgatcgacgaactggaaaaacgcggcgtggcgacgctatggctggaagtccgtgcctcaaatgctgccgccattgccctgtacgaaagtttaggctttaacgaggcgacgattcgccgcaattactaccccaccacggacggtcgcgaagacgccatcatcatggcgttaccaatcagtatgtaa

SEQ ID NO: 28 - protein, 148 aa, Escherichia coli
MNTISSLETTDLPAAYHIEQRAHAFPWSEKTFASNQGERYLNFQLTQNGKMAAFAITQVVLDEATLFNIAVDPDYQRQGLGRALLEHLIDELEKRGVATLWLEVRASNAAAIALYESLGFNEATIRRNYYPTTDGREDAIIMALPISM

SEQ ID NO: 29 - DNA, 678 bp, Escherichia coli
atgaagtgggactggattttctttgatgccgatgaaacgctgtttacctttgactcattcaccggcctgcagcggatgtttcttgattacagcgtcacctttaccgctgaagattttcaggactatcaggccgttaacaagccactgtgggtggattatcaaaacggcgcgatcacttcattacagcttcagcacgggcggtttgagagctgggccgaacggctgaacgtcgaaccgggtaaactcaacgaggcctttattaatgcgatggcggaaatctgtacgccgttgccgggggcggtttccctgcttaacgccattcgtggcaacgccaaaatcggcatcatcaccaacggctttagcgccttgcaacaggtacgtctggaacgcacgggcctgcgtgattacttcgatttgctggtgatttccgaagaagttggcgttgccaaaccgaataagaaaattttcgattatgcgctggaacaagcgggcaatcctgaccgttcacgcgtgctgatggttggtgacactgccgagtccgatattctcggtggcatcaacgccgggcttgcgacctgctggctgaatgcgcacaatcgcgagcaaccagaaggcatcgcgcccacctggaccgtttcttcgttgcacgaactggagcagctcctgtgtaaacactga

SEQ ID NO: 30 - protein, 225 aa, Escherichia coli
MKWDWIFFDADETLFTFDSFTGLQRMFLDYSVTFTAEDFQDYQAVNKPLWVDYQNGAITSLQLQHGRFESWAERLNVEPGKLNEAFINAMAEICTPLPGAVSLLNAIRGNAKIGIITNGFSALQQVRLERTGLRDYFDLLVISEEVGVAKPNKKIFDYALEQAGNPDRSRVLMVGDTAESDILGGINAGLATCWLNAHNREQPEGIAPTWTVSSLHELEQLLCKH

SEQ ID NO: 31 - DNA, 1224 bp, Escherichia coli
atggcgctgtctgatgcgtggttgcgttcagtcgttggaaaggaacgtgataaggttttggttaaatccgatcgtgatggtctgtctgtcagagtatcaccgaaaggtcgcgtagtgttccaatatcgttatcaatgggcagggaaaggtgagcgccttgatatcggaacttacccggcaactggattaaaagaggccagagaagaggttatccgtctccgtggtgaactcgagtcaaaccgcaatccacgattagtcaagcaggctgaaaaacgaaaagctactgaagccatgacggtagagtctgtgatccgtgcctggtatgaagcatattgtgtaaaaaataaaaaaggttctgaacagatactccgctcgtttgagctgcacctgttctctaaaatcgggaatatccctcacgatgcagctacattgcatgattggttagaagtcctggagcctcttagcactaagactccagcaatagcagaccgattgctaattaacgcaaagcaggcccatgtctgggcgtataagagaaagctcattgaaactcgcccgctgtcggatatcacgggtaaagatatggatatccgtaaaggtcagaagaaacggtttctgacacatgatgaaattaaaatcctttatgctgcgatcgatggttctcgaatggttcctaaataccgggccttcattaaactattgctgcattttggctgccgtagttcagagctaattaccgccagggtggacgattttgatttcattaataaagtatggactgtaccaccagaacgacataagactggggagataacaggcgaaccgctaaagcggcccattattgaaccggttgaagagcttataaagtacgctatttctatgaacaatggttccgatatgctttttactaaggaaggaagcagggaacccgttggtcggacatcattgcagtcgctgccttacaatttaatgcagtacgcatggcggcgtttggggtatcaattccctcattggtctcttcatgatttgaggcgaacagcacgaacaaacttttctgatcttactgcgcctcatattgcagaaataatgctaggtcataaactgccaggggtatggcaagtttatgacaagagcgattatctagaagaacagcgtaaagcctaccaggcatggtgggagagagttgaatcgattgttacttgttctggttcagacaccaactga

SEQ ID NO: 32 - protein, 407 aa, Escherichia coli
MALSDAWLRSVVGKERDKVLVKSDRDGLSVRVSPKGRVVFQYRYQWAGKGERLDIGTYPATGLKEAREEVIRLRGELESNRNPRLVKQAEKRKATEAMTVESVIRAWYEAYCVKNKKGSEQILRSFELHLFSKIGNIPHDAATLHDWLEVLEPLSTKTPAIADRLLINAKQAHVWAYKRKLIETRPLSDITGKDMDIRKGQKKRFLTHDEIKILYAAIDGSRMVPKYRAFIKLLLHFGCRSSELITARVDDFDFINKVWTVPPERHKTGEITGEPLKRPIIEPVEELIKYAISMNNGSDMLFTKEGSREPVGRTSLQSLPYNLMQYAWRRLGYQFPHWSLHDLRRTARTNFSDLTAPHIAEIMLGHKLPGVWQVYDKSDYLEEQRKAYQAWWERVESIVTCSGSDTN

SEQ ID NO: 33 - DNA, 1254 bp, Escherichia coli
atgaaagtcgaaatgaatactaaacttttggcctatttaaacaatgagttacatggagtgtggatagatagtgaaaatcgtaatatccacataatacttaaatcaagccttcctataattaaatccgtctggtcaggagcacctatccactttttggtaggtttatctactaaaaatatactagtgattgggatgttgattgaagataatgtcgataatccatttttactagcctatccaccaagagaggcagatgaaattaaagggctggatttgttattgtcaggcgcttatgatggtattctattatcattttttgactcgcatacaatgcgtgttatggacctgaaaataaaagtttcggaaaatttaccgtgtgaatgtttaaaaaaattttgtgctaattcatattctctcaattcaggatttagggaaggtaatgaagcaatggatgaattctgcaacaatgctttgactggtaacgagaaaataattagtctgccactaagtgtaatcgataaaaaatcttacctagcaagtgttcatgaaccaaacgataccgtattaacatatgaatttagcgtcagtgaaaacggctctgagggatatgagcaggaagctcttatataccatgctttgcggcaggtcttttcaccggaggaagtgtttttttctccagatattattgagggtaataaaaaaagagaattagttgatattcttattgtagaaaatgactatgtattatctatacagtctaaagcatcatctttgattgaaatgggtttaaaatctcatgaaaagctttgtagcatgtataagaaaaaagcattgcaagggatcgatcaggttaaaggcgttatcccaattctaaataatgatgtggttattaattatgacgggagggaatgcttaataaagcgcagaaagggtatttatcatttagtgataatctcagatcttgttttagagaaagaaggtgctgaaaagatttataacgaaattagcaaccttaaagagtcaaaaggggcgaaagttttagttatgagccttgaaggtcttgtaaattttataagactatcaagattaaataaaagaatgttttgggcaatgctggagactaaatacaagttcagcataaaaaaccgtacaattttaattagagatatcgactctagccaagagaataatctaccattacttgccactgatcaatacctatcacttcttcgaggtgcgggaaaagtaaaataa

SEQ ID NO: 34 - protein, 417 aa, Escherichia coli
MKVEMNTKLLAYLNNELHGVWIDSENRNIHIILKSSLPIIKSVWSGAPIHFLVGLSTKNILVIGMLIEDNVDNPFLLAYPPREADEIKGLDLLLSGAYDGILLSFFDSHTMRVMDLKIKVSENLPCECLKKFCANSYSLNSGFREGNEAMDEFCNNALTGNEKIISLPLSVIDKKSYLASVHEPNDTVLTYEFSVSENGSEGYEQEALIYHALRQVFSPEEVFFSPDIIEGNKKRELVDILIVENDYVLSIQSKASSLIEMGLKSHEKLCSMYKKKALQGIDQVKGVIPILNNDVVINYDGRECLIKRRKGIYHLVIISDLVLEKEGAEKIYNEISNLKESKGAKVLVMSLEGLVNFIRLSRLNKRMFWAMLETKYKFSIKNRTILIRDIDSSQENNLPLLATDQYLSLLRGAGKVK

SEQ ID NO: 35 - DNA, 348 bp, Escherichia coli
atgacaaccgaaattaactaccatgcactgcttgagcgcgcacggaataaagtgcagagcattgagttcgccttaacacagagtgcattcgctgagattcgcgctgagcttgaagatgatttagaactggcacggattgcactggcatctctggaagttgagccagatgaacgcgcagcctatgaattatttatggaaaagcgtttcggtaaaacagtcgatcgtcggagagcaaaaaacggtgataacgagtacatggcgtgggatatggctctcggctgggtcgtctggcaacaacgcgcgggcatgagtctttcaactgcacaaccacaggagggtcaacaatga

SEQ ID NO: 36 - protein, 115 aa, Escherichia coli
MTTEINYHALLERARNKVQSIEFALTQSAFAEIRAELEDDLELARIALASLEVEPDERAAYELFMEKRFGKTVDRRRAKNGDNEYMAWDMALGWVVWQQRAGMSLSTAQPQEGQQ

SEQ ID NO: 37 - DNA, 879 bp, Escherichia coli
atgtgcataactcatgtagttagtttttccggcgggagaacatctgcatatcttgttcacctgatggaagaacaaagaaaggctggcaataacgtctgctacatctttatggataccggttgcgaacatccgctgacataccgctttattcgggaggttgtgaagttctggggcataccactaactgtgttgcaggtcgatatcaatcctgagcttgggcagccaaatggttatacagaatgggagccaaaggatattcagacgcgaatgccggtacttaaaccgtttatggacatggttaaaaagtacggcacgccatacatcggcggcgcgttctgtactgacaggctaaaactcatccctttcacgaaatactgcgataaccatttcgggcgaggtaattacatcacatggctgggtattcgtgcagacgaaccccgtaggctgaaaccgaaatcgggcgtccggtatcttgccgaactgtcagattttgataagtcggatgttatccggtggtggcgaaaacaaccttttgatttgcaaatcccggagcatctcgggaactgtgttttctgcatcaaaaagtcaacgcaaaagctggggcttgcatgtaaagacgaacctggtctgatgcgagtttttaatgagctggttacaggcaaacacgtcagggatggtcatcgcagaacaggtaaagacgttatgtaccgtggtcacctgacgcttgacggaattgccagaatgtctgccaacagcgactacagaaatttgtatcaggcgatggtacaggccaggcgattcgataccggctcgtgttcagagtcatgtgaaatctggggtgatcaattagaattgaaattcgaagaggtaggggtatga

SEQ ID NO: 38 - protein, 292 aa, Escherichia coli
MCITHVVSFSGGRTSAYLVHLMEEQRKAGNNVCYIFMDTGCEHPLTYRFIREVVKFWGIPLTVLQVDINPELGQPNGYTEWEPKDIQTRMPVLKPFMDMVKKYGTPYIGGAFCTDRLKLIPFTKYCDNHFGRGNYITWLGIRADEPRRLKPKSGVRYLAELSDFDKSDVIRWWRKQPFDLQIPEHLGNCVFCIKKSTQKLGLACKDEPGLMRVFNELVTGKHVRDGHRRTGKDVMYRGHLTLDGIARMSANSDYRNLYQAMVQARRFDTGSCSESCEIWGDQLELKFEEVGV

SEQ ID NO: 39 - DNA, 111 bp, Escherichia coli
gtgaaagggatgagttttagcctgtcagtacagaacgcgccgccgatgtatggcgtgccgtactttttaaccatgtccataaacggtttaagtaccggcattcgcgtctga

SEQ ID NO: 40 - protein, 36 aa, Escherichia coli
MKGMSFSLSVQNAPPMYGVPYFLTMSINGLSTGIRV

SEQ ID NO: 41 - DNA, 537 bp, Escherichia coli
atgtcatttattaaaactttttccgggaagcatttttattatgacaggataaataaagacgacatcgcgattaacgatatcgcagtttccctttcaaatatctgtcgctttgccggtcatctttcacacttctacagcgtcgcccaacatgcggtgctttgcagcaaactggttccggaggagtttgcttttgaagcgttaatgcatgatgcaacagaagcgtattgtcaggacatccccgcgccactgaaacgccttcttcctgactataaacagatggaagaaaaaatagacgccgtaatccgtgagaaatacgggttacctcctgttatgagcacgccagtgaaatatgccgatctcattatgctggcaaccgaacgccgcgatctcgggcttgatgatggctctttctggcctgtactggaaggtatcccggcaacagagatgttcaaagtgattccactggcaccaggacatgcctacgggatgtttatggaacgttttaacgagttatcggagttacgcaaatgtgcataa

SEQ ID NO: 42 - protein, 178 aa, Escherichia coli
MSFIKTFSGKHFYYDRINKDDIAINDIAVSLSNICRFAGHLSHFYSVAQHAVLCSKLVPEEFAFEALMHDATEAYCQDIPAPLKRLLPDYKQMEEKIDAVIREKYGLPPVMSTPVKYADLIMLATERRDLGLDDGSFWPVLEGIPATEMFKVIPLAPGHAYGMFMERFNELSELRKCA

SEQ ID NO: 43 - DNA, 96 bp, Escherichia coli
gtgcaggaagaaatggctaacgaatttcgtgatctgcttgttgaaaaattcaaagacagcaaagtagaaacctttattggtactttcaccgcctga

SEQ ID NO: 44 - protein, 31 aa, Escherichia coli
MQEEMANEFRDLLVEKFKDSKVETFIGTFTA

SEQ ID NO: 45 - DNA, 795 bp, Escherichia coli
atgtctcagaacttagacgcaaccgcaattaatcaaatccatgcccttatttctgctcagggtgttaatgaaattatcagtaagattggtgccgatgctgtggcattgcctgagaatttccgcattcatgatctggaaaaatttaatttaaatcgcttccgtttccgtggtgcgctttccactgccagcatcgatgactttacccgttattctaaagatcttgcagatgaaggcacccgctgctttatcgatgccgataatatgcgtgccgtcagtgtgcttaacctgggtactattgatgaaccaggtcacgcagataacaccgccactctcaaactgaaaaagacagcaccgttctctgctctgttgtctgttaacggcgagcgtaactcccagaagtcactggcagaatggattgaagactgggccgactaccttgtgggctttgatgctaatggtgacgccattcaggcaacaaaagcggctgcggctgtccgtaaaatcacgattgaagcaaaccagaccgctgattttgaagacaatgacttcagcggcaaacgctccctgatggagtctgtcgaagcgaaaaccaaagatattatgccagtggcatttgaatttaaatgcgttccgtttgaaggcctgaaagaacgtccgtttaaattacgcctcagcattatcactggcgatcgtcctgtactggttctgcgcattattcagctggagcagtgcaggaagaaatggctaacgaatttcgtgatctgcttgttgaaaaattcaaagacagcaaagtag

SEQ ID NO: 46 - protein, 264 aa, Escherichia coli
MSQNLDATAINQIHALISAQGVNEIISKIGADAVALPENFRIHDLEKFNLNRFRFRGALSTASIDDFTRYSKDLADEGTRCFIDADNMRAVSVLNLGTIDEPGHADNTATLKLKKTAPFSALLSVNGERNSQKSLAEWIEDWADYLVGFDANGDAIQATKAAAAVRKITIEANQTADFEDNDFSGKRSLMESVEAKTKDIMPVAFEFKCVPFEGLKERPFKLRLSIITGDRPVLVLRIIQLEQCRKKWLTNFVICLLKNSKTAK

SEQ ID NO: 47 - DNA, 114 bp, Escherichia coli
atgaaatcaggcggtgaaagtaccaataaaggtttctactttgctgtctttgaatttttcaacaagcagatcacgaaattcgttagccatttcttcctgcactgctccagctga

SEQ ID NO: 48 - protein, 37 aa, Escherichia coli
MKSGGESTNKGFYFAVFEFFNKQITKFVSHFFLHCSS

SEQ ID NO: 49 - DNA, 141 bp, Escherichia coli
ttgccggtgaacctgacggaaaactccgcgcagcaggtcgttaatatcgtttttaataaactgattatttatctcatcactgaatatctttatatagtgaggacttattatgtctcagaacttagacgcaaccgcaattaa

SEQ ID NO: 50 - protein, 46 aa, Escherichia coli
MPVNLTENSAQQVVNIVFNKLIIYLITEYLYIVRTYYVSELRRNRN

SEQ ID NO: 51 - DNA, 549 bp, Escherichia coli
ttggcggtaccagtttgtacacttgcttccggctggtaccgctctttttacaaaacagagaagggcatcaccggacgacgggctcataacccaatccatccgggcggctgccaccgcaggtgttcttctctgttttgtggagaaaccaaccgaccttgcagggtcgatatgatgaggagcagcaaaatggctagcgaacgcagtactgatgtgcaggcatttatcggggagctggacggcggcgtatttgaaaccaaaatcggcgctgttctcagtgaagtcgcttccggtgtgatgaacacgaaaaccaaaggtaaggtctcgctcaacctggaaatcgaaccgtttgatgagaaccgtgtaaaaatcaaacacaaactctcatatgttcgcccgactaaccgcgggaaaatttccgaagaagacaccaccgaaacgccgatgtatgtcaatcgcggtggtcgcctgactattctgcaggaagaccagggacaattactgactcttgccggtgaacctgacggaaaactccgcgcagcaggtcgttaa

SEQ ID NO: 52 - protein, 182 aa, Escherichia coli
MAVPVCTLASGWYRSFYKTEKGITGRRAHNPIHPGGCHRRCSSLFCGETNRPCRVDMMRSSKMASERSTDVQAFIGELDGGVFETKIGAVLSEVASGVMNTKTKGKVSLNLEIEPFDENRVKIKHKLSYVRPTNRGKISEEDTTETPMYVNRGGRLTILQEDQGQLLTLAGEPDGKLRAAGR

SEQ ID NO: 53 - DNA, 750 bp, Escherichia coli
atgaaaacagtccatgacatccggcggtctaacgccagaaaactgagagatggtgttggcgggaattcttcctttgccacyatgattgatcgcgagccaacccagaccagcaggtttatgggagatggtgctactaaaaatatcggtgacagcatggcamgrcacatcgaaaaatgtttcgacctgcctgtcggatggctygatcaagaacaccagacmacgaacatcacaaaaaaacctgatgtttcaatcactaayaaacaaatmacrttagtccctgtcatatcatgggtacaggccggagcatggaaagaagttggmtattctgaggttgatttgagcacagcagaaacktatccctgccctgtaccctgtggsgaaatgacttatatcttgcgggtgatwggtgattcaatgattgatgagtaccgcccgggagacatgatttttgtygatcctgaagtmcctgcctgccacggtgacgacgttattgcattgatgcacgatacasgygaaaccaccttcaagmggttgatagaagatggracacagcgttatctcaaagcattaaacccaaactggcctgagccttacattaagatyaacggtaattgctctataattggtacwgtgattttctcgggaaaaycarragatacamatmaacgcytatcaatrtttatgatctgctcgcagttttttatactgacatgtactatgagatacataatgtatccaaaagaaacatga

SEQ ID NO: 54 - protein, 249 aa, Escherichia coli
  Xaa 171, 217, 218, 221, 222, 226: Xaa is any amino acid
MKTVHDIRRSNARKLRDGVGGNSSFATMIDREPTQTSRFMGDGATKNIGDSMARHIEKCFDLPVGWLDQEHQTTNITKKPDVSITNKQITLVPVISWVQAGAWKEVGYSEVDLSTAETYPCPVPCGEMTYILRVIGDSMIDEYRPGDMIFVDPEVPACHGDDVIALMHDTXETTFKRLIEDGTQRYLKALNPNWPEPYIKINGNCSIIGTVIFSGKXXDTXXRLSXFMICSQFFILTCTMRYIMYPKET

SEQ ID NO: 55 - DNA, 552 bp, Escherichia coli
gtgggtaagcatcactggaaagtagaaaaacagcctgagtggtacgtgaaagctgtcagaaaaactatcgcggcgttgccgggaggttacgctgaagctgctgagtggctggatgtaacagagaacgctttattcaaccgccttcgtgcagatggcgatcagattttcccgctgggatgggcaatgattttacagcgcgcggctggcactcactacattgcggatgctgtcgcacagtctgctggtggggtgtttgtatcgcttcctgaacttgaggaagtagagaacgccgatataaaccagcgcctgctggaagtcatcgaacagatcgggagttactcaaagcagattcgttcggcaatcgaagatggggtagtggagccacacgagcagacagcaattaatgatgagttgtatctgtcaatttcgaagctccaggagcatgcagcactggtctacaaaatcttttgcgctccagaaaagagtgacgcccgcgagtgtgcagctccgggcgtcgtggcgttttgtgtctgtggagaaactaacgcatga

SEQ ID NO: 56 - protein, 183 aa, Escherichia coli
MGKHHWKVEKQPEWYVKAVRKTIAALPGGYAEAAEWLDVTENALFNRLRADGDQIFPLGWAMILQRAAGTHYIADAVAQSAGGVFVSLPELEEVENADINQRLLEVIEQIGSYSKQIRSAIEDGVVEPHEQTAINDELYLSISKLQEHAALVYKIFCAPEKSDARECAAPGVVAFCVCGETNA

SEQ ID NO: 57 - DNA, 837 bp, Escherichia coli
atgaacagtttaacggcaaataaccgtttgtcgcaacagctggtggtcagcgtcgctgaacacctgttgttacggcatgaatgcagattaccaaatcacatggctgtaagtaaccacagagaactttacctgactgtggggggcgagttgtgcaggaacttaaccgctggtttcgtgacggaagagggctttatgtccatgttattcgttgggagccagaaacacagcgcgttatctatcttcgcaaagactacccgcatgagtgctttagtcctttgtggaaattcaggcgtgattttgttgagtgtgaaggaccaccagcacattgattctgccattccgggacgttacactgttcaggcaccttataaagcgggtgtcgggattggcgtcctggaattgcatacggcgacaattggcgcgttagcgtcttttttgttgctacaactcagctatacccaaattatggtgggctgggtgggggcaccgaaaggtgcgccggtttccgtatgcgccggttacgccaaccctgctcagttcaccaccagcgaaattggcgtttccggtggtggaagttatccattgcatacggaggctgccatcatggctactgtcccagccctctctcgtctgaatgatgaagacttacataaactcagttatgtaacaactgcactacatgctctgcgcaaggtaactctttcggatccgcaggcgcatcaggttttggtagaaacccttcttaacttgcaggctgaacgtattcgtctggcggataaggctaattttcatattcaccgtctcctgaatatcagcggagggcatcgtcatgcttaa

SEQ ID NO: 58 - protein, 278 aa, Escherichia coli
MNSLTANNRLSQQLVVSVAEHLLLRHECRLPNHMAVSNHRELYLTVGGELCRNLTAGFVTEEGFMSMLFVGSQKHSALSIFAKTTRMSALVLCGNSGVILLSVKDHQHIDSAIPGRYTVQAPYKAGVGIGVLELHTATIGALASFLLLQLSYTQIMVGWVGAPKGAPVSVCAGYANPAQFTTSEIGVSGGGSYPLHTEAAIMATVPALSRLNDEDLHKLSYVTTALHALRKVTLSDPQAHQVLVETLLNLQAERIRLADKANFHIHRLLNISGGHRHA

SEQ ID NO: 59 - DNA, 237 bp, Escherichia coli
atgcttaatccgttgatcctcaatatttgccgtttgcttcagcgtaaaaaaacatcaattcctacagttgggcagtggtacaccacgcctgcagggcatgttctacgtgttagcctggttgaccgtgaatgccagaaggtgatttgtgaaccgctgggccgtaattaccgcgtcagtatgccgcttatagcctttcgctccggaaaaaacatgaagcatctcggaggtgcagcatga

SEQ ID NO: 60 - protein, 78 aa, Escherichia coli
MLNPLILNICRLLQRKKTSIPTVGQWYTTPAGHVLRVSLVDRECQKVICEPLGRNYRVSMPLIAFRSGKNMKHLGGAA

SEQ ID NO: 61 - DNA, 819 bp, Escherichia coli
atgagtatggagctgatggttaaagcgatgaaaattcgagtgggtaatccattgcgaaaactggttctgatcaagctggctgataatgccagcgatcagggtgagtgctggcccagctaccagcatattgctgaccagtgcgagattagcaaacgttctgtgatgaatcatattgcggccctttgtgagtccgggctggtaaaaaaagtcacccggaaaggtgaaaaaggtaactcaagtaatatctatctccttcatctggatggtgcaggagattcactagggggtagtgcaaataattcactatctggtgcagcaaattcactaggtagtgcaggagttgcaccagggggtagtgcaggagattcacccagaaccagtcactcttttgaaccagtcaaagaaccagtcaatgaaccaatagctgttggtgcatcagttgatgagcccgtgcgagttcgttcaaaccgaccggaatactctccggagtttgagcaggcatggctggcatatcccaaacgtgctggtggcaattcaaaatctgcagccttcaaagcctggaaagcccgtttgaatgagggagtaaaccccgaaaccatgctggaaggtgtgaaacgctacgcgggctgggtatctgcgatgggtaacagcggcacacaatttgtgaaacaggctgtcacgttctttggtccggatcgtcatttcgaagaattctgggaagttcctgcggtatctgcagccagacgcgaggacccgtacttcaaagccagttacgacaacgtggactacagccagatcccggcaggattcagggggtga

SEQ ID NO: 62 - protein, 272 aa, Escherichia coli
MSMELMVKAMKIRVGNPLRKLVLIKLADNASDQGECWPSYQHIADQCEISKRSVMNHIAALCESGLVKKVTRKGEKGNSSNIYLLHLDGAGDSLGGSANNSLSGAANSLGSAGVAPGGSAGDSPRTSHSFEPVKEPVNEPIAVGASVDEPVRVRSNRPEYSPEFEQAWLAYPKRAGGNSKSAAFKAWKARLNEGVNPETMLEGVKRYAGWVSAMGNSGTQFVKQAVTFFGPDRHFEEFWEVPAVSAARREDPYFKASYDNVDYSQIPAGFRG

SEQ ID NO: 63 - DNA, 165 bp, Escherichia coli
gtgctgcaaccgtgtggatggcggcattccgtgaaagccactcccagccagaacgaaacaattttctggcgcgtcgtgagcrgtgyttacggaaaagcagcaagcgcgctgyatcgggtgawgagtggtatctgtcagggaattacgtgggggcttaatgagtaa

SEQ ID NO: 64 - protein, 54 aa, Escherichia coli
  Xaa 28, 29, 38, 41: Xaa is any amino acid
MLQPCGWRHSVKATPSQNETIFWRVVSXXYGKAASALXRVXSGICQGITWGLNE

SEQ ID NO: 65 - DNA, 654 bp, Escherichia coli
atgagtaataaatattgccaggmgctggtggagctgcggaacaaaccagcccatgaactgaaggaagtgggygatcagtggcgcacgccggacaacattttctggggaattaacaccytgtttggcccgtttgttcgggatctgtttactgacggtgataacgccaaatgtgctgcgtattacacggcggaagacaacgcgctggcgcatgactggtcagaacgtcttgcggagcttaaaggtgctgcctttggtaatcccccatacagccgcgccagtcagcatgaggggcaatacatcaccggcatgcgttacatcatgaaacatgccagtgccatgcgtgataaaggtgggcgctatgttttcctgatcaaagctgccaccagcgaagtttggtggccggaagatgcagaccatattgcttttattcgcgggcgtattggttttgaactgccagcctggtttatcccgaaggacgagaagcaggtgccgacaggcgctttcttcgctggtgctattgctgttttcgacaagacctggaagggaccggcaatcagctacatcgggcgcgatgaacttgaggcatgtggtgaggcctttctggcgcaggttcgccagcaggcggaaaaactggtcagggagatggcggcatga

SEQ ID NO: 66 - protein, 217 aa, Escherichia coli
  Xaa 8: Xaa is any amino acid
MSNKYCQXLVELRNKPAHELKEVGDQWRTPDNIFWGINTLFGPFVRDLFTDGDNAKCAAYYTAEDNALAHDWSERLAELKGAAFGNPPYSRASQHEGQYITGMRYIMKHASAMRDKGGRYVFLIKAATSEVWWPEDADHIAFIRGRIGFELPAWFIPKDEKQVPTGAFFAGAIAVFDKTWKGPAISYIGRDELEACGEAFLAQVRQQAEKLVREMAA

SEQ ID NO: 67 - DNA, 327 bp, Escherichia coli
atgacgacattaactcaatgccagcagcaggtgctggatatgctgatttcttaccagaaagaacgtggcttcccgccaaccaatcaggaggtggcaaccatgctgggataccgttcagtgaatgcagcggtggagcatcttcgcgcactggagaaaaaaggcgtcatcacgataaagcgtggcgtggcccgggggataacgcttcataccgcggtgaaggacgacgacagcgaggcggtcgggattatccgctcactgcttgccggtgaggaaaacgcaaggctgcgtgcaacccactggttacatgagaggggcctgaaagcatga

SEQ ID NO: 68 - protein, 108 aa, Escherichia coli
MTTLTQCQQQVLDMLISYQKERGFPPTNQEVATMLGYRSVNAAVEHLRALEKKGVITIKRGVARGITLHTAVKDDDSEAVGIIRSLLAGEENARLRATHWLHERGLKA

SEQ ID NO: 69 - DNA, 390 bp, Escherichia coli
atgaagctgatcctgccttttccgcccagcgtgaacacgtactggcgacaccccaacaaaggggcgtttgcaggtaagagcctgataagcgcggcggggcgcaaattccagagcgcggcgtgtgcagcaatagttgagcagttacgtcgtctgccaaaaccaacgtcggcacctgcttcagtggagatcgtgttgtttcctccggataaccggatccgcgatctggacaactataacaaggcgctgtttgacgccctgacccacgcgggtgtgtgggaagacgacagtcaggtgaaaagaatgctggtggagtggggaccggttatcccggaagggaaggtcgagatcactatcagtaagtacgagaaaacggcgggtgcagccgcctga

SEQ ID NO: 70 - protein, 129 aa, Escherichia coli
MKLILPFPPSVNTYWRHPNKGAFAGKSLISAAGRKFQSAACAAIVEQLRRLPKPTSAPASVEIVLFPPDNRIRDLDNYNKALFDALTHAGVWEDDSQVKRMLVEWGPVIPEGKVEITISKYEKTAGAAA

SEQ ID NO: 71 - DNA, 843 bp, Escherichia coli
atgaataatctgatggtcattgatggtattgaagttcgtcgtgatgcttatggacgttacagcctgaacgatctgcatcgcgcagcagtagcatctggtgcaaatgccagaaccaaggagccgggaaagtttctttccagccaacagattactgagctggttcaggaattgatcgatacccaaaatctgggtgtcggttcattcaatgaaactacccaaaatttgggtagtaaacctgtcagtaaaatagaagggcggaatggcggaacatatgtctgtaaggaactggtgtatgcctatgcaatgtggatcagcccgtcattccatctgaaggtgatccgcactttcgacatggtaaccagcgcaccggaaaaattatccgggcaggctgctgacaagatgcaggctggcgtgattctgctggactttatgcgccgggagttaaatctgtctaactcatcagtgcttggtgcctgtcagaaacttcaggaggctgttggcttaccgaatctggcaccgcgctatgccattgatgctcctgctgatgcacacgatggctcaagtcgcccgacactgtcrctgagtgcactgctgaaacagtatggtatmcgcctgacggctaatcaggcatatcaccagatggcgaagctggggatcgttgaacaacgygaacgatacagccgyachgcgattaacaacatcaaaaaattctggtcgctgacggcgaaaggctgcatgttcggcaaraacatcaccagtccygcaaatccgcgcgagacgcagccgcatttcttcgaatcccgattccctgagctgttaaagctgctcgataccgttcattga

SEQ ID NO: 72 - protein, 280 aa, Escherichia coli
MNNLMVIDGIEVRRDAYGRYSLNDLHRAAVASGANARTKEPGKFLSSQQITELVQELIDTQNLGVGSFNETTQNLGSKPVSKIEGRNGGTYVCKELVYAYAMWISPSFHLKVIRTFDMVTSAPEKLSGQAADKMQAGVILLDFMRRELNLSNSSVLGACQKLQEAVGLPNLAPRYAIDAPADAHDGSSRPTLSLSALLKQYGIRLTANQAYHQMAKLGIVEQRERYSRTAINNIKKFWSLTAKGCMFGKNITSPANPRETQPHFFESRFPELLKLLDTVH

SEQ ID NO: 73 - DNA, 942 bp, Escherichia coli
ttgttcagrcccggttcagagctgatgcccctgtttatgcaggggcgtgtcctgctggagcctgagccggaacgttattcatctttcgccagtggtgccgttccggcggcatcacaaccgctggcggatgatcctgccgttcgggccgtgttccgcaatgaggcagtgatccgtcgtgckggkggcgtggaatgtcttgaaagctggttacttcgtgaaaagggctgtcagtggcctcattccgamtggcacagcgagaacatgaccacaatgcgacacgcgccgggcgcaatccgtctgtgctggcactgcgataaccwgctkcgcgatcagttcacggaacggctggaatcaatggcaacggataactgtgcccgctgggtgttgtctgttgtgcgtcgggatctcggttttgatgacagtcacgttgtgacaatgccggaactgtgctggtggctggttcgtaatgayctggcggatgccttaccggaaagtgcagcccgtaaggcactgagattaccgaagcckgttgtgccgtctgtcacccgggaragtgaccttgtkccttcggttcctgccaccagcatyatccaggataargcgaaaaaggtgctggcgctgaaagtggatccrgagtcgccggagtcttttatgttacgcccaaaacgtcgccgctgggttaatgaaaagtacacgcgctgggttaagacacagycgtgtgcatgttgtggaaagccygctgatgatccccaccacctgataggccacggacagggtggaatgggtacaaaagcgcatgacctttttgtgttgcctttgtgcagaaagcatcacgacgagctgcatgcggataccgtggcatttgaagagatgtatggctcccagctggagctgatatttcgttttatcgatcgtgcgctggcaattggcgtactggtgtaa

SEQ ID NO: 74 - protein, 313 aa, Escherichia coli
  Xaa 82, 107, 239: Xaa is any amino acid
MFRPGSELMPLFMQGRVLLEPEPERYSSFASGAVPAASQPLADDPAVRAVFRNEAVIRRAGGVECLESWLLREKGCQWPHSXWHSENMTTMRHAPGAIRLCWHCDNXLRDQFTERLESMATDNCARWVLSVVRRDLGFDDSHVVTMPELCWWLVRNDLADALPESAARKALRLPKPVVPSVTRESDLVPSVPATSIIQDKAKKVLALKVDPESPESFMLRPKRRRWVNEKYTRWVKTQXCACCGKPADDPHHLIGHGQGGMGTKAHDLFVLPLCRKHHDELHADTVAFEEMYGSQLELIFRFIDRALAIGVLV

SEQ ID NO: 75 - DNA, 753 bp, Escherichia coli
atgaaccttgaagccttaccgaaatattactccccaaaatctccaaaattgagcgatgacgcatcggcgacaggctcgggtggtttaacaattacggatgtratggctgcgcaggggatggtgcagtcgaaagcaccgcttggttttgccttattcctggcaaaagttggtgttcaggaccctcagtttgcgattgaaggtctgctcaattacgcgatggcactggataacccgacattgaacaaattgagtgaagaaaaccggttacagatcatcccttaccttgtgaattttgcctttgctgattattccaggtctgcggcaagtaaggctcgctgtgagcattgtgcaggtacgggatttcataatgtattgcgcgaagtggtgaaacactccagaagcggggagtctgttgtcaaggaagagtgggtgaaggaactatgtcagcattgtcatggtaagggagaagtcagcacagcgtgcagagggtgtaagggtaaaggtattgtactggatgagaaaagaacccggcttcatggtgcgcctgtttataagatttgtgggcgttgcaatggaaaccggtttagccgtttaccaaccacactggcgcggcttcatgtccagaagctggtaccagacctgacggattatcagtggtacaaaggatatgcagatgtcattgataaactggttacaaagtgctggcaggaagaagcatatgcagagatacaattgagaaaggtgacaagataa

SEQ ID NO: 76 - protein, 250 aa, Escherichia coli
MNLEALPKYYSPKSPKLSDDASATGSGGLTITDVMAAQGMVQSKAPLGFALFLAKVGVQDPQFAIEGLLNYAMALDNPTLNKLSEENRLQIIPYLVNFAFADYSRSAASKARCEHCAGTGFHNVLREVVKHSRSGESVVKEEWVKELCQHCHGKGEVSTACRGCKGKGIVLDEKRTRLHGAPVYKICGRCNGNRFSRLPTTLARLHVQKLVPDLTDYQWYKGYADVIDKLVTKCWQEEAYAEIQLRKVTR

SEQ ID NO: 77 - DNA, 216 bp, Escherichia coli
atgaaatccatggacaaaatttcaacgggcattgcctacggcacctccgcaggtagtgccgggtactggtttttacagttgctcgataaagtcacgccctcacagtgggcggcaataggtgtgctgggtagtctggtatttggcttgctgacgtatctgacaaacctttatttcaagattaaagaagataagcgtaaggctgcgagaggtgaataa

SEQ ID NO: 78 - protein, 71 aa, Escherichia coli
MKSMDKISTGIAYGTSAGSAGYWFLQLLDKVTPSQWAAIGVLGSLVFGLLTYLTNLYFKIKEDKRKAARGE

SEQ ID NO: 79 - DNA, 498 bp, Escherichia coli
atgtcaccatcattacgcaaggctgttgctgctgctattggtggtggggctgttgctatagcgtctgtgctcatcactggtccaagtggtgacgatggtctggaaggtgtcagctacataccatacaaagatatcgttggtgtatggactgtatgtcacggacacaccggaaaagatatcattcccggtaaaacgtataccgaagcagaatgcaaagccctcctgaataaagaccttgctacggtcgccagacaaattaacccgtacatcaaagctgatataccagaaacaacacgcggcgctctttactcgttcgtttacaacgtgggcgctggcaatttcagaacatcgacgcttcttcgcaaaatcaaccagggcgatatcaaaggtgcatgtgatcaactacgtcgctggacatatgctggcggtaagcaatggaaagggctgatgactcgccgtgagattgagcgtgaagtctgtttgtgggggcagcaatga

SEQ ID NO: 80 - protein, 165 aa, Escherichia coli
MSPSLRKAVAAAIGGGAVAIASVLITGPSGDDGLEGVSYIPYKDIVGVWTVCHGHTGKDIIPGKTYTEAECKALLNKDLATVARQINPYIKADIPETTRGALYSFVYNVGAGNFRTSTLLRKINQGDIKGACDQLRRWTYAGGKQWKGLMTRREIEREVCLWGQQ

SEQ ID NO: 81 - DNA, 438 bp, Escherichia coli
atgagcagagtaaccgcgattatttacgctctggttatctgcatcatcgtctgcctgtcatgggctgttaatcattaccgtgataacgcaatcgcctacaaagagcagcgcgataaagccacatccatcatcgctgacatgcagaagcgtcaacgtgatgtagcagaactcgatgccagatatacaaaggagcttgctgatgctaatgcgactatcgaaagtctccgtgctgatgtttctgctggtcgtaagcgcctgcaagtctccgccacctgtgcaaagtcaacgaccggagccagcagcatgggcgatggagaaagcccaagacttacagcagatgctgaactcaattattaccgtctccgaagtggaatagacaggataaccgcgcaggttaactacctgcaggaatacatcaggacgcaatgccttcgatga

SEQ ID NO: 82 - protein, 145 aa, Escherichia coli
MSRVTAIIYALVICIIVCLSWAVNHYRDNAIAYKEQRDKATSIIADMQKRQRDVAELDARYTKELADANATIESLRADVSAGRKRLQVSATCAKSTTGASSMGDGESPRLTADAELNYYRLRSGIDRITAQVNYLQEYIRTQCLR

SEQ ID NO: 83 - DNA, 192 bp, Escherichia coli
atgaagaaacaatatattatcccttatatgttaaaagtaatgaatgaaaaaggaaaagttgctttccagccagcatggttccctgagaacgataatcatgaagaaactttcgattctctttgcgagttataccgtgaaggaaaaatcacaatggaaggaggttattacttcgatctaatttttatcctgtaa

SEQ ID NO: 84 - protein, 63 aa, Escherichia coli
MKKQYIIPYMLKVMNEKGKVAFQPAWFPENDNHEETFDSLCELYREGKITMEGGYYFDLIFIL

SEQ ID NO: 85 - DNA, 495 bp, Escherichia coli
atggatcgagagttaaaaaatctgacgctgaatatcagtcaactggcggcactgtcaggtgtacatcgccagactgctgcggcaaggctgcaaaatctacccgttgcaggggggcatgaaagcaacctcaagctttatcgggtggttgatattgtgtcggcatttctggcattaccaccgccggttgcagaaggcgaaatggacgcgcatgagcgcaaagcctggtatcagtctgaacgtgagcgtcttaagttcgaacaggaaacggcacaactcattccggccagtgatgtcagacgggagtttgccatctgggcaaaagctgtcgtgcaggtgctggagacattaccggatattctggaacgtgactgcggtctgcagcctgccgctgtgagccgtgttcagtccattattgatgatctgcgcgatcagatagccctgcgggtgactgaagcaggtgcggatgatgaggaggaattacagcaggaggagtaa

SEQ ID NO: 86 - protein, 164 aa, Escherichia coli
MDRELKNLTLNISQLAALSGVHRQTAAARLQNLPVAGGHESNLKLYRVVDIVSAFLALPPPVAEGEMDAHERKAWYQSERERLKFEQETAQLIPASDVRREFAIWAKAVVQVLETLPDILERDCGLQPAAVSRVQSIIDDLRDQIALRVTEAGADDEEELQQEE

SEQ ID NO: 87 - DNA, 2103 bp, Escherichia coli
atgctgaatcaggaaaccgcaaaggcagcacgaaccgattcaggttatatccttcgcgcaccgagacgaatgcgggttgctgatgccgttgctcagtatatgcgggtgcccatgggggcagggaactcagtcccgtgggatccgctggtggcaccgtatgttattgagccgatgaactgcctggcctcgcgtgaatacgacgcagtgatatttgttggcccggcacgaaccggcaagactatcggcctgattgacggctgggtgatttacaacgtgatttgcgaccctgcggatatgctgatcattcagatgacggaggaaaaagcccgcgaacactccaaaaaacgactcgccagaacgtttcgcgtcagcccggaagtggtcagtcgcctgagtccgaacaaaaatgacaacaacgtttatgacagaacattccttgctggcaactacctgaaaatcggctggccgtcagtcaatatcatgtcctcatcagattataaatgcgtcgcgctgacggattatgaccgttttccggaagatattgatggcgagggggatgctttctctcttgcctcaaaacgtaccacaacatttatgtccagtggtatgacgctggtggagagttcccccggcagggatgtgaaggatgtgaaatggcgacggacttcaccgcatgaggctccaccaaccactgggatactgtcgctctataaccgtggcgatcgccgtcgctggtactggccctgtccacactgtggtgagtattttcagccctgcggcgatgtggttgctggtttccgtgatattgccgatcccgtgctggcaagtgaggcggcttatattcagtgtccttcctgttcaggacggattatgcctgaacaaaaacgtgagctgaacggacgtggggtctggctgcgggatggtgaatccatcaatgcggatggcagtcgttatggtgatccccgacgctcacgtattgcgtcattctggatggagggtccggcagctgcttaccagacactctcgcaactcgtttacaaactgcttactgcagaacaggaatacgagacaaccggaagtgaagaaacactcaagacggttatcaataccgactggggattaccttatcttccccgcgccagcatggagcaacgaaaaagtgaactgcttgagcagcgggcagagccagttccttcccgcagtgtgccggatggcgttaatttccttgtggcgacagtggatgtgcaggcgggacgtcatcgccgttttgtggttcaggtaacgggctatggcagccgtggcgaacgctggattattgatcgttacaacatcacgcagtcattgcgcggtgacagcgacggggagagccagcgaattgatccggccagttatccggaagactgggatgtcctgctgacggatgtttttcataaaagctggccgctggcctccgatccttctcaacaaatgcgactgatggcaatggcggtggactccggcggtgaagacggggtcactgataatgcctataaattctggcgtcgttgccgtcgtgatggccttggtaaacgtatttacctgtttaagggcgacagcatccggcgcgcaaaactgatcacccgtacattccctgataacaccggacgaacgggccgacgggcgcaggccgcaggtgatgtaccgctctggcttcttcagacggatgccctgaaagaccgggtgaataacgcgttatggcgtgactcgccaggtcccggctatgtgcatttccctgactggctggggagctggttttacgacgaactgacgtatgaagagcggagcagtgacgggaaatggagtaagccgggtcgcggtgccaacgaagcttttgacctgatggtgtatgccgaggctctggtcattctgcatggatacgaaaagatccgctggccggatgcaccggagtgggcgagccgggaaacctggctggagtgtgtcccggacagtaccgaactgtcaccctcaccggaaccggtatccacgcctgttaaaaaacaaaaacggaagaaaacagtaactgacgatgttaacccctggctgacttccggaggatggttatga

SEQ ID NO: 88 - protein, 700 aa, Escherichia coli
MLNQETAKAARTDSGYILRAPRRMRVADAVAQYMRVPMGAGNSVPWDPLVAPYVIEPMNCLASREYDAVIFVGPARTGKTIGLIDGWVIYNVICDPADMLIIQMTEEKAREHSKKRLARTFRVSPEVVSRLSPNKNDNNVYDRTFLAGNYLKIGWPSVNIMSSSDYKCVALTDYDRFPEDIDGEGDAFSLASKRTTTFMSSGMTLVESSPGRDVKDVKWRRTSPHEAPPTTGILSLYNRGDRRRWYWPCPHCGEYFQPCGDVVAGFRDIADPVLASEAAYIQCPSCSGRIMPEQKRELNGRGVWLRDGESINADGSRYGDPRRSRIASFWMEGPAAAYQTLSQLVYKLLTAEQEYETTGSEETLKTVINTDWGLPYLPRASMEQRKSELLEQRAEPVPSRSVPDGVNFLVATVDVQAGRHRRFVVQVTGYGSRGERWIIDRYNITQSLRGDSDGESQRIDPASYPEDWDVLLTDVFHKSWPLASDPSQQMRLMAMAVDSGGEDGVTDNAYKFWRRCRRDGLGKRIYLFKGDSIRRAKLITRTFPDNTGRTGRRAQAAGDVPLWLLQTDALKDRVNNALWRDSPGPGYVHFPDWLGSWFYDELTYEERSSDGKWSKPGRGANEAFDLMVYAEALVILHGYEKIRWPDAPEWASRETWLECVPDSTELSPSPEPVSTPVKKQKRKKTVTDDVNPWLTSGGWL

SEQ ID NO: 89 - DNA, 213 bp, Escherichia coli
atgaaccagaatgatatcgaagccatgattcagcgttatacggaagctgaaatggcggtgctggacggaaaatccgtcacctttaatggtcagcagatgaccatggaaaacttatctgagatccggcagggacggcaggagtgggagcgccgccttgcggctctgattacacgacgacgggggcatcccgggtaccggctggcgaggttctga

SEQ ID NO: 90 - protein, 70 aa, Escherichia coli
MNQNDIEAMIQRYTEAEMAVLDGKSVTFNGQQMTMENLSEIRQGRQEWERRLAALITRRRGHPGYRLARF

SEQ ID NO: 91 - DNA, 1509 bp, Escherichia coli
atggcaattcttgatgatgtgattggcgttttttcaccaggatggaaagcggcaaggctgcgttcccgtgcggtgatccaggcttatgaggccgtaaaaacgacgcggacacacaaagcccggcgggagaaccgaactgccgaccagttaagccagtacggggccgtgtcgttacgtgagcaggcccgttaccttgataacaaccacgatctggttattggtgtatttgacaagctggaagaacgggtggtggggaaaaacgggattattgtcgagccacatccggtattacgcaatggggccattgcccgtgatctggcagcggagatacgcacccgatggagtgaatggtctgtcagtccggaagtcaccgggcagtttacccgtccgatgctggaacgtctgatgctgcgtacctggctgcgcgatggtgaggtgtttgcccagatggtttccgggcgcataaacagcctgacgccttctgccggtgttcatttctggctggaggcgctcgagccggactttattcccatgaccagtgatgagagcaacaggctgaatcagggcgtgtttgttgatgactgggggcgtcccgaaaaatatctggtgtataaaagccgtcccgtatccgggcggcagatggaaaccaaagaagtggatgcagagcgaatgctgcatcttaaatttgttcgccgtctgcaccagatgcgcgggacgtctttgttgtccggtgtgctgatccgcctcagtgccctgaaagagtatgaagattctgagctgactgcagcaaggatcgccgctgctctggggatgtacatccggaaaggcgacgggcagagctatgaaccggatggtaatggcagcaaggagaatgaacgcgagcttaccattcagccaggcattatttacgacgatctgaaacccggcgaagaaatcggaatggtgaagtcggatcgtcccaatcctaaccttgaaacttttcgtaatggtcagttgcgtgccgtggcggcgggcagtcgtctgagtttttccagtacggcacgcaactataacggcacttacagcgcccagcgtcaggaactggttgagtctactgatggctacctgatcctgcaggactggtttattggtgccgtcacccgcccgatgtatcgtgcctggctgaaacaggctgtggcatccggtgttatcaggctaccccgcgatcttgaccgttcttcactgtataccgcggtgtattccggaccagtgatgccgtggattgaccctgttaaggaggctgaggcctggaaaatccagattcgtggtggagcggcgacagaatcagactgggtacgtgctggtggtcgtaatccggatgatgtcaaacgtcggcgcaaggccgaaattgatgaaaaccgcaagctggatctggtatttgataccgatccggccagtgataaaggaggcagcagtgccgcaacgaaacgacaggagccgcagcacaccgacgaccagtccgaagaataa

SEQ ID NO: 92 - protein, 502 aa, Escherichia coli
MAILDDVIGVFSPGWKAARLRSRAVIQAYEAVKTTRTHKARRENRTADQLSQYGAVSLREQARYLDNNHDLVIGVFDKLEERVVGKNGIIVEPHPVLRNGAIARDLAAEIRTRWSEWSVSPEVTGQFTRPMLERLMLRTWLRDGEVFAQMVSGRINSLTPSAGVHFWLEALEPDFIPMTSDESNRLNQGVFVDDWGRPEKYLVYKSRPVSGRQMETKEVDAERMLHLKFVRRLHQMRGTSLLSGVLIRLSALKEYEDSELTAARIAAALGMYIRKGDGQSYEPDGNGSKENERELTIQPGIIYDDLKPGEEIGMVKSDRPNPNLETFRNGQLRAVAAGSRLSFSSTARNYNGTYSAQRQELVESTDGYLILQDWFIGAVTRPMYRAWLKQAVASGVIRLPRDLDRSSLYTAVYSGPVMPWIDPVKEAEAWKIQIRGGAATESDWVRAGGRNPDDVKRRRKAEIDENRKLDLVFDTDPASDKGGSSAATKRQEPQHTDDQSEE

SEQ ID NO: 93 - DNA, 2124 bp, Escherichia coli
atgatgtcaaacgtcggcgcaaggccgaaattgatgaaaaccgcaagctggatctggtatttgataccgatccggccagtgataaaggaggcagcagtgccgcaacgaaacgacaggagccgcagcacaccgacgaccagtccgaagaataattcctggttcaggatgcaggctggtcaccagagtgacgcggatatttatatttatgacgagattggtttctggggtgttacagcgaagcagtttatcagtgatctgaatgcactgggcgatatcacccacattaatctccatatcaattcaccgggtggcgatgtctttgaaggcatcgccatttttaatgcgctgaaaacacatggtgcgtccattaccgtttatgtcgacggtgtggcggcgtcaatggcgtcggtcattgcgatggtgggaaacccggtcattatgccggaaaacaccttcatgatgattcataaaccatttggctttacgggcggtgatgcggaggacatgcgcacctatgccgacctgctcgataaggttgaggcggttctgttacccgcttatgcacagaaaaccgggaaaaccaccgatgaaattgctgccatgctggcggatgagacctggatgtccggtgccgaatgtctggcacatggatttgctgatcaggtgacgccagccgttaaggcaatggcatgtattcagtcaaaacgtacagaggaatttaaaaagatgccggaatccattcgaaacatgattactccgccacgcaacagtgctccacgcgtacaggatgatgaacctgcagcctcccggacgccagtgcaggccgcagcacccgtggtggatgaaaacagtatccgtgcgcaggtactggcagagcaaaaagcgcgtgtaaacggtattaatgatctgtttgccatgtttggcgggcgttatcagacgctgcaggctcagtgtcttgccgatcctgaatgttcgctggagcaggcccgcgaaaagctgttgaacgagatggggcgcgagtccacgccatccaataaaaataccccggctcatatttatgccggtaacggtaattttgtgggggacgggatccgccaggcgctgatggcgcgtgccggatttgaaaaaaccgaacgtgataatgtctacaacgggatgaccctgcgtgaatatgcccgtatgtcactgactgaacggggtattggggtttccagttataacccgatgcagatggtcggtgcggcgttcacacacagtacgtctgacttcggtaatattctgctggatgttgcgaacaaagccattctgcagggctgggaagatgctcctgaaacctatgaacagtggacgcggaaaggtcagttgtctgattttaaaattgcccatcgtgtgggtatggggggcttcagtgctctgcgtcaggtgcgtgaaggggcggaatataaatacgtcaccaccggagataaacaggccactattgcactggcgacctatggcgagctgttcagtatcacccgtcaggccattatcaatgatgatctgaatatgctgaccgatgtcccgatgaaactgggccgtgcggcgaaatccactattgccgatctggtttatgccattctgacgtctaacccgaaaatctccacagataatgtaagtctgttcgataaagcgaaacatgcaaacgtactggagagcgctgcaatggacgtggcatcgctggataaagcccgccagttgatgcgcgttcagaaagagggggagcgtcatctgaatattcgtcctgcgttcgtactggtaccgacggcgatggagtctgttgctaaccaggtcattcgctcctcaagtgtcaagggggctgacattaacgccggtattattaacccggtgaaagattttgcgaccgttattgcagagcctcgtcttgatgataacagccagaccaccttctacctggctgcgtcaaaaggctccgatacgattgaagtggcttatctcaacggtgtggatacgccatatattgatcagatggagggcttcagtgtggatggcgtgacaacgaaagtgcgtattgacgccggtgtcgcgccagttgatcaccgcggtctggtgaaatgtacggcgtaa

SEQ ID NO: 94 - protein, 707 aa, Escherichia coli
MMSNVGARPKLMKTASWIWYLIPIRPVIKEAAVPQRNDRSRSTPTTSPKNNSWFRMQAGHQSDADIYIYDEIGFWGVTAKQFISDLNALGDITHINLHINSPGGDVFEGIAIFNALKTHGASITVYVDGVAASMASVIAMVGNPVIMPENTFMMIHKPFGFTGGDAEDMRTYADLLDKVEAVLLPAYAQKTGKTTDEIAAMLADETWMSGAECLAHGFADQVTPAVKAMACIQSKRTEEFKKMPESIRNMITPPRNSAPRVQDDEPAASRTPVQAAAPVVDENSIRAQVLAEQKARVNGINDLFAMFGGRYQTLQAQCLADPECSLEQAREKLLNEMGRESTPSNKNTPAHIYAGNGNFVGDGIRQALMARAGFEKTERDNVYNGMTLREYARMSLTERGIGVSSYNPMQMVGAAFTHSTSDFGNILLDVANKAILQGWEDAPETYEQWTRKGQLSDFKIAHRVGMGGFSALRQVREGAEYKYVTTGDKQATIALATYGELFSITRQAIINDDLNMLTDVPMKLGRAAKSTIADLVYAILTSNPKISTDNVSLFDKAKHANVLESAAMDVASLDKARQLMRVQKEGERHLNIRPAFVLVPTAMESVANQVIRSSSVKGADINAGIINPVKDFATVIAEPRLDDNSQTTFYLAASKGSDTIEVAYLNGVDTPYIDQMEGFSVDGVTTKVRIDAGVAPVDHRGLVKCTA

SEQ ID NO: 95 - DNA, 324 bp, Escherichia coli
atggcaaagaattttgtagaagaaggaaaaacggtggcgattgttgccagtgcagccatcagcagcggagatctggtgcaggtgggtgatgtttttgcggtggcactgaccgatattccacagggtgaaacaggcgacggcctgaccgaaggtgtgtttatgctgcctaagctgaaaacggatgatatgaaaacgggtaagaaggtttatctgaagtccggaaaagttcagctgactaacagcggctctgatccgctggtcggggttgtctgggcagatgccggaaccagtgcagaagaagtgccggtaaaactcaatgtctga

SEQ ID NO: 96 - protein, 107 aa, Escherichia coli
MAKNFVEEGKTVAIVASAAISSGDLVQVGDVFAVALTDIPQGETGDGLTEGVFMLPKLKTDDMKTGKKVYLKSGKVQLTNSGSDPLVGVVWADAGTSAEEVPVKLNV

SEQ ID NO: 97 - DNA, 276 bp, Escherichia coli
atgtctgatcccttttcccggctggcagcgcgtatggatgcgatcacggtcagaaagatgggaaagacagcctcgattaatgatgtcgatatgactgtgatcccgggagaaatactggcagagctgaatgctctgtccggacctgcggtatctctggtggtgttttcttcgggataccgcccacgtcgcggggatcgcgttgtttatgacggacaacaatggacggtcacacggcatgaacgctttaacggtaagccaatgatctttattgagtaa

SEQ ID NO: 98 - protein, 91 aa, Escherichia coli
MSDPFSRLAARMDAITVRKMGKTASINDVDMTVIPGEILAELNALSGPAVSLVVFSSGYRPRRGDRVVYDGQQWTVTRHERFNGKPMIFIE

SEQ ID NO: 99 - DNA, 540 bp, Escherichia coli
atggtgccacaggccagcgcatgggcgataaaccgtgtggcacagaaagcggtctcggttgccacccggcaggttgccgggaataccgttgcgggagataaccaggtgaaagggatccccctgaaactggtacgtcagcgtgtccgggtgtttaaagccagtccgtcaggaaaaatgacggccaggatccgcgttaaccggggcaatctgcccgccatcaaactgaacacaacacggcggcgtgctggtgaaggactgagagtgggaaaatactttttccggggggcatttgttcagcaactggcgaatggccgctggcatgttctgaggcgtcttcctgaagcgcgttttgcaacagggcatgaccatcagggcaggccaagaaaaaatcgtcttcctgtggaggtagtgaaaatcccgctgtccggaccgctgacacaggcatttgaagatgcccgcgatcgcatcattgctgcggaaatgccgaaacagctggggtatgcactgaaacaacaactgagattatggctgacccgatga

SEQ ID NO: 100 - protein, 179 aa, Escherichia coli
MVPQASAWAINRVAQKAVSVATRQVAGNTVAGDNQVKGIPLKLVRQRVRVFKASPSGKMTARIRVNRGNLPAIKLNTTRRRAGEGLRVGKYFFRGAFVQQLANGRWHVLRRLPEARFATGHDHQGRPRKNRLPVEVVKIPLSGPLTQAFEDARDRIIAAEMPKQLGYALKQQLRLWLTR

SEQ ID NO: 101 - DNA, 414 bp, Escherichia coli
atggctgacccgatgaaccgacatacacaaatccgccaggtcgtactggcacgccttcgggaacagtgtggagacagcgccacgttttgtgacgggcttccggcatttattgatgcgcaggaactgcctgccgtggcggtgtggctgagtgatgctcagtacaccggaaaaatgacggatgaagatgactggcaggctgttctgcatattgccgtcttcatccgggcacaggcaccggattcagagctggatatgtggatggagagcaccatttttcctgccctgaatgatataccggcactttccggactcatcgacaccctgatcccactcggttttaactatcaacgtgataatgagatggccacctgggcgatggcggaaatcacgtaccagatcacgtacacgaattaa

SEQ ID NO: 102 - protein, 137 aa, Escherichia coli
MADPMNRHTQIRQVVLARLREQCGDSATFCDGLPAFIDAQELPAVAVWLSDAQYTGKMTDEDDWQAVLHIAVFIRAQAPDSELDMWMESTIFPALNDIPALSGLIDTLIPLGFNYQRDNEMATWAMAEITYQITYTN

SEQ ID NO: 103 - DNA, 744 bp, Escherichia coli
atgaccacaccaaatccactggcaaagacgaaaggtgcggggacgacgttctggatgtataccggcaacggcgatgcgtttgcgaatcctttgtcggacactgactggctgcgtcttgcgatggtgaaggatctgcaacctggcgaaatgaccgctgatgcagaagatgacacttatctcgatgatgaagatgcagactggaaaacgacaacccaggggcagaaatccgtcggtgatacttcggcgacgctggcctggcgtccgggtgacagcgggcagaaaaaactggttcagttgttcgactccggtgaagtctgcgcgtttcgtatcaaatatcccaacggcactgttgatgttttccgtggctggctgagctcactgggtaaaaccattgcctcaaaagacgtgatgacccgcacagtgaaaatcagcggtgtggggcgtccgtatctggcagaggaaggcactgaaacagtgagcgttaccgggctgacggtggcaccggcatctgccagtgtaaaagtgggagcaaccaccacgctgacctttacagtaaaacctgacggagccagtgacaaagcgatcagtgtgcattcgacagatccacagactgccacggtgaccctgaacgggcttgtggccacggtgaaaggcgtgaagcagggcagtgtcagcattgtgggcatgacttctgacggcgattttgtggcagtggctacggtggctgtcagcgccgcaggttaa

SEQ ID NO: 104 - protein, 247 aa, Escherichia coli
MTTPNPLAKTKGAGTTFWMYTGNGDAFANPLSDTDWLRLAMVKDLQPGEMTADAEDDTYLDDEDADWKTTTQGQKSVGDTSATLAWRPGDSGQKKLVQLFDSGEVCAFRIKYPNGTVDVFRGWLSSLGKTIASKDVMTRTVKISGVGRPYLAEEGTETVSVTGLTVAPASASVKVGATTTLTFTVKPDGASDKAISVHSTDPQTATVTLNGLVATVKGVKQGSVSIVGMTSDGDFVAVATVAVSAAG

SEQ ID NO: 105 - DNA, 387 bp, Escherichia coli
atgtttctgaaacagggcacgtttaattatgaaaagcagtccgtggtgctcagtgagctatccgggctgcagagaattgaatatctggcgtttgttcagcagcgaacggcaaagtttgatgccgaagagggagaactgccggaggctgaacgacagattgcttttctgcggatggggatggatatcaatgcctggctggtttcccgctcactgtggaatgcggaacagtctcaggatgttgagacgctttgcgcatccgttattacaacatggtcgtatgatgccctgggagcgggggcggagatggttctgtcgctgagcggtatgggagccattgagaatgccggggatttggagcatgaggtgctgacgccggaaaagtcctga

SEQ ID NO: 106 - protein, 128 aa, Escherichia coli
MFLKQGTFNYEKQSVVLSELSGLQRIEYLAFVQQRTAKFDAEEGELPEAERQIAFLRMGMDINAWLVSRSLWNAEQSQDVETLCASVITTWSYDALGAGAEMVLSLSGMGAIENAGDLEHEVLTPEKS

SEQ ID NO: 107 - DNA, 330 bp, Escherichia coli
atgcagtttgtcatgcggcttgcccgggagttccggcgggcagactggcggcggatgctgtcggaaatgtcggccactgagcttggtgagtggggcgattatttccggatgcagagcttcagtgatgtgtggatggatgcgcagtttgcctcgctgaaggcattgatcgtgagaatggtgtccggtagcagtgatgctgcggtggctgatttcagccttttaccggaagagaacgggataccggagcgaacggacgaagaactgatgcatcttggggaaggtatttccggaggtgtgcgttatggaccagatagccaacctggtcattga

SEQ ID NO: 108 - protein, 109 aa, Escherichia coli
MQFVMRLAREFRRADWRRMLSEMSATELGEWGDYFRMQSFSDVWMDAQFASLKALIVRMVSGSSDAAVADFSLLPEENGIPERTDEELMHLGEGISGGVRYGPDSQPGH

SEQ ID NO: 109 - DNA, 3066 bp, Escherichia coli
atggaccagatagccaacctggtcattgatttggggattgatgcggcagagtttaaaaatgaaattccccgtatcaaaaaccttctgaatggtgcagccagcgatgcagaacggtcttctgcccgtatgcagcgttttatggagcgtcagactcaggccgcccggcagacaatgcaggcggcttcttcggctgcaacagccgcatccgtccatgcgcagacggtggagaagagcgcacaggctcatgaacgcatggcccgcgaggtggagcaaacccgccagcgtatggaggcactgagccagaaaatgcgcgaggaacaggcgcaggccatggctctggcggaggctcaggataaagcggctgctgcgttttatcgtcagattgacagtgtaaaacaggccagtgcggggctgcaggaattacagcgtattcagcagcagatccgacaggccagaaacagtggcgggattggtcagcaggattatctggcgctgatttctgaggttacggcgaaaacccgtgttcttacacaggctgaggaagaggctacccgacagaaagtggcgtttatccgtcagcttaaagagcaggcaacccgccagaatctttcttcttctgagttgcttcgtgctaaggctgcccagctgggggtaagcagtgctgcagaagtgtatatccgcaaaatggagcaggcaggaaaagcaacgcattcgctgggtctgaaaagtgcagcggcccgtcaggagataggcgttctgataggtgaactggcccgcggcaatttaggtgcgctgaggggatccggaataacgctggctaaccgtgccgggtggatagacacattgatgtcaccgaaaggcatgatgcttggcggggttattggcggtattgccgcggctgtctatggtctgggtaaagcctggtatgacggtcagaaggagggggaagaatttaaccgccagctgtcgctgacggggcattatgccggagtcactgccgggcagctgtggacgctcagtcgtgctatttccgggaatggtatcacgcaacatgctgcagccggtgcgctggctcaggtggtggggagtggtgcatttcgtggaaacgatatcggtatggtggcgagagctgccgcacagatggagcgatcggttggccagtcggtcagcgataccataaatcagtttaagcggctgaaggatgatcctgtaaatgccgcgaaggctctggacaatgagctgcattttcttactgccactcagcttgagcagatacgcgtccttggggaacaggggcggtccagtgatgcggcacggatagccatgtctgcactggcagaggaaaccggtcggcgtactgcggatattgataataacctcaatgcgctgggcagtacgctgaagtatctgtctgatttatggagtcgtttctgggatgcggccatgaatattggtcgtgaagactcgctggatgaacagatttccgctttacaggagaaagtgtcgcgggcgaaaagactcccctggacggcatcatcttctcaggttgagtacgatcagcagcgtcttaacgagcttcaggagaaaaaacgccagaaggatttgcaggatgcaaaagagcaggcagagcggaattatcaggagcaacagaaacgccgtaatgctgaaaatgctgcactgaaccggatgaatgaaacggaagcagcacgacatcagcgtgaaattgcgcgtattaatgccatgcagtacgccgatcaggctgtcagggatgcggcgatacaacgtgaaaatgaacgttacgagaaagccctggcatccggtaagaaaaaaacacgcgaaacccgtaatgatgaggccacccggttattgctgcagtacagtcagcaacaggcacaggtggaaggacagattgctgctgcaagacagtcagcaggcattgccactgacaggatgacagaagcgcataaacagcttctggctctgcagcagcgcatcagcgatctggacgggaaaaaactgacggcagatgaaaagagtgtgctggcccgtaaagatgaactgattcaggcactgacgctgctggatgtaaaacagcaggagcttcagaaacagacggcactcaacgatctgaagaaaaaaacaattcagctgaccagtcaactggctgaagaagagcgcgctcagcgccagcaacatgacctggatatcgccacggtgggtatgggtgatcagcagcggcagcgatatcaggtacaactgagtcttcgccagaaataccagcaacagctggagcagttgaggcgggatagtgagcagaaagggacatataacacggatgactacagaaaggctgagcaggcgctgacggagagcctgaaccgacaactgaatgagaatcgccgttactggcaacagcttgaagttgtgcagggtaactggaaaaacggagtcctgcgtgcatttcaggattttaccgtggatgcagataatacggcaggaacagcagaacaggtgttctcgtcagccttcagcaacatgggaaatggcctggcaacttttgtcactaccggcaaactcaacttcaaatccttcacctcttcggtgctgtcagatatggcgaaaatcctggcgcaggcaaccatgatgaaatcgataaaagggattggcagtgtactgggatttgatctcagcagcctttccctgaatgccaatggggggatttatcagtctgctgatttgagtcgctacagtggcacggtggttaaccgtccgacgttttttgcttttgcaaaaggcgcgggtgtgatgggggaagctggacctgaagccattctgccactgcgtcgtggtgctgacggtaagctgggggttgtggcggatattggtggttcaggtatggcgatgtttgccccgcagtacaacatcgagatcaataacgatggcacgaacgggcagataggtccggctgccctgaaggtggtttatgaccttgggaaaaaagcggcagcggactttatgcaacagcaggcccgtgatggtggtcggttaagtggagcatatcggtaa

SEQ ID NO: 110 - protein, 1021 aa, Escherichia coli
MDQIANLVIDLGIDAAEFKNEIPRIKNLLNGAASDAERSSARMQRFMERQTQAARQTMQAASSAATAASVHAQTVEKSAQAHERMAREVEQTRQRMEALSQKMREEQAQAMALAEAQDKAAAAFYRQIDSVKQASAGLQELQRIQQQIRQARNSGGIGQQDYLALISEVTAKTRVLTQAEEEATRQKVAFIRQLKEQATRQNLSSSELLRAKAAQLGVSSAAEVYIRKMEQAGKATHSLGLKSAAARQEIGVLIGELARGNLGALRGSGITLANRAGWIDTLMSPKGMMLGGVIGGIAAAVYGLGKAWYDGQKEGEEFNRQLSLTGHYAGVTAGQLWTLSRAISGNGITQHAAAGALAQVVGSGAFRGNDIGMVARAAAQMERSVGQSVSDTINQFKRLKDDPVNAAKALDNELHFLTATQLEQIRVLGEQGRSSDAARIAMSALAEETGRRTADIDNNLNALGSTLKYLSDLWSRFWDAAMNIGREDSLDEQISALQEKVSRAKRLPWTASSSQVEYDQQRLNELQEKKRQKDLQDAKEQAERNYQEQQKRRNAENAALNRMNETEAARHQREIARINAMQYADQAVRDAAIQRENERYEKALASGKKKTRETRNDEATRLLLQYSQQQAQVEGQIAAARQSAGIATDRMTEAHKQLLALQQRISDLDGKKLTADEKSVLARKDELIQALTLLDVKQQELQKQTALNDLKKKTIQLTSQLAEEERAQRQQHDLDIATVGMGDQQRQRYQVQLSLRQKYQQQLEQLRRDSEQKGTYNTDDYRKAEQALTESLNRQLNENRRYWQQLEVVQGNWKNGVLRAFQDFTVDADNTAGTAEQVFSSAFSNMGNGLATFVTTGKLNFKSFTSSVLSDMAKILAQATMMKSIKGIGSVLGFDLSSLSLNANGGIYQSADLSRYSGTVVNRPTFFAFAKGAGVMGEAGPEAILPLRRGADGKLGVVADIGGSGMAMFAPQYNIEINNDGTNGQIGPAALKVVYDLGKKAAADFMQQQARDGGRLSGAYR

SEQ ID NO: 111 - DNA, 330 bp, Escherichia coli
atggagacgtttcactggaaagtgcgcccggatatgaatgtggtatcagagccgaaagtggtgacagtgaagctgggcgatggttatgaacagcgtcgtgcggcgggactgaataaccagttgtcgacttacagcgtgacgatacgtgttcgtaaatgtgaacacccatctttaaaagcctttctggaacggcacggtggcgttcgcgcatttcagtggacgccaccttatgactggaagccgatcagggtggtttgtcgtaaatggtcggcaagcgtgggggcgctgtgggtaaccataacggcagattttgaacaggtcgtggcatag

SEQ ID NO: 112 - protein, 109 aa, Escherichia coli
METFHWKVRPDMNVVSEPKVVTVKLGDGYEQRRAAGLNNQLSTYSVTIRVRKCEHPSLKAFLERHGGVRAFQWTPPYDWKPIRVVCRKWSASVGALWVTITADFEQVVA

SEQ ID NO: 113 - DNA, 699 bp, Escherichia coli
atgcaggatattccacaggaaacacatcatgagacgacacgcctcactcagtcagctcaggtggtgctctgggaaatcgatctgacagaggtcggtggtgaacgttattttttctgtaatgagcagaacgaaaaaggtgagccggtcacctggcaggggcggcagtatcaggcataccccattcaggggacaggatttgaactgaacggcaagggcagtgctgcccgtccgacactgacggtttctaacctgcacggtatggtcaccggtatggcggaagatctgcagagtctggtcggcggaacggtggtccggcgtaaggtttacgcccgttttctggatgcggtgaacttcgtcaacggaaacagtgatgccgacccggagcaggaggtgatcagcagctggcgcatcgagcagtgcagtgaactgagtgcggtcagtgcttcttttgtactgtccacgccgacggaaacggatggcgctgtttttccggggcgtatcatgctggccaacacctgcacctggacctatcgcggtgatgagtgcggttataacggtccggctgtcgcggatgaatatgaccagccgacgtccgatatcacgaaggataaatgcagcaaatgcctgagcggctgtaagtttcgcaataacgtcggcaactttggcggttacctttccattaacaaactttcgcagtaa

SEQ ID NO: 114 - protein, 232 aa, Escherichia coli
MQDIPQETHHETTRLTQSAQVVLWEIDLTEVGGERYFFCNEQNEKGEPVTWQGRQYQAYPIQGTGFELNGKGSAARPTLTVSNLHGMVTGMAEDLQSLVGGTVVRRKVYARFLDAVNFVNGNSDADPEQEVISSWRIEQCSELSAVSASFVLSTPTETDGAVFPGRIMLANTCTWTYRGDECGYNGPAVADEYDQPTSDITKDKCSKCLSGCKFRNNVGNFGGYLSINKLSQ

SEQ ID NO: 115 - DNA, 405 bp, Escherichia coli
atgacagagacagaatcagcgattctggcgcacgcccggcgatgtgcgccagtggagtcgtgcggcttcgtggtgagaacgccggagggagaaagatattttccctgcgtgaatatctccggtgagccggaggcgtatttccggatggctccggaggactggctgcgggcagaaatgcagggtgagattgtggcgctggtccacagtcaccccggtggtctgccctggctgagtgaggccgatcggcggctgcaggtgcagagtgatttgccgtggtggctggtctgccgcggggcgattcacaagttccgctgtgtgccacatcttaccgggcggcgctttgagcacggggtgacgggactgttacacgctgttccgggatgcataccatctggcgggaattga

SEQ ID NO: 116 - protein, 134 aa, Escherichia coli
MTETESAILAHARRCAPVESCGFVVRTPEGERYFPCVNISGEPEAYFRMAPEDWLRAEMQGEIVALVHSHPGGLPWLSEADRRLQVQSDLPWWLVCRGAIHKFRCVPHLTGRRFEHGVTGLLHAVPGCIPSGGN

SEQ ID NO: 117 - DNA, 339 bp, Escherichia coli
atgccggattttcatcgcggagatgactggtggcgtaacggccagaatctctatcttgacaatatggaggctactggtttttaccgtgtcgcactgacagaggcgcagccgggcgatgtgctgctgtgctgttttggttcatcggtgccgaatcacgccgccatttactgtggtgacggtgagctgctgcaccatattcctgaacaactgagtaaacgagagaggtataccgacaaatggcagcgacgcacacactccctctggcgtcaccgggcatggcacgcatctgcctttacggggatttacaacgatttggccgccgcatcgaccttcgtgtga

SEQ ID NO: 118 - protein, 112 aa, Escherichia coli
MPDFHRGDDWWRNGQNLYLDNMEATGFYRVALTEAQPGDVLLCCFGSSVPNHAAIYCGDGELLHHIPEQLSKRERYTDKWQRRTHSLWRHRAWHASAFTGIYNDLAAASTFV

SEQ ID NO: 119 - DNA, 537 bp, Escherichia coli
gtgaaaacgggggctgaagccatccgggcgctggccacgcagcttccgtcgtttcgccagaaactgaatgagggctggtatcaggtgcgcattgccgggcgtgatgcaggcgaaaatgaattatctgcccgtcttaatgaaccgctggcaaatggtgccgtgattcacatcgtgccgcgtctggcgggagctaaaagtggcggtgtgtttcaggtggtgctgggggcggcgctgattgcggtggcatggtggaaccctgtgggctggctgggtgctgcggctgtatcgggcatgtatgcggcaggggccagtatgattctgggtggtgtggcccagatgctggcaccgaaagccaggacgcccacggcagccagtacagataacggcaacagaacacctatttctcctcactggataacatggttgctcagggcaatgttctgcctgttctgtacggtgaaatgcgtgtggggtcgcgggtggtttctcaggagatcagcacggcagacgaaggtgacggtggtcaggttgtggtga

SEQ ID NO: 120 - protein, 178 aa, Escherichia coli
MKTGAEAIRALATQLPSFRQKLNEGWYQVRIAGRDAGENELSARLNEPLANGAVIHIVPRLAGAKSGGVFQVVLGAALIAVAWWNPVGWLGAAAVSGMYAAGASMILGGVAQMLAPKARTPTAASTDNGNRTPISPHWITWLLRAMFCLFCTVKCVWGRGWFLRRSARQTKVTVVRLW

SEQ ID NO: 121 - DNA, 129 bp, Escherichia coli
atggttgctcagggcaatgttctgcctgttctgtacggtgaaatgcgtgtggggtcgcgggtggtttctcaggagatcagcacggcagacgaaggtgacggtggtcaggttgtggtgattggtcgctga

SEQ ID NO: 122 - protein, 42 aa, Escherichia coli
MVAQGNVLPVLYGEMRVGSRVVSQEISTADEGDGGQVVVIGR

SEQ ID NO: 123 - DNA, 3396 bp, Escherichia coli
atgggtaaaggcagcagtaaggggcataccccgcgcgaagcgaaggacaacctgaagtccacgcagttgctgagtgtgatcgatgccatcagcgaagggccggttgaaggtccggtggatgggttaaaaagcgtgctgctgaacagtacgccggtgctggacagtgaggggaataccaatatctccggtgtcacggtggtgttccgggcaggtgagcaggagcagacaccgccggaggggtttgaatcctccggttccgagacggtgctgggtacggaagtgaaatatgacacgccgatcacccgcaccattacgtcggcaaacatcgaccgactgcgctttaccttcggtgtgcaggcactggtggaaaccacttcaaagggtgaccggaatccgtcggaagtccgcctgctggttcagatacagcgtaacggtggctgggtgacggaaaaagacatcaccattaagggcaaaaccacctcgcagtatctggcctcggtggtggtggataacctgccgccgcgcccgtttaatatccggatgcgcaggatgacgccggacagcaccacagaccagctgcagaacaaaacgctctggtcgtcatacaccgaaatcatcgatgtgaaacagtgctacccgaacacggcactggtcggcgtgcacgtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacattcgtgcaggaccgaccgtcggataaggtgtggacctataaccgcagtaatgtggtgatgccggatgatggcgcgccgttccgctacagcttcagcgccctgaargaccgccataatgccgttgaggtgaactggattgacccggayaacggctgggagacggcgacagagcttgtggaggacacgcaggccattgcccgttacggtcgtaacgtcacgaagatggatgcctttggctgtaccagycgggggcaggcacaccgcgccgggctgtggctgattaaaacrgarctgctggaaacgcagaccgtggacttcagcgtgggtgcagaagggcttcgccatgtaccgggcgatgtcattgaaatctgygatgatgactatgcgggkatcagcaycggcgggcgcgtgctggcggtgaacarccagacgcggacactgacgctcgaccgtgaaatcacgctgccatcctccggcaccacgctgataagcctggttgacggacaggggaatccggtcagcgtggaggtccagtccgtcaccgacggcgtgaaggtaaaagtgagccgkgttcctgayggcgttgccgartacagcgtgtgggggctgaagctgccgacgctgcgccagcgcctgttccgctgygtgagtatccgtgagaatgacgacggcacgtatgccatcaccgcygtgcagcatgtrccggaraaagaggccatcgtggataacggggcgcactttgacggcgaccagagcggcacggtgaatggtgtcacgccgccagcrgtgcagcacctgaccgcmgaagtcaccgcagacagcggggaataycaggtgctggcgcgctgggayacgccgaaggtggtgaagggtgtgagctttatgcttcgcctgaccgtggcagcggatgacggcagtgagcggctggtcagcacggcccggacgacggaaaccacataccgattcacgcaactggcgctgggaaactacaggctgacagtccgggcggtaaatgcgtggggacagcagggcgatccggcgtcggtatcgttccggattgccgcaccgtcagcgccgtcgcggattgagctgacgccgggctattttcagatcaccgccacgccgcatcttgccgtttatgatccgacggtacagtttgagttctggttctcggaaaagcggattgcggatatcaggcaggttgaaaccacagcccgctatcttggcacggcgctgtactggatagctgccagtatcaatatcaggccgggccatgattattatttttacgttcgcagtgtgaacaccgttggcaaatcggcattcgtggaggctgtcggtcgggcgagcgatgatgcggaaggttacctggattttttcaaaggccagataactgaatcccatctcggcaaggagctgctggaaaaagtcgagctgacggaggataacgccagcaaactggaggagttttcgaaagagtggaaagacgccaacgataaatggaatgccatgtggggcgtcaaaattgagcagaccgaagacggcaggcattatgtcgcggggcttggcctcagcatggaggatacggaggaaggcaaactgagccagttcctggttgccgctaaccgtatcgcgtttattgatccgtctaatggcaacacaagaccaatgtttgttggtcagggcgatcagatattcatgaacgacgtgttcctgaaacgcctgacggctccgaccattaccagcggcggtaatcctccggcattttccctgacaccggacgggcggctgacggcgaaaaatgccgatatcagcggtagcgtgaatgcgaactccgggacgctcaacaacgtcacgattaacgagaactgtcgggttctgggaaaactgtccgcgaaccagattgaaggcgatctcgttaaaacagtgggcaaagctttcccccgggactcccgtgcaccggagcggtggccatcagggaccattaccgtcagggtttatgacgatcagtcgtttgaccggcaaattgttattccagcggtggctttctgcggtgccagacatgagcgggagaatagcgatacttattcgtcatgccgcctgatagtgaagaaaaacggggctgaaatttataaccgaacggctctggataatactctgatttacacgggtgttattgatatgcctgcaggcagtggcgtaatgacactggagttttctgtatcagcatggtgggtaaatggttggtatcccacagcaagtatcagcgatttgctggttgttgtgatgaagaaagccactgcaggcatcacgattagctga

SEQ ID NO: 124 - protein, 1131 aa, Escherichia coli
  Xaa 491, 500: Xaa is any amino acid
MGKGSSKGHTPREAKDNLKSTQLLSVIDAISEGPVEGPVDGLKSVLLNSTPVLDSEGNTNISGVTVVFRAGEQEQTPPEGFESSGSETVLGTEVKYDTPITRTITSANIDRLRFTFGVQALVETTSKGDRNPSEVRLLVQIQRNGGWVTEKDITIKGKTTSQYLASVVVDNLPPRPFNIRMRRMTPDSTTDQLQNKTLWSSYTEIIDVKQCYPNTALVGVHVDSEQFGSQQVSRNYHLRGRILQVPSNYNPQTRQYSGIWDGTFKPAYSNNMAWCLWDMLTHPRYGMGKRLGAADVDKWALYVIGQNCDQSVPDGFGGTEPRITCNAWLTTQRKAWDVLSDFCSAMRCMPVWNGQTLTFVQDRPSDKVWTYNRSNVVMPDDGAPFRYSFSALKDRHNAVEVNWIDPDNGWETATELVEDTQAIARYGRNVTKMDAFGCTSRGQAHRAGLWLIKTELLETQTVDFSVGAEGLRHVPGDVIEICDDDYAGISXGGRVLAVNXQTRTLTLDREITLPSSGTTLISLVDGQGNPVSVEVQSVTDGVKVKVSRVPDGVAEYSVWGLKLPTLRQRLFRCVSIRENDDGTYAITAVQHVPEKEAIVDNGAHFDGDQSGTVNGVTPPAVQHLTAEVTADSGEYQVLARWDTPKVVKGVSFMLRLTVAADDGSERLVSTARTTETTYRFTQLALGNYRLTVRAVNAWGQQGDPASVSFRIAAPSAPSRIELTPGYFQITATPHLAVYDPTVQFEFWFSEKRIADIRQVETTARYLGTALYWIAASINIRPGHDYYFYVRSVNTVGKSAFVEAVGRASDDAEGYLDFFKGQITESHLGKELLEKVELTEDNASKLEEFSKEWKDANDKWNAMWGVKIEQTEDGRHYVAGLGLSMEDTEEGKLSQFLVAANRIAFIDPSNGNTRPMFVGQGDQIFMNDVFLKRLTAPTITSGGNPPAFSLTPDGRLTAKNADISGSVNANSGTLNNVTINENCRVLGKLSANQIEGDLVKTVGKAFPRDSRAPERWPSGTITVRVYDDQSFDRQIVIPAVAFCGARHERENSDTYSSCRLIVKKNGAEIYNRTALDNTLIYTGVIDMPAGSGVMTLEFSVSAWWVNGWYPTASISDLLVVVMKKATAGITIS

SEQ ID NO: 125 - DNA, 600 bp, Escherichia coli
atgcgtaaattatgtgctgttattctgtccgcagtagtctggctggttgccgctggtacgccagcgagcgcagcagagcatcagtccacactaagcgccgggtatcttcagacccatactgatatgccaggcagcgatgacctgaagggcattaacgtgaaataccgttatgaatttacggacacgctggggctggtgacgtcattcagctatgcaggagacaagaatcgccagcttacccgttacagcgatacccgctggcatgaagattccgttcgtaaccgctggttcagcgtgatggcggggccgtctgtgcgcgtgaatgaatggttcagcgcgtatgcgatcgcgggtgtggcttacagccgtgtgtcgactttttccggggattatcttcaggtgaccgacaacaagggggatacgcacgatgtgctgaccggaagtgatgacggtcgccacagcaacacgtctctggcgtggggggctggcgtgcagtttaacccgaccgaattcgtggccattgatattgcttatgaaggttccggcagtggcgactggcgcactgacggtttcatcgtgggtgtcggttataaattctga

SEQ ID NO: 126 - protein, 199 aa, Escherichia coli
MRKLCAVILSAVVWLVAAGTPASAAEHQSTLSAGYLQTHTDMPGSDDLKGINVKYRYEFTDTLGLVTSFSYAGDKNRQLTRYSDTRWHEDSVRNRWFSVMAGPSVRVNEWFSAYAIAGVAYSRVSTFSGDYLQVTDNKGDTHDVLTGSDDGRHSNTSLAWGAGVQFNPTEFVAIDIAYEGSGSGDWRTDGFIVGVGYKF

SEQ ID NO: 127 - DNA, 252 bp, Escherichia coli
ttggcattcgtttcgcttgttttcgctgccgtctggctggactttgcgttggtttcgctcgtctttgcggctgtctcactgtttttcgcgttggtttctgattttttggctgctgtcgcggagtttgccgatgcagtctgtgaggtcgctgccgcctgtgcgctgttagctgcattcgtttctgaggttttcgccgcgttcttcgatgatgccgctgcagtttcggatttctttgccgccgctgcgctctga

SEQ ID NO: 128 - protein, 83 aa, Escherichia coli
MAFVSLVFAAVWLDFALVSLVFAAVSLFFALVSDFLAAVAEFADAVCEVAAACALLAAFVSEVFAAFFDDAAAVSDFFAAAAL

SEQ ID NO: 129 - DNA, 162 bp, Escherichia coli
ttggcattcgtttcgctggtcttcgctgccgtctggctggactttgcgttagtttcgctcgtcttcgcggctttctggctgttagccgcagcagttgctgatccagctgctgaagtcgcagaaccagctgcagcactctcgctttcggctgctgcatcctga

SEQ ID NO: 130 - protein, 53 aa, Escherichia coli
MAFVSLVFAAVWLDFALVSLVFAAFWLLAAAVADPAAEVAEPAAALSLSAAAS

SEQ ID NO: 131 - DNA, 2358 bp, Escherichia coli
atggcagcagtaaaaatctcaggtgtgctgaaagatggtgcgggtaaaccaatacagaactgcactattcaactgaaggcaaagcgtaacagcaccacggtactggtgaacacggtggcctctgaaaatccggatgaagccgggcgttacagcatggatgttgagtatggccagtacagcgtcatcctgctggttgaaggttttccgccttcacatgccgggaccattaccgtctatgaaggctccagaccaggtacgctgaatgattttctcggtgccatgacggaagatgatgtcatgccggaggcattgcgtcgttttgaggcaatggtggaagaagcggcacgcaacgccgaagccgcctctcagagcgcagcggcggcaaagaaatccgaaactgcagcggcatcatcgaagaacgcggcgaaaacctcagaaacgaatgcagctaacagcgcacaggcggcagcgacctcacagactgcatcggcaaactccgcgacagcagccaaaaaatcagaaaccaacgcgaaaaacagtgagacagccgcaaagacgagcgaaaccaacgcaaagtccagccagacggcagcgaaaacaagcgaaacgaatgccaaagccagtgaaactgcggcgaaaagcagtcaggatgcagcagccgaaagcgagagtgctgcagctggttctgcgacttcagcagctggatcagcaactgctgcggctaacagccagaaagccgcgaagacgagcgaaactaacgcaaagtccagccagacggcagcgaagaccagcgaaacgaatgccaaagccagcgaaactgcggcgaaaaacagtcaggatgcagcagcccaaagcgagagtgccgcagctggttctgcaacagcggcagctaatagccaaaaagctgcaaaaaccagtgaaactaacgcaaagacgagtgaaacaaaagcagcagccagcgagacagaagcaacgtcagccgcaacaagagcagagaatgcagcccggattgcagaagatgccgctgatcctgcttctgtccctccgcttcctgatatctggctacctttgaatgattctctggaagcgataacagggtatgccccgggctataaaacaataaccatcggcagtgatgaaataacaatgcctgttaatggcatatgccaatttagccgggcttcatctgcaacgtatattgataagtccgggcatattaccgtggcaggcaataacgttcctcgttttgaaaaatatggtttgctgatagagaatcagcgaacaaacatgttcgtaaatagttttaatcctgatgcgtggaataaaagcggtggtatatctgtaacatcatcaacagatgaatttgagtttaaatatggacgtttcacagtaggaagtgagatagcaggaacgacaacagggagaaatatatgcacagttgctggtaataaaggcatagatgtgactggcgatgatcagtacagtaaaggtccgtatgttaccgcgtcgttcagggtaagaagtgatctcaatgttcgcgcacgtatccgttttgaacggtataactcggaaggatacactttcctttgtgacgcctatttgtcattacagactcatgaactacaaattacgggtggtaatgcccagctattaacagcaaactttgaaatcgaccctggtagtggatggatatattttcaggcaacactgaaatgtctgccagaatggggaatggttggtacgcagctgcaaattgcagccgacagagcagtgggggcttttgcaacaggtgactggatagaagtaaccaccccgcaattcgagtatggtgcttgtgcaacttccttcatcataacgacaacagagccagcgactcgtgcatcagatttatgtaaatttccgctgatgaaaaatatgtataccatgccttttacgttcatggcggaagtccataaaaactggtttatttctcataatgcagcaccgcgtgtcattgattcagaaaatcaccagtccggaggcccatttattatggggtttggttcttctggaactatcagtcaggacggttattcgtattgcgatataggcggggctaaccgacgtgtatatgaatcatgcggagtaagggatctcgttatgggattcagggttaaggctgacggcatgacatgctcatttgcaaataagcatataagcactgaaacaaaaacagtatggaaatatattcgtgaagcagccgtgattcgtatcggggggcaaacgacgacaggattacgacaccttaatggtcatataaaaaacctccgtttctggaacagagcattgtcagatacgcagcttaaggaatacgtataa

SEQ ID NO: 132 - protein, 785 aa, Escherichia coli
MAAVKISGVLKDGAGKPIQNCTIQLKAKRNSTTVLVNTVASENPDEAGRYSMDVEYGQYSVILLVEGFPPSHAGTITVYEGSRPGTLNDFLGAMTEDDVMPEALRRFEAMVEEAARNAEAASQSAAAAKKSETAAASSKNAAKTSETNAANSAQAAATSQTASANSATAAKKSETNAKNSETAAKTSETNAKSSQTAAKTSETNAKASETAAKSSQDAAAESESAAAGSATSAAGSATAAANSQKAAKTSETNAKSSQTAAKTSETNAKASETAAKNSQDAAAQSESAAAGSATAAANSQKAAKTSETNAKTSETKAAASETEATSAATRAENAARIAEDAADPASVPPLPDIWLPLNDSLEAITGYAPGYKTITIGSDEITMPVNGICQFSRASSATYIDKSGHITVAGNNVPRFEKYGLLIENQRTNMFVNSFNPDAWNKSGGISVTSSTDEFEFKYGRFTVGSEIAGTTTGRNICTVAGNKGIDVTGDDQYSKGPYVTASFRVRSDLNVRARIRFERYNSEGYTFLCDAYLSLQTHELQITGGNAQLLTANFEIDPGSGWIYFQATLKCLPEWGMVGTQLQIAADRAVGAFATGDWIEVTTPQFEYGACATSFIITTTEPATRASDLCKFPLMKNMYTMPFTFMAEVHKNWFISHNAAPRVIDSENHQSGGPFIMGFGSSGTISQDGYSYCDIGGANRRVYESCGVRDLVMGFRVKADGMTCSFANKHISTETKTVWKYIREAAVIRIGGQTTTGLRHLNGHIKNLRFWNRALSDTQLKEYV

SEQ ID NO: 133 - DNA, 1041 bp, Escherichia coli
atggttacaaaaacagtaattcctgatgacatcaaaacgctaaaatcggatgttagtaaattaaaaaccgatcaaggaaactacgcaacaaaatcttatgtagacaataaaacaacatggaatggttattgcaatgtaatctatgatcaaaaaacattgccaacaactggaactatattcagcggtaagctgcatttgtcaaataagactggtgaaacggaaaacgcttatagtgacatatataccagaaaaaatattgatggtactaaagatacaatgacgaggatcgtcacacataacgggaaaaaaggtatcttttgggactttagtgatctttacggaggaactttaatttttccaggcagtgatggttaccttaagatggggaactgtctcatgtcgtatggtgtgcggggaagtaacgcgcttattaagtttgataatacagactcattgcagatcaaatatgctaatcacgggtcgaccatgacactaaacacgcaaggtacggcgtattctggtgtgtcgacgttattatggggaaattccagtcgtccagttgtttatgaaattagggatgatggcgggctttttttgttttatgcacaaaggaacccagataaaacctatcagcttgagataaacgggccatgcaaggctacatcattcgaccaggtgtcggacagagatcttaaagaaaacattcaggttattgataatgccactgagcgcatcagattaatgaatgggtatacttaccgtctcaagtctaatggtatgccttatgctggcgttattgcgcaagaggcacttaatgcaatccctgaatcagttggtagcacaataaagtacaagagcggggacaatgggtctgatggagaagagggagaaagatactataccgtcgattactcaggcgtaacgggtttgcttgttcaggtagccagagagtcagacgacaggataacagcactggaagaagaaaacgcagaattaagacaaagattatctgcaattgaggcggcgcttgcgtctaaataa

SEQ ID NO: 134 - protein, 346 aa, Escherichia coli
MVTKTVIPDDIKTLKSDVSKLKTDQGNYATKSYVDNKTTWNGYCNVIYDQKTLPTTGTIFSGKLHLSNKTGETENAYSDIYTRKNIDGTKDTMTRIVTHNGKKGIFWDFSDLYGGTLIFPGSDGYLKMGNCLMSYGVRGSNALIKFDNTDSLQIKYANHGSTMTLNTQGTAYSGVSTLLWGNSSRPVVYEIRDDGGLFLFYAQRNPDKTYQLEINGPCKATSFDQVSDRDLKENIQVIDNATERIRLMNGYTYRLKSNGMPYAGVIAQEALNAIPESVGSTIKYKSGDNGSDGEEGERYYTVDYSGVTGLLVQVARESDDRITALEEENAELRQRLSAIEAALASK

SEQ ID NO: 135 - DNA, 294 bp, Escherichia coli
atgaaaatggatataacacctttccttcatgcgctttgtgctgtggctgcgcagctactgattggtctttttaccgggaactgggcttacggggcgatagccggttgtacgttcttcattgcgcgtgaacacacccaggcagaatatcgctggattgaaatgttcgggcatggcaagcgaatgaatatgccgtggtggggcggttttgatccgcgcgcgtgggatgtggcaagcctgatggattttgctgtgccggtggtggcgtgtctgctgatctggctgttgatccgttaa

SEQ ID NO: 136 - protein, 97 aa, Escherichia coli
MKMDITPFLHALCAVAAQLLIGLFTGNWAYGAIAGCTFFIAREHTQAEYRWIEMFGHGKRMNMPWWGGFDPRAWDVASLMDFAVPVVACLLIWLLIR

SEQ ID NO: 137 - DNA, 1248 bp, Escherichia coli
ttgacaataaaaaatgagatcgctttcatttttgaaaaggttaactctggcaattacaaatttacagcatataaagaaaaattaatatctaaaggcgctaactctacacccagacagatttccataccaactgctagggacagaattactcttagagctctctgtgaatgccttacggaaatatatcctaactccagattaaaactaccacatacagtaattgactcattgaaagaagcattaaacagcagtctttatgctgaatatgcaaaaatagatcttaaaagtttctatccttcaattgaacataaattgataattaatgcaataaaaaataaaattagaaaaaaagaaattagacagttaataacatcatcattaatcgtgcctactgtaagtggaacaacaggaagcaaaggtatcccgaataataccagaggagtacctcagggattagcgatatcaaacattttagctgaaatatcactatctaattttgatgatgaaatcaataaaatgcatgacatatggtacatgcgatacgttgatgacattcttattttaacaccaaaatatcaagcaacaaaaatagcttctcatatcattgataagcttcaatcattaaatttaaacccacatccattaaatgaagagaactcaaaatccaaagtaggcagcttggatgaaagttttaactttttgggataccacatagaaaatcgagaattattgataaaacatgagagcattcttagatttgagtcatctttagcaaggatttttactgcatacaggcacgctctactacaagctaaaagtaagcgtgataaagaacgagctgttgcatattgtcagtggaaactaaatctcagaattacgggatgtgtgtttgaaggtaaacgattgggatgggtatcgtacttctcacaaataacctcaacagctcaacttcgctctgttaatcatactatcaataatcttatccgccgattcggcctttcatcagaaataaaaccaaagtctttaattaaaactttctatgaactccgcagaggtagagcggagacttttaaatacatacctaactttgataatttacatatatctcagaaacgagaacttgtttctatgtggataggtaaagagaaggaaaaaaaacttagcaatagtgaaatagagaggaagtttaaatttaaaattgcgaaatcagtaaaagagcttgaagaggatatctcaggaatatcatag

SEQ ID NO: 138 - protein, 415 aa, Escherichia coli
MTIKNEIAFIFEKVNSGNYKFTAYKEKLISKGANSTPRQISIPTARDRITLRALCECLTEIYPNSRLKLPHTVIDSLKEALNSSLYAEYAKIDLKSFYPSIEHKLIINAIKNKIRKKEIRQLITSSLIVPTVSGTTGSKGIPNNTRGVPQGLAISNILAEISLSNFDDEINKMHDIWYMRYVDDILILTPKYQATKIASHIIDKLQSLNLNPHPLNEENSKSKVGSLDESFNFLGYHIENRELLIKHESILRFESSLARIFTAYRHALLQAKSKRDKERAVAYCQWKLNLRITGCVFEGKRLGWVSYFSQITSTAQLRSVNHTINNLIRRFGLSSEIKPKSLIKTFYELRRGRAETFKYIPNFDNLHISQKRELVSMWIGKEKEKKLSNSEIERKFKFKIAKSVKELEEDISGIS

SEQ ID NO: 139 - DNA, 249 bp, Escherichia coli
atgcgtattgagatctgcatagctaaagagaaaatgactaaaatgccaagcggtgctgtggatgcgttaaaggaagaattaactcgacgcatcagtaagcgttatgacgatgtagaggtgatcgtaaaagccaccagcaacgatggcctttctgttacgcgcaccgccgataaagattcagctaaaacttttgttcaggaaactctgaaagatacctgggagtctgctgacgagtggtttgttcattaa

SEQ ID NO: 140 - protein, 82 aa, Escherichia coli
MRIEICIAKEKMTKMPSGAVDALKEELTRRISKRYDDVEVIVKATSNDGLSVTRTADKDSAKTFVQETLKDTWESADEWFVH

SEQ ID NO: 141 - DNA, 1587 bp, Escherichia coli
atgacaagccttttggccgcagaggtagcgaaaagaagaacctttgcaattatttctcacccggacgccggtaagactaccatcaccgagaaggtgctgctgttcggacaggccattcagaccgccggtacagtaaaaggccgtggctctaaccagcacgctaagtcggactggatggagatggaaaagcagcgtgggatctccatcactacgtctgtgatgcagtttccgtatcacgactgcctggttaacttgctcgataccccggggcacgaagacttctcggaagatacctatcgtaccctgacggcggtggactgctgcctgatggttatcgacgccgcaaaaggtgtagaagatcgtacccgtaagctgatggaagttacccgtctgcgcgatacgccgatcctcacctttatgaacaaacttgaccgtgatatccgcgacccgatggaactgctcgatgaagttgagaacgagctgaaaatcggctgcgcaccgatcacctggccgattggctgcggcaagctgtttaaaggcgtttaccacctttataaagatgaaacctatctctatcagagcggtaaaggccacaccattcaggaagtccgcattgttaaagggctgaataacccggatctcgacgctgcggttggtgaagatctggcacagcagctgcgtgacgaactggagctggtgaaaggcgcgtctaatgagttcgacaaagagctgttccttgcgggcgaaatcaccccggtattctttggtactgcgctgggtaacttcggcgtcgatcatatgctggatggcctggtggagtgggcgcctgcgccgatgccgcgtcagaccgatacccgtaccgtagaagcgagcgaagataaatttaccggcttcgtatttaaaattcaggccaacatggacccgaaacaccgcgaccgcgtggcgtttatgcgcgtggtatccggtaaatatgaaaaaggcatgaagctgcgccaggtgcgcaccgcgaaagatgtggtgatctccgacgcgctgacctttatggcgggtgaccgttcgcacgttgaagaagcgtatcctggcgatatccttggtctgcacaaccacggcaccattcagatcggcgacacctttacccagggtgagatgatgaagttcaccggtattccgaacttcgcgccagaactgttccgtcgtatccgcctgaaagatccgctgaagcaaaaacagctgctcaaagggctggtacagctttccgaagagggcgcggtgcaggtgttccgtccgatctccaacaacgatttgatcgttggcgcggttggtgtgctgcagtttgatgtggtggtagcgcgcctgaagagcgaatacaacgttgaagcagtgtatgagtcagtcaacgttgccactgcccgctgggtagaatgtgcggacgcgaagaaattcgaagagttcaagcgtaagaacgaaagccaactggcgcttgatggcggcgataacctcgcttacatcgctaccagcatggtcaacctgcgcctggcgcaggaacgttatccggacgttcagttccaccagacccgcgagcattaa

SEQ ID NO: 142 - protein, 528 aa, Escherichia coli
MTSLLAAEVAKRRTFAIISHPDAGKTTITEKVLLFGQAIQTAGTVKGRGSNQHAKSDWMEMEKQRGISITTSVMQFPYHDCLVNLLDTPGHEDFSEDTYRTLTAVDCCLMVIDAAKGVEDRTRKLMEVTRLRDTPILTFMNKLDRDIRDPMELLDEVENELKIGCAPITWPIGCGKLFKGVYHLYKDETYLYQSGKGHTIQEVRIVKGLNNPDLDAAVGEDLAQQLRDELELVKGASNEFDKELFLAGEITPVFFGTALGNFGVDHMLDGLVEWAPAPMPRQTDTRTVEASEDKFTGFVFKIQANMDPKHRDRVAFMRVVSGKYEKGMKLRQVRTAKDVVISDALTFMAGDRSHVEEAYPGDILGLHNHGTIQIGDTFTQGEMMKFTGIPNFAPELFRRIRLKDPLKQKQLLKGLVQLSEEGAVQVFRPISNNDLIVGAVGVLQFDVVVARLKSEYNVEAVYESVNVATARWVECADAKKFEEFKRKNESQLALDGGDNLAYIATSMVNLRLAQERYPDVQFHQTREH

SEQ ID NO: 143 - DNA, 684 bp, Escherichia coli
gtgaagtctctccctattcagcaatgcaacctcgtgttgccaggctcaaattacgagcaaacatacaggaataaatcgatgactatgacaagactgaagatttcgaaaactctgctggctgtaatgttgacctctgccgtcgcgaccggctctgcctacgcagaaaacaacgcgcagactaccaatgaaagcgcagggcaaaaagtcgatagctctatgaataaagtcggtaatttcatggatgacagcgccatcaccgcgaaagtgaaggcggccctggtggatcatgacaacatcaagagcaccgatatctctgtcaaaaccgatcaaaaagtcgtgaccctgagcggtttcgttgaaagccaggctcaggccgaagaggcggtgaaagtggcgaaaggtgttgagggcgtgacctctgtcagcgacaaactgcacgttcgcgacgctaaagaaggctctgtgaaaggctacgcgggtgacaccgccactaccagtgaaatcaaagccaaactgctggcagatgacattgtcccttcccgtcatgtgaaagttgaaaccaccgatggcgtggtccagctctccggtaccgtagattctcaggcacagagcgaccgtgctgaaagtatcgccaaagcggtagatggtgtgaaaagcgttaaaaatgatctgaaaactaagtaa

SEQ ID NO: 144 - protein, 227 aa, Escherichia coli
MKSLPIQQCNLVLPGSNYEQTYRNKSMTMTRLKISKTLLAVMLTSAVATGSAYAENNAQTTNESAGQKVDSSMNKVGNFMDDSAITAKVKAALVDHDNIKSTDISVKTDQKVVTLSGFVESQAQAEEAVKVAKGVEGVTSVSDKLHVRDAKEGSVKGYAGDTATTSEIKAKLLADDIVPSRHVKVETTDGVVQLSGTVDSQAQSDRAESIAKAVDGVKSVKNDLKTK

SEQ ID NO: 145 - DNA, 192 bp, Escherichia coli
gtgacattaactatggtaaaggagacgcttatgtttcgttggggcatcatatttctggttatcgcgttaatcgccgccgcacttgggtttggtggtctggccggtactgctgcaggcgcagctaaaattgtctttgtcgtcgggattattctgttcctggtgagtttgttcatgggccgaaaacgaccctag

SEQ ID NO: 146 - protein, 63 aa, Escherichia coli
MTLTMVKETLMFRWGIIFLVIALIAAALGFGGLAGTAAGAAKIVFVVGIILFLVSLFMGRKRP

SEQ ID NO: 147 - DNA, 1074 bp, Escherichia coli
gtggggcagcgaatacctgtaacgcttggtaatattgcgccgttgtcgctaaggccgttccagcctggacggattgctctggtgtgcgaaggcggcggacaacgtggaattttcacggctggcgtgctggatgagtttatgcgcgcgcagtttaatcctttcgatctttatctcggcacatctgccggggcgcagaacctctcggcgtatatctgcaatcagcccggttacgcgcgcaaagtcatcatgcgttacaccacaaaacgcgaatttttcgatccattgcgctttgtccgtggaggaaatcttatcgatctcgactggctggtggaggccaccgcaagccagatgccgttgcaaatggacaccgcagcgcggttatttgacagcggcaaatcgttttatatgtgcgcctgtcgtcaggatgactatgcgccgaattactttttgccaactaaacaaaactggctggatgtgattcgcgcctccagtgcgatacctggcttttatcgtagcggagtgtcgctggaaggtattaactacctggatggtgggatcagtgatgcgatcccggttaaagaggcggtaaggcagggagcaaaaacgttggtcgtcatccgcactgtgccgtcacaaatgtactacacgccacagtggttcaaacgcatggaacgctggctgggtgacagtagcctgcagccgctggtcaatctggtgcagcatcatgaaaccagctatcgtgagattcagcaatttattgagaaaccaccgggccagctgcggatattcgaaatttatccgccgaagccattgcatagtattgcgctcggcagtcggattccggcgctgcgtgaagactataaacttgggcgtttatgtgggcgttattttctggcaacggtcggtaaattattgactgaaaaagcgccgctgagccgccatctggtgccggtggtgacgccggagtcgatcgttattccgcctgcgccagtcgccaacgatacgctggttgctgaagtgagcgacgctccgcaggcgaacgacccgacatttaacaatgaggatctggcttga

SEQ ID NO: 148 - protein, 357 aa, Escherichia coli
MGQRIPVTLGNIAPLSLRPFQPGRIALVCEGGGQRGIFTAGVLDEFMRAQFNPFDLYLGTSAGAQNLSAYICNQPGYARKVIMRYTTKREFFDPLRFVRGGNLIDLDWLVEATASQMPLQMDTAARLFDSGKSFYMCACRQDDYAPNYFLPTKQNWLDVIRASSAIPGFYRSGVSLEGINYLDGGISDAIPVKEAVRQGAKTLVVIRTVPSQMYYTPQWFKRMERWLGDSSLQPLVNLVQHHETSYREIQQFIEKPPGQLRIFEIYPPKPLHSIALGSRIPALREDYKLGRLCGRYFLATVGKLLTEKAPLSRHLVPVVTPESIVIPPAPVANDTLVAEVSDAPQANDPTFNNEDLA

SEQ ID NO: 149 - DNA, 780 bp, Escherichia coli
ttgatttgccgttttatcgacacccactgccattttgatttcccgccgtttagtggcgatgaagaggccagcctgcaacgcgcggcacaagcgggcgtaggcaagatcattgttccggcgacagaggcggaaaattttgcccgcgtgcaggcgttagcggaaaaatatcaaccgctgtatgccgcattgggcttgcatcctggtatgttggaaaaacatagcgatgtgtctcttgatcagctacagcaggcgctggaaaggcatccggcgaaggtggtggcggtgggggagatcggtctggatctctttggcgacgatccgcaatttgagaggcagcagtggttactcgacgaacaactgaaactggcgaaacgctacgatctgccggtgatcctgcattcacgacgcacgcacgacaaactggcgatgcatcttaaacgccacgatttaccgtgcactggcgtggttcatggtttttccggcagcctgcaacaggccgaacggtttgtgcaactgggctacaaaattggcgtaggcgggactatcacctatccacgcgccagtaaaacccgcgatgtcatcgcaaaattaccgctggcatcgttgttgctggaaaccgacgcaccagatatgccgctcaatggttttcaggggcagcctaatcgccctgaacaggccgcccgtgtgtttgccgtgctttgcgagttacgaccggaaccggcggatgagattgccgaagtgttgcttaataacacctatacgttgtttaacgtgccgtag

SEQ ID NO: 150 - protein, 259 aa, Escherichia coli
MICRFIDTHCHFDFPPFSGDEEASLQRAAQAGVGKIIVPATEAENFARVQALAEKYQPLYAALGLHPGMLEKHSDVSLDQLQQALERHPAKVVAVGEIGLDLFGDDPQFERQQWLLDEQLKLAKRYDLPVILHSRRTHDKLAMHLKRHDLPCTGVVHGFSGSLQQAERFVQLGYKIGVGGTITYPRASKTRDVIAKLPLASLLLETDAPDMPLNGFQGQPNRPEQAARVFAVLCELRPEPADEIAEVLLNNTYTLFNVP

SEQ ID NO: 151 - DNA, 864 bp, Escherichia coli
atgaacagcagatgcgctttagtcagtaagattatccccttctcctgcgttgacgggccaggcagtcgtctggctctgtttttgcagggctgcaatctgcgctgcaaaaactgtcacaatccgtggacgatggggcgctgtaatgattgcggagagtgcgtgccgcagtgtccgcatcaggcgttgcagattgtcgacggcaaagtggcgtggagcgcggctgtctgcgagcaatgtgatacctgcctgaagatgtgtccgcaacatgctacgccaatggcgcaatccatgagcgtggacgaggtgcttaaccatgtccgcaaagcggttctgtttattgaagggataacggtaagcggcggcgaagccacgacccagttgccgtttgtggtggcgctgtttactgccatcaaaaacgatccgcaactgtgccatctcacctgcctcgtggacagtaacggcatgttgagcgaaaccggctgggaaaaattgctcccggtgtgtgacggcgcaatgctcgatctcaaagcgtgggggagcgaatgtcatcagcaattaaccggacgcgataatcagcagatcaagcgcagcatctgtttgctggcagagcgcggtaagctggcggaactgcgtttgctggtaatccctggccaggtggattatttgcaacatatcgaagaactggcggcgttaatcaagggacttggcgatgttccggtacgcctgaacgcgtttcatgcccacggcgtgtatggcgaggcgcaaagctggccgagcgccacgccggaggatgtggaacaactggctgatgcgttacgggagcgcggggtgagccggttaatatttccggcgctatatttgtga

SEQ ID NO: 152 - protein, 287 aa, Escherichia coli
MNSRCALVSKIIPFSCVDGPGSRLALFLQGCNLRCKNCHNPWTMGRCNDCGECVPQCPHQALQIVDGKVAWSAAVCEQCDTCLKMCPQHATPMAQSMSVDEVLNHVRKAVLFIEGITVSGGEATTQLPFVVALFTAIKNDPQLCHLTCLVDSNGMLSETGWEKLLPVCDGAMLDLKAWGSECHQQLTGRDNQQIKRSICLLAERGKLAELRLLVIPGQVDYLQHIEELAALIKGLGDVPVRLNAFHAHGVYGEAQSWPSATPEDVEQLADALRERGVSRLIFPALYL

SEQ ID NO: 153 - DNA, 1551 bp, Escherichia coli
atgcccacttctcatgaaaatgcactgcaacaacgttgccagcaaattgtcaccagcccggtacttagcccggagcagaagcgccattttctggcactggaagcagaaaacaatctgccttacccacagctgcctgccgaagcccgccgcgcgctggatgagggggtaatctgcgatatgtttgaaggtcatgcgccgtacaaaccgcgctatgtcttacccgattacgcccgttttttggccaacggttccgaatggctggagctggaaggcgcgaaagaccttgatgacgcactctctctgctgaccattctttaccaccatgtaccgtcggtcacatcgatgccggtctacctggggcaactggatgcgttgttgcaaccgtatgttagaattctaacacaagacgagatcgatattcgaataaaacgtttctggcgttacctcgacagaaccctgccagacgcctttatgcatgccaatatcggcccgtctgattcgcccattacccgtgcgatattacgtgcagacgcagagctgaagcaggtttcaccgaacctgacctttatctacgatcctgatatcacccctgatgacctgctgctggaagtggcgaaaaacatctgtgaatgtagcaaaccgcacatcgccaacggtccggtgcatgataaaattttcacaaaagggggctacgggattgtgagctgttacaactcactgccgctggcgggtggtggcagcacgctggtacgcctaaacctgaaagccattgccgagcgcagtgaatcgctggaggacttctttacgcgcactctaccgcactactgccaacagcagatcgccatcatcgatgcgcggtgtgaattcctctatcaacaatcacacttctttgagaatagcttcctggtgaaagaagggctgattaaccctgaacgttttgtgccgatgtttggcatgtatgggctggcggaagcggttaacttgctgtgtgaaaaagaagggattgccgcacgctacggtaaagaggccgccgcaaatgaagtgggttatcgcattagcgcgcaactggcggagtttgtcgccaatacccccgtgaaatatggctggcaaaaacgcgccatgttacacgcacagtcggggataagttccgatatcggcaccacgccgggcgcgcgtttgccgtatggtgatgagccagatccgattacccatctgcaaactgtcgccccgcatcatgcttattattattccggcatcagcgacattctgacgctcgacgaaaccatcaaacgtaatccgcaggcgctggtacagctttgcctcggtgcctttaaagctggaatgcgtgaatttaccgccaatgtcagcggtaacgatctggttcgcgttaccggttatatggtgcgtttgtcggatttagaaaaatatcgcgccgaaggttcacgcaccaacaccacctggctgggagaagaagccgcacgcaacactcgtattctggaacgccagccgcgcgtgataagccatgaacagcagatgcgctttagtcagtaa

SEQ ID NO: 154 - protein, 516 aa, Escherichia coli
MPTSHENALQQRCQQIVTSPVLSPEQKRHFLALEAENNLPYPQLPAEARRALDEGVICDMFEGHAPYKPRYVLPDYARFLANGSEWLELEGAKDLDDALSLLTILYHHVPSVTSMPVYLGQLDALLQPYVRILTQDEIDIRIKRFWRYLDRTLPDAFMHANIGPSDSPITRAILRADAELKQVSPNLTFIYDPDITPDDLLLEVAKNICECSKPHIANGPVHDKIFTKGGYGIVSCYNSLPLAGGGSTLVRLNLKAIAERSESLEDFFTRTLPHYCQQQIAIIDARCEFLYQQSHFFENSFLVKEGLINPERFVPMFGMYGLAEAVNLLCEKEGIAARYGKEAAANEVGYRISAQLAEFVANTPVKYGWQKRAMLHAQSGISSDIGTTPGARLPYGDEPDPITHLQTVAPHHAYYYSGISDILTLDETIKRNPQALVQLCLGAFKAGMREFTANVSGNDLVRVTGYMVRLSDLEKYRAEGSRTNTTWLGEEAARNTRILERQPRVISHEQQMRFSQ

SEQ ID NO: 155 - DNA, 126 bp, Escherichia coli
gtgcattttcatgagaagtgggcatcttcttttccttttatgccgaaggtgatgcgccattgtaagaagtttcgtgatgttcactttgatcctgatgcgtttgccaccactgacgcattcatttga

SEQ ID NO: 156 - protein, 41 aa, Escherichia coli
MHFHEKWASSFPFMPKVMRHCKKFRDVHFDPDAFATTDAFI

SEQ ID NO: 157 - DNA, 780 bp, Escherichia coli
atgactgatctgaaagcaagcagcctgcgtgcactgaaattgatggacctgaccaccctgaatgacgacgacaccgatgagaaagtgatcgccctgtgtcatcaggccaaaactccggtcggcaataccgccgctatctgtatctatcctcgctttatcccgattgctcgcaaaacgctgaaagagcagggcaccccggaaatccgtatcgctacggtaactaacttcccacacggtaacgacgacatcgaaatcgcgctggcagaaacccgtgcggcaatcgcctacggtgccgatgaagttgacgtggtgttcccgtaccgcgcgctgatggcgggtaacgagcaggttggttttgacctggtgaaagcctgtaaagaggcttgcgctgcggcgaacgtactgctgaaagtgattattgaaaccggcgaactgaaagacgaagcgctgatccgtaaagcgtctgaaatctccatcaaagcgggtgctgacttcatcaaaacctctaccggtaaagtggctgtgaatgcgacgccggaaagcgcgcgcatcatgatggaagtgatccgcgatatgggcgtagaaaaaatcgttggtttcaaaccggcgggcggcgtgcgtactgcggaagatgcgcagaaatatctcgccattgcagatgaactgttcggtgctgactgggctgatgcgcgtcactaccgctttggtgcttccagcttgctggcaagcctgctgaaagctctgggccacggcgacggtaagagcgccagcagctactaa

SEQ ID NO: 158 - protein, 259 aa, Escherichia coli
MTDLKASSLRALKLMDLTTLNDDDTDEKVIALCHQAKTPVGNTAAICIYPRFIPIARKTLKEQGTPEIRIATVTNFPHGNDDIEIALAETRAAIAYGADEVDVVFPYRALMAGNEQVGFDLVKACKEACAAANVLLKVIIETGELKDEALIRKASEISIKAGADFIKTSTGKVAVNATPESARIMMEVIRDMGVEKIVGFKPAGGVRTAEDAQKYLAIADELFGADWADARHYRFGASSLLASLLKALGHGDGKSASSY

SEQ ID NO: 159 - DNA, 1323 bp, Escherichia coli
ttgtttctcgcacaagaaattattcgtaaaaaacgtgatggtcatgcgctgagtgatgaagaaattcgtttctttatcaacggcattcgcgacaacactatctccgaagggcagattgccgccctcgcgatgaccattttcttccacgatatgacaatgcctgagcgtgtctcgctgaccatggcgatgcgagattcaggaaccgttctcgactggaaaagcctgcatctgaatggcccgattgttgataaacactcgaccggcggtgtcggcgatgtgacttcgctgatgttggggccgatggtcgctgcctgtggcggctatattccgatgatctccggtcgcggcctcggtcatactggcggtacgctcgacaaactggaatccatccctggcttcgacattttcccggatgacaaccgtttccgcgaaattattaaagacgtcggcgtggcgattatcggccagaccagctcactggctccggcggataaacgtttctacgcgacccgcgatattaccgcaaccgtggattcaatcccgctgatcaccgcctctattctggcgaagaaactggcggaaggtctggacgcgctggtgatggacgtgaaagtgggtagcggcgcgtttatgccgacctacgaactctctgaagcccttgccgaagcgattgttggcgtggctaacggcgctggcgtgcgcaccaccgcgctgctcaccgatatgaatcaggtactggcctccagtgcaggtaacgcggttgaagttcgtgaagcggtgcagttcctgacgggtgaatatcgtaacccgcgtctgtttgatgtcacgatggcactgtgcgtggagatgctgatctccggcaaactggcgaaaaatgacgccgaagcgcgcgcgaaattgcaggcggtgctggacaacggtaaagcggcagaagtctttggtcgtatggtcgcggcacaaaaaggcccgaccgacttcgttgagaactacgcgaagtatctgccgacagcgatgctgacgaaagcagtctatgctgataccgaagggtttgtcagtgaaatggatacccgcgcactggggatgacagtggttgcaatgggcggcggacgccgtcaggcatctgacaccatcgattacagcgtcggctttactgatatggcgcgtctgggcgaccaggtagacggtcagcgtccgctggcagttatccacgcgaaagacgaaaacagctggcaggaagcggcgaaagcggtgaaagcggcaattaaacttgccgataaagcaccggaaagcacaccaactgtctatcgccgtatcagcgaataa

SEQ ID NO: 160 - protein, 440 aa, Escherichia coli
MFLAQEIIRKKRDGHALSDEEIRFFINGIRDNTISEGQIAALAMTIFFHDMTMPERVSLTMAMRDSGTVLDWKSLHLNGPIVDKHSTGGVGDVTSLMLGPMVAACGGYIPMISGRGLGHTGGTLDKLESIPGFDIFPDDNRFREIIKDVGVAIIGQTSSLAPADKRFYATRDITATVDSIPLITASILAKKLAEGLDALVMDVKVGSGAFMPTYELSEALAEAIVGVANGAGVRTTALLTDMNQVLASSAGNAVEVREAVQFLTGEYRNPRLFDVTMALCVEMLISGKLAKNDAEARAKLQAVLDNGKAAEVFGRMVAAQKGPTDFVENYAKYLPTAMLTKAVYADTEGFVSEMDTRALGMTVVAMGGGRRQASDTIDYSVGFTDMARLGDQVDGQRPLAVIHAKDENSWQEAAKAVKAAIKLADKAPESTPTVYRRISE

SEQ ID NO: 161 - DNA, 1224 bp, Escherichia coli
atgaaacgtgcatttattatggtgctggactcattcggcatcggcgctacagaagatgcagaacgctttggtgacgtcggggctgacaccctgggtcatatcgcagaagcttgtgccaaaggcgaagctgaccacggtcgtaaaggcccgctcaatctgccaaatctgacccgtcttgggctggcgaaagcacacgaaggttctaccggtttcattccggcgggaatggatggcaacgctgaagttatcggcgcgtacgcatgggcgcacgaaatgtcatccggtaaagacaccccgtctggtcactgggaaatcgccggtgtcccggttctgtttgagtggggatatttctccgatcacgaaaacagcttcccgcaagagctgctggataaactggttgaacgcgctaatctgccgggttacctcggtaactgccactcttccggtacggtcattctggatcaactgggcgaagagcacatgaaaaccggcaagccgattttctatacctccgctgactccgtgttccagattgcctgccatgaagaaactttcggtctggacaaactctacgaactgtgcgaaatcgctcgtgaagagctgaccaacggcggctacaacatcggtcgtgttatcgctcgtccgtttatcggcgacaaagctggtaacttccagcgtactggtaaccgtcacgacctggctgttgagccgccagcaccgaccgtgctgcagaaactggttgatgaaaaacacggccaggtggtttcggtcggtaaaattgcagacatctacgccaactgcggtatcaccaaaaaagtgaaagcgaccggcctggacgcgctgtttgacgccaccatcaaagagatgaaagaagcgggtgataacaccatcgtcttcaccaacttcgttgacttcgactcttcctggggccaccgtcgcgacgtcgccggttatgctgcgggtctggaactgttcgaccgccgtctgccggagctgatgtctttgctgcgcgatgacgatattctgattctcactgctgaccacggttgtgacccgacctggaccggtactgaccacacgcgtgaacacattccggtactggtttacggcccgaaagtgaaaccaggttcgctgggtcatcgtgaaaccttcgcggatatcggccagactctggcaaaatattttggtacttctgatatggaatatggcaaagccatgttctga

SEQ ID NO: 162 - protein, 407 aa, Escherichia coli
MKRAFIMVLDSFGIGATEDAERFGDVGADTLGHIAEACAKGEADHGRKGPLNLPNLTRLGLAKAHEGSTGFIPAGMDGNAEVIGAYAWAHEMSSGKDTPSGHWEIAGVPVLFEWGYFSDHENSFPQELLDKLVERANLPGYLGNCHSSGTVILDQLGEEHMKTGKPIFYTSADSVFQIACHEETFGLDKLYELCEIAREELTNGGYNIGRVIARPFIGDKAGNFQRTGNRHDLAVEPPAPTVLQKLVDEKHGQVVSVGKIADIYANCGITKKVKATGLDALFDATIKEMKEAGDNTIVFTNFVDFDSSWGHRRDVAGYAAGLELFDRRLPELMSLLRDDDILILTADHGCDPTWTGTDHTREHIPVLVYGPKVKPGSLGHRETFADIGQTLAKYFGTSDMEYGKAMF

SEQ ID NO: 163 - DNA, 720 bp, Escherichia coli
atggctactccacacattaatgcagaaatgggcgattttgctgacgtagttttgatgccaggtgacccgctgcgtgcgaagtatattgctgaaactttccttgaagatgcccgtgaagtgaacaacgttcgcggtatgctgggcttcactggtacttacaaaggccgcaaaatttccgtaatgggccacggtatgggtatcccgtcctgctccatctacaccaaagaactgatcactgatttcggcgtgaagaaaattatccgcgttggttcctgtggcgctgttctgccgcacgtaaaactgcgcgacgtcgttatcggtatgggtgcctgcaccgattccaaagttaaccgcatccgttttaaagaccatgactttgccgctatcgctgacttcgacatggtgcgtaacgcggtagacgcggcaaaagcactgggcgttgatgctcgtgttggtaacctgttctccgctgacctgttctactctccggacggcgaaatgttcgacgtgatggaaaaatacggcatcctcggcgtggaaatggaagcggctggtatctacggcgtcgctgcagaatttggcgcgaaagccctgaccatctgcaccgtgtctgaccacatccgcactcacgagcagaccactgccgctgagcgtcagaccaccttcaacgacatgatcaaaatcgcgctggaatccgttctgctgggcgataaagagtaa

SEQ ID NO: 164 - protein, 239 aa, Escherichia coli
MATPHINAEMGDFADVVLMPGDPLRAKYIAETFLEDAREVNNVRGMLGFTGTYKGRKISVMGHGMGIPSCSIYTKELITDFGVKKIIRVGSCGAVLPHVKLRDVVIGMGACTDSKVNRIRFKDHDFAAIADFDMVRNAVDAAKALGVDARVGNLFSADLFYSPDGEMFDVMEKYGILGVEMEAAGIYGVAAEFGAKALTICTVSDHIRTHEQTTAAERQTTFNDMIKIALESVLLGDKE

SEQ ID NO: 165 - DNA, 1323 bp, Escherichia coli
ttgaccgatcttttattgcaagggccgcgttctgccccggaattgcgccagcgtctggcaatcagtcaggcgacgttctcacgccttgttgccagagaagatcgggtgattcgctttggtaaagcacgggcaacgcgatatgcactgctgcgtccttatcgcggaattgagcgtattcccgtatggcgagtggatgatgccggaaaggcgcataaattcgccgacatccggttgtgctggccgcagggaagttgtctggtaacaggcgcagatggcgacgaacggtggtttgatggtttgccctggtatttgaccgatctgcgaccgcaggggtttttggggcgcgcgtggggcaggaagttagccgcgcaactgaatcttactgaagatatccgtctctggcaggaagaagatgtgctctacgccctgaccgtatttagcggtgaatacaccggcggctggctggtcggggaggggaattatcagcgatggattactgcacaacgccctgcggcaattcctctggatcaaaaactcacccattacgaacaactggcaagcgatgcactggcaggagaaattgtgggttcttctgcgggcggtgagcagccaaaatttacctgctatgcacaaacgccgtcaggcaataaacatgtgctggttaaattcaccgtgccacagcaaaccgcggtcagccaacgttggggcgacttgcttattgcggaatctattgccgcgcaaatcctgcgcgacggcgggatccacgccatcgagtcaacggtgcttgtaacaagtaacaggcaggtattccttgaagcggaacgatttgactgcaaaggtaacgatggtcgcttgcccattgtgtcgctggaggcggtgcagagtgagtttatctcttctccgggatcgtggccggaggctatgcgccgtttgtgtgagcaacaacttgtcactcaccagagcgtggcgcaaacagaagtgatctgggcgtttgggcgacttatcgccaacagcgatatgcacgcaggcaatttatcattttatttatctgaaccaccatttgcgctgacgcccgtctacgacatgctgccgatggcctatgcaccaaacagcgccggaatgttgcgtgatgctgccattgaggtgaggtttgatcttaacgtcagtaaaagtgcatggttaacggcgatcccgctggcgcagcagttctggcaaacggtcgccggagatccgcgtatcagcgaggcatttcgccacattgcacaagaaatgccggaaaaaatccggcaaatcgaagggaaagttgcccgcatgggcgggtaa

SEQ ID NO: 166 - protein, 440 aa, Escherichia coli
MTDLLLQGPRSAPELRQRLAISQATFSRLVAREDRVIRFGKARATRYALLRPYRGIERIPVWRVDDAGKAHKFADIRLCWPQGSCLVTGADGDERWFDGLPWYLTDLRPQGFLGRAWGRKLAAQLNLTEDIRLWQEEDVLYALTVFSGEYTGGWLVGEGNYQRWITAQRPAAIPLDQKLTHYEQLASDALAGEIVGSSAGGEQPKFTCYAQTPSGNKHVLVKFTVPQQTAVSQRWGDLLIAESIAAQILRDGGIHAIESTVLVTSNRQVFLEAERFDCKGNDGRLPIVSLEAVQSEFISSPGSWPEAMRRLCEQQLVTHQSVAQTEVIWAFGRLIANSDMHAGNLSFYLSEPPFALTPVYDMLPMAYAPNSAGMLRDAAIEVRFDLNVSKSAWLTAIPLAQQFWQTVAGDPRISEAFRHIAQEMPEKIRQIEGKVARMGG

SEQ ID NO: 167 - DNA, 936 bp, Escherichia coli
atgccggctacgcagcgcgttctgtttctctggcgcaatgccgacacggtagtgattggtcgcgcgcagaacccgtggaaagagtgtaatacccggcggatggaagaagataacgtccgcctggcgcggcgcagtagcggtggcggcgcagtgttccacgatctcggcaatacctgttttacctttatggctggcaagccggagtacgataaaactatctccacgtcgattgtgctcaatgcgctgaacgcgctcggcgtcagcgccgaagcttccgggcgtaacgatctggtggtgaaaaccgccgaaggcgatcgcaaagtctcaggctcggcctatcgcgaaaccaaagatcgtggcttccaccacggcactttgctgctcaattccgaccttagccgcctggcaaactatctcaatccggataaaaagaaactggcggcgaaaggcattacctcagtgcgttcccgcgtgaccaatctgaccgaattgctaccggggatcacccatgagcaggtttgcgaggccataaccgaggcctttttcgcccattatggcgagcgcgtggaagcggaaatcatctccccggacaaaacgccagacttgccaaacttcgccgaaacctttgcccgccagagtagctgggaatggaacttcggtcaggctccggcattctcgcatctgctggatgaacgctttacctggggcggcgtggaactgcatttcgacgttgaaaaaggccatatcacccgcgcccaggtgtttaccgacagtctcaaccccgcgccgctggaagccctcgccgggcgactgcaaggctgtctgtaccgcgcggatatgctgcaacaggagtgcgaagcgctgctggttgacttcccggaacaggaaaaagagctacgggagttgtcggcatggatagcgggggcggtgcgatag

SEQ ID NO: 168 - protein, 311 aa, Escherichia coli
MPATQRVLFLWRNADTVVIGRAQNPWKECNTRRMEEDNVRLARRSSGGGAVFHDLGNTCFTFMAGKPEYDKTISTSIVLNALNALGVSAEASGRNDLVVKTAEGDRKVSGSAYRETKDRGFHHGTLLLNSDLSRLANYLNPDKKKLAAKGITSVRSRVTNLTELLPGITHEQVCEAITEAFFAHYGERVEAEIISPDKTPDLPNFAETFARQSSWEWNFGQAPAFSHLLDERFTWGGVELHFDVEKGHITRAQVFTDSLNPAPLEALAGRLQGCLYRADMLQQECEALLVDFPEQEKELRELSAWIAGAVR

SEQ ID NO: 169 - DNA, 645 bp, Escherichia coli
atggctcgcacaaaactgaaattccggctgcatcgggcagtgattgtcctgttctgtcttgccttgttagtggcgctgatgcagggagcgtcatggtttagtcaaaaccaccagcgacagcgtaatccacagctggaagaactggcccgcaccctggcgcggcaggtgacgctaaacgttgcaccgcggatgcgtaccgactcaccggatgaaaaacgcattcaggcgatcctcgatcagttaacggatgaaagccgcattctcgacgcaggcgtatatgatgagcaaggcgatcttatcgcccgttctggcgaaagcgtcgacgtgcgcgaccgactggcgctcgacggcaaaaaagcgggcggctattttaaccagcagattgtcgaacccattgcgggtaaaaacggaccgctcggctatctgcgcctgacgctcgacacccatacgctcgccaccgaagcccaacaggtggataacaccactaacattttacgcctgatgttgctgctctcgctggcaatcggcgtagtgctgacccgcacgctgctacagggtaaacgcacccgctggcagcaatcgcccttcctgttaaccgccagtaaaccggtgccggaagaggaagaaagcgagaaaaaagagtga

SEQ ID NO: 170 - protein, 214 aa, Escherichia coli
MARTKLKFRLHRAVIVLFCLALLVALMQGASWFSQNHQRQRNPQLEELARTLARQVTLNVAPRMRTDSPDEKRIQAILDQLTDESRILDAGVYDEQGDLIARSGESVDVRDRLALDGKKAGGYFNQQIVEPIAGKNGPLGYLRLTLDTHTLATEAQQVDNTTNILRLMLLLSLAIGVVLTRTLLQGKRTRWQQSPFLLTASKPVPEEEESEKKE

SEQ ID NO: 171 - DNA, 969 bp, Escherichia coli
atgcctaacattacctggtgcgacctgcctgaagatgtctctttatggccgggtctgcctctttcattaagtggtgatgaagtgatgccactggattaccacgcaggtcgtagcggctggctgctgtatggtcgtggactggataaacaacgtctgacccaataccagagcaaactgggcgcggcgatggtgattgttgccgcctggtgcgtggaagattatcaggtgattcgtctggcaggttcactcaccgcgcgggctacgcgcctggcccacgaagcgcagctggatgtcgcgccgctggggaaaatcccgcacctgcgcacgccgggtttgctggtgatggacatggattccaccgccatccagattgaatgtattgatgaaattgccaaactggccggaacgggcgagagggtggcggaggtaaccgaacgggcgatgcgcggcgaactcgattttaccgccagcctgcgcagccgcgtggcgacgctgaaaggcgctgacgcgaacattctgcaacaggtgcgtgaaaatctgccgctgatgccaggcttaacgcagctggtactcaagctggaaacgctgggctggaaagtggcgattgcctccggcggctttactttctttgctgaatacctgcgcgacaagctgcgcctgacagccgtggtagccaatgaactggagatcatggacggtaaatttaccggcaatgtgatcggcgacatcgttgacgcgcagtacaaagcgaaaactctgactcgcctcgcgcaggagtatgaaatcccgctggcgcagaccgtggcgattggcgatggagccaatgacctgccgatgatcaaagcggcagggctggggattgcctaccatgccaagccaaaagtgaatgaaaaaacggaagtcaccatccgtcacgctgacctgatgggtgtattctgcatcctctctggcagcctgaatcagaagtaa

SEQ ID NO: 172 - protein, 322 aa, Escherichia coli
MPNITWCDLPEDVSLWPGLPLSLSGDEVMPLDYHAGRSGWLLYGRGLDKQRLTQYQSKLGAAMVIVAAWCVEDYQVIRLAGSLTARATRLAHEAQLDVAPLGKIPHLRTPGLLVMDMDSTAIQIECIDEIAKLAGTGERVAEVTERAMRGELDFTASLRSRVATLKGADANILQQVRENLPLMPGLTQLVLKLETLGWKVAIASGGFTFFAEYLRDKLRLTAVVANELEIMDGKFTGNVIGDIVDAQYKAKTLTRLAQEYEIPLAQTVAIGDGANDLPMIKAAGLGIAYHAKPKVNEKTEVTIRHADLMGVFCILSGSLNQK

SEQ ID NO: 173 - DNA, 1383 bp, Escherichia coli
gtggcaaaagctccaaaacgcgcctttgtttgtaatgaatgcggggccgattatccgcgctggcaggggcagtgcagcgcctgtcatgcctggaacaccatcaccgaggtgcgtcttgctgcgtcgccaacggtggcgcgtaacgagcgtctcagtggctatgccggtagcgccggagtggcaaaagtccagaaactttccgacatcagccttgaagagctgccgcgtttttccaccggatttaaagagttcgaccgcgtactaggcggcggcgtggtgccgggaagtgccattctgattggcggtaacccaggtgccgggaaatccacgctgctgttgcaaacgctgtgcaaactggcgcagcagatgaaaacgctgtatgtcaccggcgaagagtcgctgcaacaggtggcaatgcgcgctcatcgccttggcctgccgactgacaatcttaatatgctgtcggaaaccagcatcgagcagatctgcctgattgccgaagaagagcaaccgaagctgatggtaattgactccatccaggtgatgcatatggcggatgtacaatcatcgcctggcagcgtggcacaggtgcgtgaaacggcggcttatctgacgcgcttcgccaaaacgcgcggtgtggcgattgtcatggtcgggcacgtaaccaaagatggctcgctggctggccctaaagtgctggaacactgtatcgactgttcggtgcttttggatggtgatgccgactcacgttttcgcaccttacgcagccataaaaaccgcttcggcgcggtgaatgagctgggtgtcttcgcaatgaccgagcaggggctgcgtgaagtcagcaacccttcggcaattttcttaagtcgcggcgatgaagtgacctccggtagctcagtgatggtagtgtgggaaggaacgcgtccgctgctggtggagattcaggcgctcgtcgatcactcgatgatggcgaatccacgccgcgtggcagtcgggctggagcaaaaccgtctggcaatcctgctggcggtgcttcaccgtcacggtggtctacaaatggccgatcaggatgtgtttgttaacgtggtcggtggcgtgaaggtgacggaaaccagtgccgatttagcgttactgctggcgatggtttccagcctgcgtgacagaccgctaccgcaggatctggtggtgtttggtgaagtcgggctggcaggggagatccgcccggtgcccagcggccaggaacgaatctcagaagcggcgaaacacggttttcgccgggcaattgttccggcagctaacgtgccgaaaaaagcgccggaagggatgcagatttttggcgttaaaaaactctccgacgcgcttagcgtgttcgacgacttataa

SEQ ID NO: 174 - protein, 460 aa, Escherichia coli
MAKAPKRAFVCNECGADYPRWQGQCSACHAWNTITEVRLAASPTVARNERLSGYAGSAGVAKVQKLSDISLEELPRFSTGFKEFDRVLGGGVVPGSAILIGGNPGAGKSTLLLQTLCKLAQQMKTLYVTGEESLQQVAMRAHRLGLPTDNLNMLSETSIEQICLIAEEEQPKLMVIDSIQVMHMADVQSSPGSVAQVRETAAYLTRFAKTRGVAIVMVGHVTKDGSLAGPKVLEHCIDCSVLLDGDADSRFRTLRSHKNRFGAVNELGVFAMTEQGLREVSNPSAIFLSRGDEVTSGSSVMVVWEGTRPLLVEIQALVDHSMMANPRRVAVGLEQNRLAILLAVLHRHGGLQMADQDVFVNVVGGVKVTETSADLALLLAMVSSLRDRPLPQDLVVFGEVGLAGEIRPVPSGQERISEAAKHGFRRAIVPAANVPKKAPEGMQIFGVKKLSDALSVFDDL

SEQ ID NO: 175 - DNA, 1233 bp, Escherichia coli
atgtcgtcatttgattacctgaaaactgccatcaagcaacagggctgcactctacagcaggtagctgatgccagcggtatgaccaaagggtatttaagccagttactgaatgccaaaattaaaagccccagcgcacaaaagctggaggcattgcaccgttatttgggacttgaatttccccggcagaagaaaacgatcggtgtcgtattcggtaagttttacccgctgcatactggacatatctaccttatccagcgcgcctgtagccaggttgacgagctgcatatcattatgggttttgacgatacccgcgaccgcgcattgttcgaagacagcgccatgtcgcagcagccaaccgtgccggatcgtctgcgctggttattgcagacctttaagtatcaaaaaaatatccgcattcatgcttttaacgaagagggcatggaaccgtatccacacggctgggatgtgtggagcaacggcatcaaaaagtttatggccgaaaaaggcattcagccggacctgatctacacctcggaagaagccgatgcgccgcagtatatggaacatctggggatcgagacggtgctggtcgatccgaagcgtacctttatgagtatcagcggtgcgcagatccgcgaaaacccgttccgctactgggaatatattcctacggaagtgaagccattctttgtgcgtaccgtggcgatcctcggtggtgaatcgagcggtaaatccaccctggtaaacaaacttgccaatatcttcaacactaccagtgcgtgggaatatggtcgtgattatgtcttttcgcacctcggtggcgatgagatcgcgttgcagtattccgactacgataaaatcgcgctgggacatgcgcaatatattgattttgcagtgaaatatgccaataaagtggcgtttatcgacaccgattttgtcactacccaggcgttctgcaaaaagtacgaagggcgtgagcatccgttcgtgcaggcgttgattgatgagtaccgtttcgatctggtgatcctgctggagaacaacacgccgtgggtggcggatggtttacgcagcctcggcagttcggtggatcgcaaagagttccagaacttgctggtggagatgctggaagagaacaatatcgaattcgtgcgggttgaagaggacgattacgacagccgtttcctgcgctgcgtggagctggtgcgggagatgatgggggagcaaagataa

SEQ ID NO: 176 - protein, 410 aa, Escherichia coli
MSSFDYLKTAIKQQGCTLQQVADASGMTKGYLSQLLNAKIKSPSAQKLEALHRYLGLEFPRQKKTIGVVFGKFYPLHTGHIYLIQRACSQVDELHIIMGFDDTRDRALFEDSAMSQQPTVPDRLRWLLQTFKYQKNIRIHAFNEEGMEPYPHGWDVWSNGIKKFMAEKGIQPDLIYTSEEADAPQYMEHLGIETVLVDPKRTFMSISGAQIRENPFRYWEYIPTEVKPFFVRTVAILGGESSGKSTLVNKLANIFNTTSAWEYGRDYVFSHLGGDEIALQYSDYDKIALGHAQYIDFAVKYANKVAFIDTDFVTTQAFCKKYEGREHPFVQALIDEYRFDLVILLENNTPWVADGLRSLGSSVDRKEFQNLLVEMLEENNIEFVRVEEDDYDSRFLRCVELVREMMGEQR

SEQ ID NO: 177 - DNA, 333 bp, Escherichia coli
atgggtaaggcgataatatttatagagacgccaatgtttacgcgtcagatcaagcagattgcaaccgatgatgaattaaaggaattacaaaaagaactcatcggaactcccgataaaggtgatctcattcagcagactggtggattgcgtaaagtccgaatggctgcgggttcacagggaaaaagtggcagtgtcagaataatttactttctggcgacggaagagattatttatttgattatggcctatccgaaaaatgccaaagatagtctgacagatacggaaaaagctcaactaaagaagttgacgaaactgctcaaaggcgagatataa

SEQ ID NO: 178 - protein, 110 aa, Escherichia coli
MGKAIIFIETPMFTRQIKQIATDDELKELQKELIGTPDKGDLIQQTGGLRKVRMAAGSQGKSGSVRIIYFLATEEIIYLIMAYPKNAKDSLTDTEKAQLKKLTKLLKGEI

SEQ ID NO: 179 - DNA, 285 bp, Escherichia coli
atgagtttttttgatgagttgaaaacctctctggaagaggctgtcgagattaaacaaggtttaaaagaacctgcacgggtgacccgctacgaaattgcggatgttaaagctattcgtgagcaactcaacgtttctcaaagtgagatggcaaaagctctgggaaccagtgtggataccattaaaagctgggaatcgaagcgaagaaatcctacgggattggctgcaaaagtacttgccacaattaaagaaaatcctgcctttttccgggaacttgcttcccattaa

SEQ ID NO: 180 - protein, 94 aa, Escherichia coli
MSFFDELKTSLEEAVEIKQGLKEPARVTRYEIADVKAIREQLNVSQSEMAKALGTSVDTIKSWESKRRNPTGLAAKVLATIKENPAFFRELASH

SEQ ID NO: 181 - DNA, 1668 bp, Escherichia coli
gtggctcaattcgtttataccatgcatcgtgtcggcaaagttgttccgccgaaacgtcatattttgaaaaacatctctctgagtttcttccctggggcaaaaattggtgtcctgggtctgaacggcgcgggtaagtccaccctgctgcgcattatggcgggcattgataaagacatcgaaggtgaagcacgtccgcagccagacatcaagattggttatctgccgcaggaaccgcagctgaacccggaacacaccgttcgtgagtccattgaagaagcggtttctgaagtggttaacgccctgaaacgcctggatgaagtgtatgcgctgtatgccgatccggatgccgattttgacaagctggccgctgaacaaggccgtctggaagagatcattcaggctcacgacggtcacaacctgaacgttcagctggagcgtgcggcggatgcgctgcgtctgccggactgggacgcgaaaatcgctaacctttccggtggtgagcgtcgtcgcgtggcgttgtgccgcctgctgctggaaaaaccagacatgctgctgctcgacgaaccgaccaaccacctggatgcggaatccgtagcgtggctggaacgcttcctgcacgacttcgaaggcaccgtggtggcgattacccacgaccgttacttcctcgataacgttgcgggctggatcctcgaacttgaccgcggtgaaggtattccgtgggaaggtaactactcctcctggctggagcagaaagatcagcgtctggcgcaggaagcttcacaagaagcggcgcgtcgtaagtcgatcgagaaagagctggagtgggtacgtcagggaactaaaggccgtcagtcaaaaggtaaagcacgtctggcgcgctttgaagaactcaacagcaccgaatatcagaaacgtaacgaaaccaacgaactgtttattccacctggaccgcgtctgggcgataaagtgctggaagtcagcaacctgcgtaaatcctatggtgatcgtctgctgattgactccctgagcttctcgatcccgaaaggagcgatcgtcgggatcatcggtccgaacggtgcgggtaaatcgacgctgttccgtatgatctctggtcaggaacagccggacagcggcaccatcactttgggtgaaacggtgaaactggcgtcggttgatcagttccgtgactcaatggataacagcaaaaccgtttgggaagaagtttccggcgggctggatatcatgaagatcggcaacaccgagatgccaagccgcgcctacgttggccgctttaactttaaaggggttgatcagggtaaacgcgttggcgaactctccggcggtgagcgcggtcgtctgcatctggcgaagctgctgcaggttggcggcaacatgctgctgctcgacgaaccaaccaacgacctggatatcgaaaccctgcgcgcactggaaaacgccctgctggagttcccgggctgcgcgatggttatctcgcacgaccgttggttcctcgaccgtatcgccacccacattctggattaccaggatgaaggtaaagttgagttcttcgaaggtaactttaccgagtacgaagagtacaagaaacgcacgctgggcgcagacgcgctggagccgaagcgtatcaagtacaagcgtattgcgaagtaa

SEQ ID NO: 182 - protein, 555 aa, Escherichia coli
MAQFVYTMHRVGKVVPPKRHILKNISLSFFPGAKIGVLGLNGAGKSTLLRIMAGIDKDIEGEARPQPDIKIGYLPQEPQLNPEHTVRESIEEAVSEVVNALKRLDEVYALYADPDADFDKLAAEQGRLEEIIQAHDGHNLNVQLERAADALRLPDWDAKIANLSGGERRRVALCRLLLEKPDMLLLDEPTNHLDAESVAWLERFLHDFEGTVVAITHDRYFLDNVAGWILELDRGEGIPWEGNYSSWLEQKDQRLAQEASQEAARRKSIEKELEWVRQGTKGRQSKGKARLARFEELNSTEYQKRNETNELFIPPGPRLGDKVLEVSNLRKSYGDRLLIDSLSFSIPKGAIVGIIGPNGAGKSTLFRMISGQEQPDSGTITLGETVKLASVDQFRDSMDNSKTVWEEVSGGLDIMKIGNTEMPSRAYVGRFNFKGVDQGKRVGELSGGERGRLHLAKLLQVGGNMLLLDEPTNDLDIETLRALENALLEFPGCAMVISHDRWFLDRIATHILDYQDEGKVEFFEGNFTEYEEYKKRTLGADALEPKRIKYKRIAK

SEQ ID NO: 183 - DNA, 1938 bp, Escherichia coli
gtggaaaaagccaaacacgttacctggcggctgttggctgtcggtgtctgtctgctgacggtcagcagcgtggcgcgagccgactcactggatgagcagcgtagtcgttacgcgcaaatcaagcaggcctgggataatcgacaaatggatgtggtcgaacaaatgatgcctggactgaaagattacccactttatccctacctggaataccgccagatcactgatgacctgatgaatcaaccggcggtgacggtcactaactttgttcgcgctaaccccacgcttcctcccgctcgcacgctgcaatctcgtttcgtcaatgaactggcgcggcgtgaagactggcgtggcttgttagcctttagcccggaaaagcccggaactaccgaagcgcaatgtaattactactatgcgaaatggaacaccgggcagagtgaagaagcctggcaaggggcgaaagagctgtggctaaccggcaagagccagcctaacgcctgtgacaagttatttagcgtctggcgtgcgtcaggtaaacaagatccgctggcgtatttagagcgtatccgtctggcgatgaaagcgggtaacaccggcctggtaacagtgctggcagggcagatgcctgccgattaccagactatcgcttcggcaatcatttcactggcgaacaaccctaatacggtactgaccttcgcgcgtacaaccggcgcgaccgattttacccgtcaaatggcggcggtggcgtttgccagtgtggcgcggcaggatgctgaaaatgcacggctgatgatcccgtcgcttgctcaggcacagcagcttaatgaagatcagattcaggagctgcgcgatattgtcgcatggcgtttgatgggcaacgatgtcaccgacgagcaggcgaaatggcgcgatgacgcgattatgcgttcgcaatctacttcgcttattgaacgccgtgtgcgaatggcgcttggcaccggcgatcgtcgcggcctgaatacctggctggcgcgtctgcctatggaagcgaaagagaaagatgaatggcgttactggcaggcggatttattgctggaacgcggacgtgaagctgaagcaaaagagattttgcatcaactcatgcaacagcgtggtttctacccgatggttgctgcacaacgcatcggcgaagagtatgagctgaagattgataaagcgccgcagaatgttgacagcgccctgactcaggggccggagatggcgcgcgtgcgcgagttgatgtactggaatctcgataacaccgcgcgtagcgagtgggccaatctggtgaagagcaagtcaaaaacagagcaggctcaactggctcggtatgctttcaataaccaatggtgggatcttagcgttcaggcaacgatcgccgggaagctgtgggatcatctggaagagcgattcccgctggcttacaacgatcttttcaaacgctacaccagtggtaaggagatcccgcaaagctatgcgatggcgattgcccgtcaggagagtgcctggaatccgaaagtgaaatcaccggtaggggccagcggcctgatgcagattatgcctggtaccgcgacccatacggtgaagatgttctctattcccggttatagcagccctgggcaattgctggatccggaaacaaacatcaacattggcaccagttacctgcaatatgtttatcagcagtttggcaataaccgtattttctcctcagcagcttataacgccgggccagggcgggtgcgaacctggcttggcaacagcgcagggcgtatcgacgcagtggcatttgtcgagagtattccattctccgagacgcgcggttatgtgaaaaacgtgctggcttatgacgcttactaccgctatttcatgggggataaaccgacgttgatgagcgccacggaatggggacgtcgttactga

SEQ ID NO: 184 - protein, 645 aa, Escherichia coli
MEKAKHVTWRLLAVGVCLLTVSSVARADSLDEQRSRYAQIKQAWDNRQMDVVEQMMPGLKDYPLYPYLEYRQITDDLMNQPAVTVTNFVRANPTLPPARTLQSRFVNELARREDWRGLLAFSPEKPGTTEAQCNYYYAKWNTGQSEEAWQGAKELWLTGKSQPNACDKLFSVWRASGKQDPLAYLERIRLAMKAGNTGLVTVLAGQMPADYQTIASAIISLANNPNTVLTFARTTGATDFTRQMAAVAFASVARQDAENARLMIPSLAQAQQLNEDQIQELRDIVAWRLMGNDVTDEQAKWRDDAIMRSQSTSLIERRVRMALGTGDRRGLNTWLARLPMEAKEKDEWRYWQADLLLERGREAEAKEILHQLMQQRGFYPMVAAQRIGEEYELKIDKAPQNVDSALTQGPEMARVRELMYWNLDNTARSEWANLVKSKSKTEQAQLARYAFNNQWWDLSVQATIAGKLWDHLEERFPLAYNDLFKRYTSGKEIPQSYAMAIARQESAWNPKVKSPVGASGLMQIMPGTATHTVKMFSIPGYSSPGQLLDPETNINIGTSYLQYVYQQFGNNRIFSSAAYNAGPGRVRTWLGNSAGRIDAVAFVESIPFSETRGYVKNVLAYDAYYRYFMGDKPTLMSATEWGRRY

SEQ ID NO: 185 - DNA, 327 bp, Escherichia coli
atggcccaacaatcaccctattcagcagcgatggcagaacagcgtcaccaggagtggttacgttttgtcgacctgcttaagaatgcctaccaaaacgatctccatttaccgttgttaaacctgatgctgacgccagatgagcgcgaagcgttggggactcgcgtgcgtattgtcgaagagctgttgcgcggcgaaatgagccagcgtgagttaaaaaatgaactcggcgcgggcatcgcgacgattacgcgtggatctaatagtctgaaagccgcgcccgtcgagctgcgccagtggctggaagacgtgttgctgaaaagcgattga

SEQ ID NO: 186 - protein, 108 aa, Escherichia coli [sequence omitted]

SEQ ID NO: 187 - DNA, 537 bp, Escherichia coli
atgctgattatgcaccaagttgtctgtgcgaccaccaatcccgctaaaattcaggccattctgcaggcatttcacgagatcttcggcgaaggatcctgccatattgcatccgttgccgtcgagagcggtgtaccggaacagccctttggcagtgaggaaacgcgcgctggcgcacgaaatagggtagccaatgcccgccgtttacttcctgaggctgatttttgggtggcgattgaagctggcatcgatggtgacagcactttcagttgggtggtgattgaaaacaccagccagcgcggcgaggcgcgttcggctactttgccgttgcctgcggtgattctggaaaaagtgcgtgaaggtgaggcgcttggtcccgtgatgtcgcgttataccggtattgatgagattggtcgtaaggaaggggcgatcggcgtgtttaccgccgggaaactcactcgcaccagcgtctatcaccaggcggtgatcctggcgctgagtccgtttcataatgccgtgtatcagccattgcaggcctga

SEQ ID NO: 188 - protein, 178 aa, Escherichia coli
MLIMHQVVCATTNPAKIQAILQAFHEIFGEGSCHIASVAVESGVPEQPFGSEETRAGARNRVANARRLLPEADFWVAIEAGIDGDSTFSWVVIENTSQRGEARSATLPLPAVILEKVREGEALGPVMSRYTGIDEIGRKEGAIGVFTAGKLTRTSVYHQAVILALSPFHNAVYQPLQA

SEQ ID NO: 189 - DNA, 648 bp, Escherichia coli
atgttacaggtatacctagtccgccacggtgaaacgcagtggaacgccgagcgacgtattcagggccagtctgacagcccgctgaccgccaaaggtgagcaacaggcgatgcaggtggcaacccgtgccaaagagcttggcattacgcatatcatcagtagcgatttaggacggacccggcgcacggcggaaatcatcgcccaggcctgcggctgtgacatcatctttgattctcgcctgcgtgaattaaatatgggtgtactggaaacaagaaatatcgattcactcaccgaagaagaagagaactggcgtcggcagctggtcaatggcaccgttgacgggcgtattcctgaaggcgagtcaatgcaggagctcagcgatcgcgttaatgcggcactggaatcttgccgggacttaccgcagggaagccgaccgctactggtgagccatggtattgcactgggatgcctggtgagtacgattctcggattaccagcatgggcagagcgccgcttacgtctgcgtaactgttctatttcgcgcgtggattatcaggaaagcttgtggctggcgtctggctgggtggttgaaaccgcaggggacatctcgcatctggacgcccctgcattagatgagctgcagcgttaa

SEQ ID NO: 190 - protein, 215 aa, Escherichia coli
MLQVYLVRHGETQWNAERRIQGQSDSPLTAKGEQQAMQVATRAKELGITHIISSDLGRTRRTAEIIAQACGCDIIFDSRLRELNMGVLETRNIDSLTEEEENWRRQLVNGTVDGRIPEGESMQELSDRVNAALESCRDLPQGSRPLLVSHGIALGCLVSTILGLPAWAERRLRLRNCSISRVDYQESLWLASGWVVETAGDISHLDAPALDELQR

SEQ ID NO: 191 - DNA, 870 bp, Escherichia coli
atggatcaggccggcattattcgcgaccttttaatctggctggaaggtcatctggatcatcccctgtcgctcgacaatgtagcggcgaaagcaggttattccaagtggcacttacagagaatgtttaaagatgtcactggccatgctattggcgcgtatattcgtgctcgtcgtttgtcgaaatcggcggtcgcactacgcctgactgcgcgtccgattctggacatcgcgctgcaataccgcttcgactctcaacagacatttacccgcgctttcaagaagcagtttgcccagactcctgcactttaccgccgttctcctgaatggagcgcctttggtattcgcccgccgctgcgtctgggtgaattcactatgccagagcacaaatttgtcaccctggaagatacgccgctgattggtgttacccagagctactcctgttcgctggagcaaatctctgatttccgccatgaaatgcgctaccagttctggcacgattttctcggcaactcgccaaccattccaccagtgctttacggtttgaacgaaacacgtccgagccaggataaagacgacgaacaagaggtgttctacaccaccgcgttagctcaggatcaggcagatggctatgtactgactgggcatccggtgatgttgcagggcggcgaatatgtgatgtttacctatgaaggtctgggaaccggcgtgcaggagtttatcctgacggtatacggaacgtgcatgccaatgcttaacttgacgcgccgtaaaggtcaggatattgagcgatactacccggcagaagatgccaaagcgggagatcgcccaattaatctgcgctgtgaactgctgattccgatccgtcgttaa

SEQ ID NO: 192 - protein, 289 aa, Escherichia coli
MDQAGIIRDLLIWLEGHLDHPLSLDNVAAKAGYSKWHLQRMFKDVTGHAIGAYIRARRLSKSAVALRLTARPILDIALQYRFDSQQTFTRAFKKQFAQTPALYRRSPEWSAFGIRPPLRLGEFTMPEHKFVTLEDTPLIGVTQSYSCSLEQISDFRHEMRYQFWHDFLGNSPTIPPVLYGLNETRPSQDKDDEQEVFYTTALAQDQADGYVLTGHPVMLQGGEYVMFTYEGLGTGVQEFILTVYGTCMPMLNLTRRKGQDIERYYPAEDAKAGDRPINLRCELLIPIRR

SEQ ID NO: 193 - DNA, 474 bp, Escherichia coli
atgaaatacaagcatttaatcctgtctttaagcctgataatgctggggccattggctcatgcagaagagattggttcggtcgacaccgtatttaaaatgatcggcccggatcacaaaattgttgttgaagcctttgacgatcccgatgtgaaaaatgtcacctgttatgtgagccgggcgaaaaccggtggtattaaagggggattgggcctggcagaagatacctccgatgcggccatttcttgtcaacaagtcgggccgattgaattgtcggatcgtattaaaaacggcaaagctcagggcgaggtagtattcaaaaaacgcacgtccctggtctttaagtcgttacaggtcgtgcgcttttatgacgctaaacgcaacgcgctcgcttatctggcttactccgacaaagttgtagaaggttcgccgaaaaacgcgattagcgcggttcctgtcatgccgtggcggcaataa

SEQ ID NO: 194 - protein, 157 aa, Escherichia coli
MKYKHLILSLSLIMLGPLAHAEEIGSVDTVFKMIGPDHKIVVEAFDDPDVKNVTCYVSRAKTGGIKGGLGLAEDTSDAAISCQQVGPIELSDRIKNGKAQGEVVFKKRTSLVFKSLQVVRFYDAKRNALAYLAYSDKVVEGSPKNAISAVPVMPWRQ

SEQ ID NO: 195 - DNA, 690 bp, Escherichia coli
atgcaacgggaaacggtctggttagtcgaagacgagcaagggatagccgatacgctggtctacatgttgcaacaggaaggttttgacgtcgaggtctttgagcgaggcttgccagtgctggataaagctcgccagcaggttcccgatgtcatgattctcgatgttggtttgcctgatatcagcggctttgaattgtgccgccagttactggcgctccatccggcgttacctgtactgttcctgacggcccgaagtgaagaggtcgatcgcctgcttgggctggaaattggcgctgacgactacgtggctaaaccgttttcacctcgcgaagtgtgcgccagagtgcgcaccttactgcgtcgggtgaagaagttctcgactccgtctcccgttatccgtattggtcattttgaattgaatgaacctgcggcgcagatcagctggtttgacacgccattaacgctgacgcggtatgagtttttattgctgaagacgttactcaagtcgccgggccgcgtctggtcccgccagcaactgatggatagcgtgtgggaagatgcgcaggacacctacgatcgcaccgtcgatacccacattaaaacgctgcgtgccaagctgcgcgccatcaaccccgatctttcaccgattaatactcatcgcggcatgggatatagcctgaggggcctgtaa

SEQ ID NO: 196 - protein, 229 aa, Escherichia coli
MQRETVWLVEDEQGIADTLVYMLQQEGFDVEVFERGLPVLDKARQQVPDVMILDVGLPDISGFELCRQLLALHPALPVLFLTARSEEVDRLLGLEIGADDYVAKPFSPREVCARVRTLLRRVKKFSTPSPVIRIGHFELNEPAAQISWFDTPLTLTRYEFLLLKTLLKSPGRVWSRQQLMDSVWEDAQDTYDRTVDTHIKTLRAKLRAINPDLSPINTHRGMGYSLRGL

SEQ ID NO: 197 - DNA, 1425 bp, Escherichia coli
atgcgtatcggcatgcggttgttgctgggctattttttactggtggcggtggcggcctggttcgtactggctatttttgtcaaagaagttaaaccgggcgtgcgaagagcaaccgaggggacgttaatcgacaccgcaacgttgctggcggagctggcgcgtcccgatttgctctctggggacccaacgcatgggcaactggcgcaggcgtttaatcagctacaacatcgcccgtttcgcgccaatatcggtggcattaacaaagtgcgcaacgaatatcatgtctatatgaccgatgcgcagggcaaagtattgttcgattcggcaaataaagccgttggacaggattattcgcgctggaatgacgtctggctaacgttgcgtggtcagtatggtgcgcgcagcacgttgcaaaatcctgccgatcccgaaagttctgtgatgtatgttgccgcgccgattatggacggctcgcggcttattggcgttttgagcgtaggcaaaccgaacgcggcgatggctccggtcattaagcgtagcgagcggcgaattttatgggccagcgccattttgttggggattgcactggtgattggcgcaggcatggtttggtggatcaaccgctctattgccaggctcactcgctatgctgattccgtcactgacaataagcccgttcctctccccgatctcggtagtagcgagttgcgtaaactcgcgcaggcgctggaaagtatgcgcgtgaagctggaagggaaaaactatattgagcagtatgtttatgcgttaactcatgagctaaaaagcccactggcggcgattcgtggcgcggcggaaattttacgcgaaggtccgccgccggaagtggtggctcgttttaccgacaacattctgacgcaaaatgcgcgaatgcaggcactggtggaaacgttactacgccaggcaagactggagaatcgtcaggaagtcgttctgactgctgttgatgtggcggcattatttcgccgcgtcagcgaagcgcgcaccgtgcagttggcagaaaaaaacatcactttgcatgttatgcctactgaggttaacgttgcttctgaaccggcgttactggagcaggcgctggggaatttactggataacgccatcgattttactcccgagagcggttgcataacgctaagcgccgaagtggatcaggaatacgtcacccttaaggtgctggataccggtagtgggattcctgactacgcgctgtcacgtatttttgaacgcttttactctttgccgcgtgcaaatgggcaaaaaagcagcggtctggggttggcgtttgtcagtgaggtcgcccgtttgtttaacggcgaagtcacgctgcgcaacgtgcaggaaggtggcgtgctggcctcgcttcgacttcaccgtcacttcacatag

SEQ ID NO: 198 - protein, 474 aa, Escherichia coli
MRIGMRLLLGYFLLVAVAAWFVLAIFVKEVKPGVRRATEGTLIDTATLLAELARPDLLSGDPTHGQLAQAFNQLQHRPFRANIGGINKVRNEYHVYMTDAQGKVLFDSANKAVGQDYSRWNDVWLTLRGQYGARSTLQNPADPESSVMYVAAPIMDGSRLIGVLSVGKPNAAMAPVIKRSERRILWASAILLGIALVIGAGMVWWINRSIARLTRYADSVTDNKPVPLPDLGSSELRKLAQALESMRVKLEGKNYIEQYVYALTHELKSPLAAIRGAAEILREGPPPEVVARFTDNILTQNARMQALVETLLRQARLENRQEVVLTAVDVAALFRRVSEARTVQLAEKNITLHVMPTEVNVASEPALLEQALGNLLDNAIDFTPESGCITLSAEVDQEYVTLKVLDTGSGIPDYALSRIFERFYSLPRANGQKSSGLGLAFVSEVARLFNGEVTLRNVQEGGVLASLRLHRHFT

SEQ ID NO: 199 - DNA, 1353 bp, Escherichia coli
atgttgaaatcccccctgttctggaaaatgaccaccttgtttggtgcagtattgctgttgttgattccgataatgctgattcggcaggtgattgtcgaacgtgccgattaccgtagcgatgtggaagatgtgattcgccaaagtaccagcgggccgcaaaaactcgttgggccgctcatcgctattcctgtgaccgagctttatacggtgcaggaagacgataaaaccgtggagcggaaacgaagttttattcatttttggttacctgagtcattgatggttgatggcaatcagaatgtggaagaacgcaagataggcatctataccggtcaggtctggcacagtgatttaacgctaaaagccgatttcgatgtttcgcgtcttagcgaactcgacgcgccaaatatcaccttaggcaagccatttattgtgattagcgtcggggatgcgcgtggtattggtgtggtgaaagcgcctgaagttaacggtacggcgctgaccattgaacccggcaccgggttagagcaaggcgggcagggcgtgcatatccctttacccgaaggggactggcgcaagcagaacctgaagctgaatgtggcgctgaatttaagcggtaccggcgatctttctgtggtgcctggcgggcgttatagcgaaatgaccttaaccagcaactggccgcatcccagttttttaggtgattttctaccagccaaacgggaagttagcgagtcaggttttcaggcgcaatggcaaagtagctggtttgctaataatctcggtgagcgttttgcttcaggcaatgataccggctgggaaaacttccccgcgtttagcgtcgcagtgacgacgccagccgatcaataccaattaacggaccgggcgactaagtacgccattctgctgattgcgctgacttttatggcattctttgtttttgaaacgctcaccgcgcaacgtttacacccaatgcaatatttgctggtggggctttcattggtgatgttttatttgctcttgctggcgctttctgaacataccggttttaccgtggcatggataatcgccagtctgattggggcgttaatgaacggtatttatttgcaggcggtattgaaaggctggcgtaatagcatgttgtttaccctcgcgctgttgttgctggatggtgtgatgtggggactgctcaactctgccgatagcgcgctgttgttgggaaccagtgtgctggtggtggcgctggccggcatgatgtttgtgacccgtaatatcgactggtatgcgttttcactgccgaaaatgaaagccagtaaagaagttaccatggacgatgaattacgtatctggaaataa

SEQ ID NO: 200 - protein, 450 aa, Escherichia coli
MLKSPLFWKMTTLFGAVLLLLIPIMLIRQVIVERADYRSDVEDVIRQSTSGPQKLVGPLIAIPVTELYTVQEDDKTVERKRSFIHFWLPESLMVDGNQNVEERKIGIYTGQVWHSDLTLKADFDVSRLSELDAPNITLGKPFIVISVGDARGIGVVKAPEVNGTALTIEPGTGLEQGGQGVHIPLPEGDWRKQNLKLNVALNLSGTGDLSVVPGGRYSEMTLTSNWPHPSFLGDFLPAKREVSESGFQAQWQSSWFANNLGERFASGNDTGWENFPAFSVAVTTPADQYQLTDRATKYAILLIALTFMAFFVFETLTAQRLHPMQYLLVGLSLVMFYLLLLALSEHTGFTVAWIIASLIGALMNGIYLQAVLKGWRNSMLFTLALLLLDGVMWGLLNSADSALLLGTSVLVVALAGMMFVTRNIDWYAFSLPKMKASKEVTMDDELRIWK

SEQ ID NO: 201 - DNA, 717 bp, Escherichia coli
atgcagaccccgcacattcttatcgttgaagacgagttggtaacacgcaacacgttgaaaagtattttcgaagcggaaggctatgatgttttcgaagcgacagatggcgcggaaatgcatcagatcctctctgaatatgacatcaacctggtgatcatggatatcaatctgccgggtaagaacggtcttctgttagcgcgtgaactgcgcgagcaggcgaatgttgcgttgatgttcctgactggccgtgacaacgaagtcgataaaattctcggcctcgaaatcggtgcagatgactacatcaccaaaccgttcaacccgcgtgaactgactattcgtgcacgcaacctgctgtcccgtaccatgaatctgggtactgtcagcgaagaacgtcgtagcgttgaaagctacaagttcaatggttgggaactggacatcaacagccgttcgttgatcggccctgatggcgagcagtacaagctgccgcgcagcgagttccgcgccatgcttcacttctgtgaaaacccaggcaaaattcagtcccgtgctgaactgctgaagaaaatgaccggccgtgagctgaaaccgcacgaccgtactgtagatgtgacgatccgccgtattcgtaaacatttcgaatctacgccggatacgccggaaatcatcgccaccattcacggtgaaggttatcgcttctgcggtgatctggaagattaa

SEQ ID NO: 202 - protein, 238 aa, Escherichia coli
MQTPHILIVEDELVTRNTLKSIFEAEGYDVFEATDGAEMHQILSEYDINLVIMDINLPGKNGLLLARELREQANVALMFLTGRDNEVDKILGLEIGADDYITKPFNPRELTIRARNLLSRTMNLGTVSEERRSVESYKFNGWELDINSRSLIGPDGEQYKLPRSEFRAMLHFCENPGKIQSRAELLKKMTGRELKPHDRTVDVTIRRIRKHFESTPDTPEIIATIHGEGYRFCGDLED

SEQ ID NO: 203 - DNA, 687 bp, Escherichia coli
atgcgtataacgattattctggttgcacccgccagagcagaaaatattggggcagcggcgcgggcaatgaaaacgatgggttttagcgaactgcggattgttgatagtcaggcacacttggagccagtcgcccgttgggtcgcacatggatctggtgatattattgataatattaaagttttcaagacactagctgaatcgttacacgatgtcgatttcactgttgccaccactgcgcgcagtcgggcgaaatatcattactacgctacgccagtagaactggtgccgctgttagaggaaaaatcttcatggatgagccatgccgctctggtgtttggtcgcgaagattccgggctgactaacgaagagttagcgttggctgacgttcttactggtgtgccgatggtggcggattatccttcgctcaatctggggcaggcagtgatggtctattgctatcaattagcaacattaatacaacaaccggcgaaaagtgacacaacggcagaccaacatcaactgcaagctttacgcgaacgagccatgacattgctgacgactctggcagtggcagatgacataaaactggtcgactggttacaacaacgcctggggcttttagagcaacgagacacggcaatgttgcaccgtttgctgcatgatattgaaaaaaatatcaccaaataa

SEQ ID NO: 204 - protein, 228 aa, Escherichia coli
MRITIILVAPARAENIGAAARAMKTMGFSELRIVDSQAHLEPVARWVAHGSGDIIDNIKVFKTLAESLHDVDFTVATTARSRAKYHYYATPVELVPLLEEKSSWMSHAALVFGREDSGLTNEELALADVLTGVPMVADYPSLNLGQAVMVYCYQLATLIQQPAKSDTTADQHQLQALRERAMTLLTTLAVADDIKLVDWLQQRLGLLEQRDTAMLHRLLHDIEKNITK

SEQ ID NO: 205 - DNA, 2505 bp, Escherichia coli
gtgcgggcttttttttcgaccaaaggtaacgaggtaacaaccatgcgagtgttgaagttcggcggtacatcagtggcaaatgcagaacgttttctgcgggttgccgatattctggaaagcaatgccaggcaggggcaggtggcgaccgtcctctctgcccccgccaaaattaccaaccatctggtagcgatgattgaaaaaaccattagcggccaagatgctttacccaatatcagcgatgccgaacgtatttttgccgaacttctgacgggactcgccgccgcccagccgggatttccgctggcacaattgaaaactttcgtcgaccaggaatttgcccaaataaaacatgtcctgcatggcattagtttgttggggcagtgcccggatagcatcaacgctgcgctgatttgccgtggcgagaaaatgtcgatcgccattatggccggcgtgttagaagcgcgtggtcacaacgttaccgttatcgatccggtcgaaaaactgcttgcagtggggcattacctcgaatctaccgttgatattgctgagtccacccgccgtattgcggcaagccgcattccggctgaccacatggtgctgatggctggtttcactgccggtaatgaaaaaggcgagctggtggttctgggacgcaacggttccgactactccgctgcggtgctggcggcctgtttacgcgccgattgttgcgagatctggacggatgttgacggtgtttatacctgcgatccgcgtcaggtgcccgatgcgaggttgttgaagtcgatgtcctatcaggaagcgatggagctttcttacttcggcgctaaagttcttcacccccgcaccatcacccccatcgcccagtttcagatcccttgcctgattaaaaataccggaaatcctcaagctccaggtacgctcattggtgccagccgtgatgaagacgaattaccggtcaagggcatttccaatctgaataacatggcaatgttcagcgtttccggcccggggatgaaagggatggttggcatggcggcgcgcgtctttgcagcgatgtcacgcgcccgtatttccgtggtgctgattacgcaatcatcttccgaatacagtatcagtttctgcgttccgcaaagcgactgtgtgcgagctgaacgggcaatgcaggaagagttctacctggaactgaaagaaggcttactggagccgttggcggtgacggaacggctggccattatctcggtggtaggtgatggtatgcgcaccttacgtgggatctcggcgaaattctttgccgcgctggcccgcgccaatatcaacattgtcgccattgctcagggatcttctgaacgctcaatctctgtcgtggtcaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggttgaagaataaacatatcgacttacgtgtctgcggtgttgctaactcgaaggcactgctcaccaatgtacatggccttaatctggaaaactggcaggaagaactggcgcaagccaaagagccgtttaatctcgggcgcttaattcgcctcgtgaaagaatatcatctgctgaacccggtcattgttgactgtacttccagccaggcagtggcggatcaatatgccgacttcctgcgcgaaggtttccacgttgttacgccgaacaaaaaggccaacacctcgtcgatggattactaccatcagttgcgttatgcggcggaaaaatcgcggcgtaaattcctctatgacaccaacgttggggctggattaccggttatcgagaacctgcaaaatctgctcaatgctggtgatgaattgatgaagttctccggcattctttcaggttcgctttcttatatcttcggcaagttagacgaaggcatgagtttctccgaggcgaccacactggcgcgggaaatgggttataccgaaccggacccgcgagatgatctttctggtatggatgtggcgcgtaagctattgattctcgctcgtgaaacgggacgtgaactggagctggcggatattgaaattgaacctgtgctgcccgcagagtttaacgccgagggtgatgtcgccgcttttatggcgaatctgtcacagctcgacgatctctttgccgcgcgtgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctga

SEQ ID NO: 206 - protein, 834 aa, Escherichia coli
MRAFFSTKGNEVTTMRVLKFGGTSVANAERFLRVADILESNARQGQVATVLSAPAKITNHLVAMIEKTISGQDALPNISDAERIFAELLTGLAAAQPGFPLAQLKTFVDQEFAQIKHVLHGISLLGQCPDSINAALICRGEKMSIAIMAGVLEARGHNVTVIDPVEKLLAVGHYLESTVDIAESTRRIAASRIPADHMVLMAGFTAGNEKGELVVLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASRDEDELPVKGISNLNNMAMFSVSGPGMKGMVGMAARVFAAMSRARISVVLITQSSSEYSISFCVPQSDCVRAERAMQEEFYLELKEGLLEPLAVTERLAIISVVGDGMRTLRGISAKFFAALARANINIVAIAQGSSERSISVVVNNDDATTGVRVTHQMLFNTDQVIEVFVIGVGGVGGALLEQLKRQQSWLKNKHIDLRVCGVANSKALLTNVHGLNLENWQEELAQAKEPFNLGRLIRLVKEYHLLNPVIVDCTSSQAVADQYADFLREGFHVVTPNKKANTSSMDYYHQLRYAAEKSRRKFLYDTNVGAGLPVIENLQNLLNAGDELMKFSGILSGSLSYIFGKLDEGMSFSEATTLAREMGYTEPDPRDDLSGMDVARKLLILARETGRELELADIEIEPVLPAEFNAEGDVAAFMANLSQLDDLFAARVAKARDEGKVLRYVGNIDEDGVCRVKIAEVDGNDPLFKVKNGENALAFYSHYYQPLPLVLRGYGAGNDVTAAGVFADLLRTLSWKLGV

SEQ ID NO: 207 - DNA, 933 bp, Escherichia coli
atggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagagccacgggaaaatatcgtttatcagtgctgggagcgtttttgccaggagcttggcaagcaaattccagtggcgatgactctggaaaagaatatgccgatcggttcgggcttaggctccagcgcctgttcagtggtcgcggcgctgatggcgatgaatgaacactgcggcaagccgcttaatgacactcgtttgctggctttgatgggcgagttggaagggcgtatctccggcagcattcattacgacaacgtggcaccgtgttttcttggtggtatgcagttgatgattgaagaaaacgacatcatcagtcagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggttgcggaaatcggcgcggtagcgagcggtatctccggctccggcccgactttgttcgctctgtgtgacaagccggataccgcccagcgcgttgccgactggttgggtaaaaactacctgcaaaatcaggaaggttttgttcatatttgccggctggatacggcgggcgcacgagtactggaaaactaa

SEQ ID NO: 208 - protein, 310 aa, Escherichia coli
MVKVYAPASSANMSVGFDVLGAAVTPVDGALLGDVVTVEAAETFSLNNLGRFADKLPSEPRENIVYQCWERFCQELGKQIPVAMTLEKNMPIGSGLGSSACSVVAALMAMNEHCGKPLNDTRLLALMGELEGRISGSIHYDNVAPCFLGGMQLMIEENDIISQQVPGFDEWLWVLAYPGIKVSTAEARAILPAQYRRQDCIAHGRHLAGFIHACYSRQPELAAKLMKDVIAEPYRERLLPGFRQARQAVAEIGAVASGISGSGPTLFALCDKPDTAQRVADWLGKNYLQNQEGFVHICRLDTAGARVLEN

SEQ ID NO: 209 - DNA, 1221 bp, Escherichia coli
ttgggcaaaaatcaggggctgtttttcccgcacgacctgccggaattcagcctgactgaaattgatgagatgctgaagctggattttgtcacccgcagtgcgaagatcctctcggcgtttattggtgatgaaatcccgcaggaaatcctggaagagcgcgtacgcgcggcgtttgccttcccggctccggtcgccaatgttgaaagcgatgtcggttgtctggaattgttccacgggccaacgctggcatttaaagatttcggcggtcgctttatggcacaaatactgacccatattgcgggcgataagccagtgaccattctgaccgcgacatccggtgatactggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctggggctaaactctgctaactccattaacatcagccgtttgctggcgcagatttgctactactttgaagctgttgcgcagctgccgcaggaagcgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaatgcgatggatgttagccagccaaacaactggccgcgtgtggaagagttgttccgccgcaaaatctggcaactgaaagagctggggtatgcagccgtggatgatgaaaccacgcaacagacaatgcgtgagttaaaagaactgggctatacctcggagccgcacgctgccgtagcttatcgtgcgctgcgtgaccagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcgcataacctgcccgccgattttgctgcgttgcgtaaattgatgatgaatcatcagtaa

SEQ ID NO: 210 - protein, 406 aa, Escherichia coli
MGKNQGLFFPHDLPEFSLTEIDEMLKLDFVTRSAKILSAFIGDEIPQEILEERVRAAFAFPAPVANVESDVGCLELFHGPTLAFKDFGGRFMAQILTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEAILGETLDLPKELAERADLPLLSHNLPADFAALRKLMMNHQ

SEQ ID NO: 211 - DNA, 249 bp, Escherichia coli
atgccggatggtaatccggcattgatatttagcgatgatgtttgtccggctccggacgatgatcgccacgatgatcattgtgcttgttatggcgcggcgatggcggcggtccatatgggtgccagcgattgcctcgccattcataatgttgtttccaccagccgtggtcgcgccagtgaccgccatcccagtaatagccacgattatcacgatcgcctatctgtaattttactgacgggactagcgtaa

SEQ ID NO: 212 - protein, 82 aa, Escherichia coli
MPDGNPALIFSDDVCPAPDDDRHDDHCACYGAAMAAVHMGASDCLAIHNVVSTSRGRASDRHPSNSHDYHDRLSVILLTGLA

SEQ ID NO: 213 - DNA, 288 bp, Escherichia coli
atgcaatctatcgtactcgcactttccctggttctggtcgctcccatggcagcgcaggctgcggaaattacgctagtcccgtcagtaaaattacagataggcgatcgtgataatcgtggctattactgggatggcggtcactggcgcgaccacggctggtggaaacaacattatgaatggcgaggcaatcgctggcacccatatggaccgccgccatcgccgcgccataacaagcacaatgatcatcgtggcgatcatcgtccggagccggacaaacatcatcgctaa

SEQ ID NO: 214 - protein, 95 aa, Escherichia coli
MQSIVLALSLVLVAPMAAQAAEITLVPSVKLQIGDRDNRGYYWDGGHWRDHGWWKQHYEWRGNRWHPYGPPPSPRHNKHNDHRGDHRPEPDKHHR

SEQ ID NO: 215 - DNA, 777 bp, Escherichia coli
atgctgattcttatttcacctgcgaaaacgcttgattaccaaagcccgttgaccaccacgcgctatacgctgccggagctgttagacaacgcccagcagctgatccatgaagcgcggaaactgacgcccccgcagattagctccctgatgcgcatcagcgacaaactggcgggtatcaacgccgctcgctttcatgactggcagccaaatttcacaccggagaatgcccgccaggcaattctggcgtttaaaggtgatgtctacactggcttgcaggccgaaaccttcagcgaagacgatttcgattttgcccaacagcatttgcgaatgctttccggcttgtatggcgtactgcgcccgctcgatttaatgcagccttatcgtctggaaatggggatacgtcttgagaatgcccgagggaaagatctgtatcaattctggggagatatcatcaccaacaagctgaacgaggcgctcgcagcacaaggcgataatgtggtgataaatctggcgtcagatgagtattttaaatcggtgaagccgaagaaattgaatgccgagattatcaagccagtgttcctcgatgagaagaacggcaaatttaagataatcagcttctacgctaagaaagcacgcggtctgatgagtcgtttcattattgaaaatcggctgaccaaaccagagcaactgactggttttaatagcgaaggttacttctttgatgaagcttcctccagcaatggcgaactggtgtttaaacgctacgagcagcgttaa

SEQ ID NO: 216 - protein, 258 aa, Escherichia coli
MLILISPAKTLDYQSPLTTTRYTLPELLDNAQQLIHEARKLTPPQISSLMRISDKLAGINAARFHDWQPNFTPENARQAILAFKGDVYTGLQAETFSEDDFDFAQQHLRMLSGLYGVLRPLDLMQPYRLEMGIRLENARGKDLYQFWGDIITNKLNEALAAQGDNVVINLASDEYFKSVKPKKLNAEIIKPVFLDEKNGKFKIISFYAKKARGLMSRFIIENRLTKPEQLTGFNSEGYFFDEASSSNGELVFKRYEQR

SEQ ID NO: 217 - DNA, 1431 bp, Escherichia coli
atgccagattttttctcctttattaacagcgtcctttggggatcggtaatgatttacctgctcttcggcgcaggttgttggttcacttttcgcaccggatttgtgcagtttcgctacatccgccagtttggcaaaagtcttaaaaatagcattcatccacagccaggcggtttaacctcatttcagtcattgtgtaccagtcttgcagcgcgcgtgggtagcggcaacctggccggcgttgcgctggcaattaccgccggtggacctggagccgtcttctggatgtgggttgccgcatttatcggcatggcgacctcgtttgccgaatgttccctcgcacagctttataaagaacgtgatgccaatgggcagtttcgtggcggaccggcatggtatatggcgcgcgggctggggatgcgctggatgggcgttctgttcgccgtctttttgctcatcgcctacgccataattttcagcggagttcaggcgaacgccgttgcgcgagctctgagtttttcttttgattttcccccgctggtaacaggtattattctcgctgtctttgctctgctggcgatcactcgcggtcttcatggcgtcgcccggctcatgcaggggtttgtcccgttgatggcgataatctgggtactgacctgcctggtgatttgcgtaatgaatatcgggcaacttccccacgtcatttggtctatttttgagagtgcttttggctggcaggaagctgcaggcggcgcggcgggatataccttaagccaggcgattactaacggttttcagcgcagtatgttttccaatgaggcgggaatggggtcgacgccaaacgcggcagcggcagctgcgtcctggcctccgcatccggcagcgcaaggaattgtccagatgattggcatttttatcgacaccctggtcatctgcacggcaagcgccatgctgatattactggcgggtaacggcacaacctacatgccgctggaaggtattcagcttatccagaaggcgatgcgggtgctaatgggttcctggggtgcggagtttgttaccctcgtggttattctgtttgccttcagctccatcgttaccaactacatttatgccgaaaacaatctcttctttttacgcctgaacaaccctaaagcgatctggtgtctgcggatctgcaccttcgcaacggtcatcggcggcaccttgctaagtcttccgctgatgtggcaactggcagatatcattatggcctgcatggctattaccaatttgaccgccatattactgctctcgcctgtggttcataccattgccagtgattatctacgccagcgtaaactcggcgtgcgtccggtgtttgatccgttgcgttatccggagatcggtcgccagctttctccagacgcgtgggatgatgtttcgcaggagtaa

SEQ ID NO: 218 - protein, 476 aa, Escherichia coli
MPDFFSFINSVLWGSVMIYLLFGAGCWFTFRTGFVQFRYIRQFGKSLKNSIHPQPGGLTSFQSLCTSLAARVGSGNLAGVALAITAGGPGAVFWMWVAAFIGMATSFAECSLAQLYKERDANGQFRGGPAWYMARGLGMRWMGVLFAVFLLIAYAIIFSGVQANAVARALSFSFDFPPLVTGIILAVFALLAITRGLHGVARLMQGFVPLMAIIWVLTCLVICVMNIGQLPHVIWSIFESAFGWQEAAGGAAGYTLSQAITNGFQRSMFSNEAGMGSTPNAAAAAASWPPHPAAQGIVQMIGIFIDTLVICTASAMLILLAGNGTTYMPLEGIQLIQKAMRVLMGSWGAEFVTLVVILFAFSSIVTNYIYAENNLFFLRLNNPKAIWCLRICTFATVIGGTLLSLPLMWQLADIIMACMAITNLTAILLLSPVVHTIASDYLRQRKLGVRPVFDPLRYPEIGRQLSPDAWDDVSQE

SEQ ID NO: 219 - DNA, 1017 bp, Escherichia coli
gtgatatcatcagggcagaccggttacatccccctaacaagctgtttaaagagaaatactatcatgacggacaaattgacctcccttcgtcagtacaccaccgtagtggccgacactggggacatcgcggcaatgaagctgtatcaaccgcaggatgccacaaccaacccttctctcattcttaacgcagcgcagattccggaataccgtaagttgattgatgatgctgtcgcctgggcgaaacagcagagcaacgatcgcgcgcagcagatcgtggacgcgaccgacaaactggccgtaaatattggtctggaaatcctgaaactggttccgggccgtatctcaactgaagttgatgcgcgtctttcctatgacaccgaagcgtcaattgcgaaagcaaaacgcctgatcaaactctacaacgatgcaggtattagcaacgatcgtattctgatcaaactggcttctacctggcagggtatccgtgctgcggaacagctggaaaaagaaggcatcaactgtaacctgaccctgctgttctccttcgctcaggctcgtgcttgtgcggaagcgggcgtgttcctgatctcgccgtttgttggccgtattcttgactggtacaaagcgaataccgataagaaagagtacgctccggcagaagatccgggcgtggtttctgtatctgaaatctaccagtactacaaagagcatggttatgaaaccgtggttatgggcgcaagcttccgtaacatcggcgaaattctggaactggcaggctgcgaccgtctgaccatcgcaccggcactgctgaaagagctggcggagagcgaaggggctatcgaacgtaaactgtcttacactggtgaagtgaaagcgcgtccggcgcgtatcactgagtccgagttcctgtggcagcacaaccaggatccaatggcagtagataaactggcggaaggtatccgtaagtttgctgttgaccaggaaaaactggaaaaaatgatcggcgatctgctgtaa

SEQ ID NO: 220 - protein, 338 aa, Escherichia coli
MISSGQTGYIPLTSCLKRNTIMTDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAVDQEKLEKMIGDLL

SEQ ID NO: 221 - DNA, 591 bp, Escherichia coli
ttgatgaatactttacgtattggcttagtttccatctctgatcgcgcatccagcggcgtttatcaggataaaggcatccctgcgctggaagaatggctgacatcggcgctaaccacgccgtttgaactggaaacccgcttaatccccgatgagcaggcgatcatcgagcaaacgttgtgtgagctggtggatgaaatgagttgccatctggtgctcaccacgggcggaactggcccggcgcgtcgtgacgtaacgcccgatgcgacgctggcagtagcggaccgcgagatgccaggctttggtgaacagatgcgccagatcagcctgcattttgtactaactgcgatcctttcgcgtcaggtgggggtgattcgcaaacaggcgctgatccttaacttacccggtcaaccgaagtctattaaagagacgctggaaggtgtgaaggacgctgagggtaacgttgtggtgcacggtatttttgccagcgtaccgtactgcattcagttgctggaagggccatacgttgaaacggcaccggaagtggttgcagcattcagaccgaagagtgcaagacgcgaagttagcgaataa

SEQ ID NO: 222 - protein, 196 aa, Escherichia coli
MMNTLRIGLVSISDRASSGVYQDKGIPALEEWLTSALTTPFELETRLIPDEQAIIEQTLCELVDEMSCHLVLTTGGTGPARRDVTPDATLAVADREMPGFGEQMRQISLHFVLTAILSRQVGVIRKQALILNLPGQPKSIKETLEGVKDAEGNVVVHGIFASVPYCIQLLEGPYVETAPEVVAAFRPKSARREVSE

SEQ ID NO: 223 - DNA, 567 bp, Escherichia coli
atgggcaacactaagttggctaatccggcaccgctgggcctgatgggcttcggcatgaccaccattctgcttaacctgcacaacgtgggttattttgctctggacggtattattcttgccatgggcattttctacggcggcatcgcgcaaatttttgccggtctgctggagtacaaaaaaggcaacactttcggtttaaccgcattcacctcttacggttctttctggctgacgctggttgcaattctgctgatgccgaaactggggctgaccgatgcgccaaatgcacagttccttggtgtctacctgggtctgtggggcatatttacgctgtttatgttcttcggcacgctgaaaggcgcacgcgttctgcaattcgttttctttagcctgaccgtgctgtttgccctgctggcgatcggtaacattgccggtaacgccgcgatcatccactttgccggctggattggtcttatctgcggtgccagtgcaatctatctggcgatgggtgaagtgctgaacgagcagtttggtcgcaccgttctgccgattggtgagtctcactaa

SEQ ID NO: 224 - protein, 188 aa, Escherichia coli
MGNTKLANPAPLGLMGFGMTTILLNLHNVGYFALDGIILAMGIFYGGIAQIFAGLLEYKKGNTFGLTAFTSYGSFWLTLVAILLMPKLGLTDAPNAQFLGVYLGLWGIFTLFMFFGTLKGARVLQFVFFSLTVLFALLAIGNIAGNAAIIHFAGWIGLICGASAIYLAMGEVLNEQFGRTVLPIGESH

SEQ ID NO: 225 - DNA, 714 bp, Escherichia coli
atgaatgttaattacctgaatgattcagatctggattttctccagcattgtagtgaggaacagttggcaaatttcgcccggctgctcacccataatgaaaaaggcaaaactcgcctctccagcgtactgatgcgcaacgaactgtttaaatcgatggaaggacatcccgagcgacaccgccgcaactggcagctgattgccggagaattacagcattttggtggcgatagtatcgccaacaaactgcgcggacacggtaaattgtatcgcgccattttgctcgatgtttcaaagcgattgaagctgaaagccgacaaagagatgtctacgtttgaaattgagcaacagttactggaacaatttctgcgtaatacctggaagaaaatggacgaggaacataagcaggagtttctgcacgcggtcgatgccagggtgaatgagctggaagagctgctgccgctgctgatgaaagacaaattattggcaaaaggtgtgtcgcatttgctttccagccaattgacccgcattttacgcacccacgcagcaatgagcgtgcttgggcatggtttgctgcgcggcgcgggtctgggaggccctgtgggcgcagcattaaatggggttaaagcggtcagcggcagtgcctatcgcgtgacaattccagccgtactgcaaatcgcctgcctgcgccggatggttagcgccactcaggtctga

SEQ ID NO: 226 - protein, 237 aa, Escherichia coli
MNVNYLNDSDLDFLQHCSEEQLANFARLLTHNEKGKTRLSSVLMRNELFKSMEGHPERHRRNWQLIAGELQHFGGDSIANKLRGHGKLYRAILLDVSKRLKLKADKEMSTFEIEQQLLEQFLRNTWKKMDEEHKQEFLHAVDARVNELEELLPLLMKDKLLAKGVSHLLSSQLTRILRTHAAMSVLGHGLLRGAGLGGPVGAALNGVKAVSGSAYRVTIPAVLQIACLRRMVSATQV

SEQ ID NO: 227 - DNA, 405 bp, Escherichia coli
atgaaatccgttattacgatttccgccagcctggcgattagcctgatgctgtgctgcacggcgcaggcaaacgaccataaaatcctcggcgtcattgcaatgccgcgaaacgaaaccaacgatctggcgctgaaacttcctgtttgtcgcattgttaaacgcatacaactctcagccgaccatggcgatttgcagttaagcggtgcatcgatttatttcaaagccacccgaagcgccagtcagaccctgaatattccttcagaaataaaagaagagcaaaccactgactggatcaacattaacagcgataacgacaacaaacgctgcgtctcaaaaatcaccttttccggtcatacagtgaactcatcggatatggccacgctgaaaattatcggcgacgactaa

SEQ ID NO: 228 - protein, 134 aa, Escherichia coli
MKSVITISASLAISLMLCCTAQANDHKILGVIAMPRNETNDLALKLPVCRIVKRIQLSADHGDLQLSGASIYFKATRSASQTLNIPSEIKEEQTTDWININSDNDNKRCVSKITFSGHTVNSSDMATLKIIGDD

SEQ ID NO: 229 - DNA, 150 bp, Escherichia coli
ttgcagactcactcactgcggttgactactaaatggggtcgtaacccacgtcatcaagggggagatgcaaaaattttttgtgcttttgcgcagaaatttcgcgatatggcaggacaagacgtgaaactgacaacaattttattcatataa

SEQ ID NO: 230 - protein, 49 aa, Escherichia coli
MQTHSLRLTTKWGRNPRHQGGDAKIFCAFAQKFRDMAGQDVKLTTILFI

SEQ ID NO: 231 - DNA, 1917 bp, Escherichia coli
atgggtaaaataattggtatcgacctgggtactaccaactcttgtgtagcgattatggatggcaccactcctcgtgtactggagaacgccgaaggcgatcgcaccacgccttctatcattgcctatacccaggatggtgaaactctggttggtcagccggctaaacgtcaggcagtgacgaacccgcaaaacaccctgtttgcgattaaacgcctgattggccgccgcttccaggacgaagaagtacagcgtgatgtttccatcatgccgttcaaaattattgctgctgataacggcgacgcatgggtcgaagttaaaggccagaaaatggcaccgccgcagatctctgctgaagtgctgaaaaaaatgaagaaaaccgctgaagattacctgggtgaaccggtaactgaagctgttattaccgtaccggcatactttaacgatgctcagcgtcaggcaaccaaagacgcaggccgtatcgctggtctggaagtaaaacgtatcatcaacgaaccgaccgcagctgcgctggcttacggtctggacaaaggtactggcaaccgtactatcgcggtttatgacctgggtggtggtactttcgatatttccattatcgaaatcgacgaagttgacggcgaaaaaaccttcgaagttctggcaaccaacggtgatacccacctgggtggtgaagacttcgacagtcgtctgatcaactatctggttgaagaattcaagaaagatcagggcattgacctgcgcaacgatccgctggcaatgcagcgcctgaaagaagcggcagaaaaagcgaaaatcgaactgtcttccgctcagcagaccgacgttaacctgccgtacatcactgcagacgcgaccggtccgaaacacatgaacatcaaagtgactcgtgcgaaactggaaagcctggttgaagatctggtaaaccgttccattgagccgctgaaagttgcactgcaggacgctggcctgtccgtatctgatatcgacgacgttatcctcgttggtggtcagactcgtatgccaatggttcagaagaaagttgctgaattctttggtaaagagccgcgtaaagatgttaacccggacgaagctgtagccatcggtgctgctgttcagggtggtgttctgactggtgacgtaaaagacgtactgctgctggacgttaccccgctgtctctgggtatcgaaaccatgggcggtgtgatgaccacgctgatcgcgaaaaacaccactatcccgaccaagcacagccaggtgttctctaccgctgaagacaaccagtctgcggtaaccatccatgtgctgcagggtgaacgtaaacgtgcggctgataacaaatctctgggtcagttcaacctggatggtatcaacccggcaccgcgcggcatgccgcagatcgaagttaccttcgatatcgatgctgacggtatcctgcacgtttccgcgaaagacaaaaacagcggtaaagagcagaagatcactatcaaggcttcttctggtctgaacgaagatgaaatccagaaaatggtacgcgacgcagaagctaacgccgaagctgaccgtaagtttgaagagctggtacagactcgcaaccagggcgaccatctgctgcacagcacccgtaagcaggttgaagaagcaggcgacaaactgccggctgacgacaaaactgctatcgagtctgcgctgactgcactggaaactgctctgaaaggtgaagacaaagccgctatcgaagcgaaaatgcaggaactggcacaggtttcccagaaactgatggaaatcgcccagcagcaacatgcccagcagcagactgccggtgctgatgcttctgcaaacaacgcgaaagatgacgatgttgtcgacgctgaatttgaagaagtcaaagacaaaaaataa

SEQ ID NO: 232 - protein, 638 aa, Escherichia coli
MGKIIGIDLGTTNSCVAIMDGTTPRVLENAEGDRTTPSIIAYTQDGETLVGQPAKRQAVTNPQNTLFAIKRLIGRRFQDEEVQRDVSIMPFKIIAADNGDAWVEVKGQKMAPPQISAEVLKKMKKTAEDYLGEPVTEAVITVPAYFNDAQRQATKDAGRIAGLEVKRIINEPTAAALAYGLDKGTGNRTIAVYDLGGGTFDISIIEIDEVDGEKTFEVLATNGDTHLGGEDFDSRLINYLVEEFKKDQGIDLRNDPLAMQRLKEAAEKAKIELSSAQQTDVNLPYITADATGPKHMNIKVTRAKLESLVEDLVNRSIEPLKVALQDAGLSVSDIDDVILVGGQTRMPMVQKKVAEFFGKEPRKDVNPDEAVAIGAAVQGGVLTGDVKDVLLLDVTPLSLGIETMGGVMTTLIAKNTTIPTKHSQVFSTAEDNQSAVTIHVLQGERKRAADNKSLGQFNLDGINPAPRGMPQIEVTFDIDADGILHVSAKDKNSGKEQKITIKASSGLNEDEIQKMVRDAEANAEADRKFEELVQTRNQGDHLLHSTRKQVEEAGDKLPADDKTAIESALTALETALKGEDKAAIEAKMQELAQVSQKLMEIAQQQHAQQQTAGADASANNAKDDDVVDAEFEEVKDKK

SEQ ID NO: 233 - DNA, 1131 bp, Escherichia coli
atggctaagcaagattattacgagattttaggcgtttccaaaacagcggaagagcgtgaaatcaaaaaggcctacaaacgcctggccatgaaataccacccggaccgtaaccagggtgacaaagaggccgaggcgaaatttaaagagatcaaggaagcttatgaagttctgaccgactcgcaaaaacgtgcggcatacgatcagtatggtcatgctgcgtttgagcaaggcggcatgggcggcggcggttttggcggcggcgcagacttcagcgatatttttggtgacgttttcggcgatatttttggcggcggacgtggtcgtcaacgtgcggcgcgcggtgctgatttacgctataacatggagctcaccctcgaagaagctgtacgtggcgtgaccaaagagatccgcattccgactctggaagagtgtgacgtttgccacggtagcggtgcaaaaccaggtacacagccgcagacctgtccgacctgtcatggttctggccaggtgcagatgcgccagggtttctttgccgtgcagcagacctgtccacactgtcagggccgcggtacgctgatcaaagatccgtgcaacaaatgtcatggtcatggtcgtgttgagcgcagcaaaacgctgtccgttaaaatcccggcaggggtggacactggagaccgcatccgtcttgcgggcgaaggtgaagcgggtgaacacggcgcaccggcaggcgatctgtacgttcaggttcaggttaaacagcacccgattttcgagcgtgaaggcaacaacctgtattgcgaagtcccgatcaacttcgctatggcggcgctgggtggtgaaatcgaagtaccgacccttgatggtcgcgtcaaactgaaagtgcctggcgaaacccagaccggtaagctgttccgtatgcgcggtaaaggcgtcaagtctgtccgcggtggcgcacagggtgatttgctatgccgcgttgttgtcgaaacaccggtaggtttgaacgagaagcagaaacagctgctgcaagagctgcaagaaagctttggtggcccaaccggcgagcacaacagcccgcgttcaaagagcttctttgatggcgtgaagaagttttttgacgacctgactcgctaa

SEQ ID NO: 234 - protein, 376 aa, Escherichia coli
MAKQDYYEILGVSKTAEEREIKKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETPVGLNEKQKQLLQELQESFGGPTGEHNSPRSKSFFDGVKKFFDDLTR

SEQ ID NO: 235 - DNA, 150 bp, Escherichia coli
aagcagcataaggcgatgattgtcgccctgatcgtcatctgtatcaccgccgtagtggcggcgctggtaacgagaaaagacctctgtgaggttcacatccgaactggccagacggaggttgctgttttcacggcttacgaatccgagtaa

SEQ ID NO: 236 - protein, 49 aa, Escherichia coli
KQHKAMIVALIVICITAVVAALVTRKDLCEVHIRTGQTEVAVFTAYESE

SEQ ID NO: 237 - DNA, 762 bp, Escherichia coli
atgtctgccaaaagacggcttcttattgcgtgtgccctgacaacgattttctatcaccttcctgcatattcttcattagaatataaaggttcctttggctcaataaatgcaggttatgctgactggaatagtggcttcattaacactcatcgtggtgaagtatggaaagtgactgcagactttggtgtgaattttaaagaagccgagttttactcattttatgaaagcaatgtgcttaaccatgccgtagcggggcgtaatcataccgtttctgctatgacacatgtcagactctttgactccaatatgactttctttggcaagatctatggtcaatgggataactcatggggtgacgatcttgatatgttttatggtttgggctacctcggctggaatggttcatgggggttttttaaaccgtatattggattacataatcaatctggagactacgtctcagccaaatatggacaaacaaatggctggaatggttatgttgttggctggacagcagtattaccttttacgttatttgacgaaaaatttgttttatctaactggaatgaaatagaactggacagaaatgatgcctatgcggaacaacaatttggtcggaatgggctaaatggcggtttaacagtagcctggaagttctatcctcgctggaaagccagtgtgacgtggcgttatttcgataataagttgggctacgatggttttggcgatcaaatgatttatatgcttggttatgatttctaa

SEQ ID NO: 238 - protein, 253 aa, Escherichia coli
MSAKRRLLIACALTTIFYHLPAYSSLEYKGSFGSINAGYADWNSGFINTHRGEVWKVTADFGVNFKEAEFYSFYESNVLNHAVAGRNHTVSAMTHVRLFDSNMTFFGKIYGQWDNSWGDDLDMFYGLGYLGWNGSWGFFKPYIGLHNQSGDYVSAKYGQTNGWNGYVVGWTAVLPFTLFDEKFVLSNWNEIELDRNDAYAEQQFGRNGLNGGLTVAWKFYPRWKASVTWRYFDNKLGYDGFGDQMIYMLGYDF

SEQ ID NO: 239 - DNA, 1494 bp, Escherichia coli
atgcagaaaacattaatggccagtttgatcggccttgcagtttgcacagggaatgcttttaatccagtcgtagctgccgagactaaacaacccaatttagtcatcattatggcggatgatttaggctatggtgatttagcaacatatggacatcagatcgttaaaacacccaatattgacaggcttgcccaggagggcgtcaaatttactgactactatgcaccagctcccttaagttctccttcgcgggcggggttattaacggggcggatgccatttcgtaccggcatacgttcatggatcccaacgggaaaagatgtggcattagggcgtaatgaactcacgattgctaatctactcaaagcgcaagggtatgacacggccatgatgggtaagctgcatctgaatgcaggcggcgatcgcaccgatcagccgcaggcaaaagatatgggctttgattactcactggttaatacggcgggttttgttaccgacgccacgctggataacgctaaagaacgcccgcgttatggcatggtttacccgacaggctggctacgtaacgggcaacccactccacgagccgataaaatgagcggtgagtatgtcagttcggaagtcgtcaactggctggataacaaaaaggacagcaagcctttcttcctctatgttgcttttaccgaagtgcatagccccctggcttcgcccaaaaaatacctcgacatgtactcacaatatatgagcgcgtatcagaagcagcatcctgatttattttatggcgactgggcagacaaaccctggcgtggtgtgggggaatattatgccaatatcagctatctggatgcacaggttggaaaagtgctggataaaatcaaagcgatgggtgaagaagataacacaatcgttatttttaccagtgataacggtccggtaacgcgtgaagcgcgcaaagtgtatgagctgaatttggcaggggaaacggatggattacgcggtcgcaaggataacctttgggaaggcggaattcgtgttccagccattattaaatatggtaaacatctaccacagggaatggtttcagatacacccgtttatggtctggactggatgcctactttagcgaaaatgatgaacttcaaattacctacagaccgtactttcgatggtgaatcgctggttcctgttcttgagcaaaaagcattgaaacgcgaaaagccattaattttcgggattgatatgccattccaggatgatccaaccgatgaatgggcgatccgtgatggtgactggaagatgattatcgatcgcaataataaaccgaaatatctctacaatctgaaatctgatcgttatgaaacacttaatctgatcggtaaaaaaccagatattgaaaaacagatgtatggtaagtttttaaaatataaaactgatattgataatgattctctaatgaaagccagaggtgataaaccagaagcggtgacctggggctaa

SEQ ID NO: 240 - protein, 497 aa, Escherichia coli
MQKTLMASLIGLAVCTGNAFNPVVAAETKQPNLVIIMADDLGYGDLATYGHQIVKTPNIDRLAQEGVKFTDYYAPAPLSSPSRAGLLTGRMPFRTGIRSWIPTGKDVALGRNELTIANLLKAQGYDTAMMGKLHLNAGGDRTDQPQAKDMGFDYSLVNTAGFVTDATLDNAKERPRYGMVYPTGWLRNGQPTPRADKMSGEYVSSEVVNWLDNKKDSKPFFLYVAFTEVHSPLASPKKYLDMYSQYMSAYQKQHPDLFYGDWADKPWRGVGEYYANISYLDAQVGKVLDKIKAMGEEDNTIVIFTSDNGPVTREARKVYELNLAGETDGLRGRKDNLWEGGIRVPAIIKYGKHLPQGMVSDTPVYGLDWMPTLAKMMNFKLPTDRTFDGESLVPVLEQKALKREKPLIFGIDMPFQDDPTDEWAIRDGDWKMIIDRNNKPKYLYNLKSDRYETLNLIGKKPDIEKQMYGKFLKYKTDIDNDSLMKARGDKPEAVTWG

SEQ ID NO: 241 - DNA, 1260 bp, Escherichia coli
atgtttaccaacgtaaatgttgattgttgcaaaacaccaggatgtaaaaacctggggttgctgaatagccaggattatgtcgcacagggtaaaaatattttatgccgtgaatgtggttacttgtttccagtgatatctgaacagtcgcttaatatttatcgtaatattgtgaatcactcctggagaggtttgatttgccaatgttcaacttgcggaggcacgtccctcaaaaaatatggatattctgcacaaggccagagaagaatgtattgccatcattgtgagaaaacatttatcactctggaacatgtaattaccacaccacgaggagccctgttagcattgatgattgagcaaggggaggcacttgcggatatcagaaagtcattacttcttaacagcactggacttagccgtgaactgttaaaattagcgcgtgaagcaaactataaagaaagtcgacagtgtttcccagcttctgatattaccctgagtacccgcgcttttcgcgtcaagtataatggtagcaataactctctttatgctcttgttaccgcagaagaacaaagcggcagggtggttgccatctcaaccaattactccccatctgccgtagagcaacattatcaatacacatcgaactatgaagagcgtatgtctccagggacgctggcacatcatgtccagcgcaaagagttacttactatgcggcgggataccttgtttgatattgattacggcccggcagttttacatcaaaacgatccgggaatgttggtaaaaccggttcttccggcatatcgtcattttgaactggtcagaatactgaccgatgagcattccaacaacgttcagcattaccttgatcacgaatgctttatattgggcggctgcctgatggctaatttgcagcatattcctcaaggtcgctgccatatttcctttgtcaaagagcgcggtgtggcacccgccaccattgattttccaccgcgattattccttagtggtggggtacgaaataatgtctggcgtgcattttctaaccgcaattattcaatggctgtatgcaatctcactggcagtaagaaagtccgcgagatgcggcatgcaacattgaacagtgcgacgcgttttatccactttgtggagaaccatcctttccttatatcattgaaccgaatgtctcctgcgaatgtcgtttctacattagatatcctcaaacatctgtggaataaaaaactagagcatggaacaatttaa

SEQ ID NO: 242 - protein, 419 aa, Escherichia coli
MFTNVNVDCCKTPGCKNLGLLNSQDYVAQGKNILCRECGYLFPVISEQSLNIYRNIVNHSWRGLICQCSTCGGTSLKKYGYSAQGQRRMYCHHCEKTFITLEHVITTPRGALLALMIEQGEALADIRKSLLLNSTGLSRELLKLAREANYKESRQCFPASDITLSTRAFRVKYNGSNNSLYALVTAEEQSGRVVAISTNYSPSAVEQHYQYTSNYEERMSPGTLAHHVQRKELLTMRRDTLFDIDYGPAVLHQNDPGMLVKPVLPAYRHFELVRILTDEHSNNVQHYLDHECFILGGCLMANLQHIPQGRCHISFVKERGVAPATIDFPPRLFLSGGVRNNVWRAFSNRNYSMAVCNLTGSKKVREMRHATLNSATRFIHFVENHPFLISLNRMSPANVVSTLDILKHLWNKKLEHGTI

SEQ ID NO: 243 - DNA, 1086 bp, Escherichia coli
atggccaacagcggtgcaaccagtggatggtatcacgactttcttgagacgccggttcagctccgggttgggacacttgagatcaacaagaacatgctgctatggatcaatgacgctctgatggcggtatttttcctgttggttggtctggaagttaaacgcgagctgatgcaaggttcgctggccagtctgcgccaggcggcatttcctgttattgccgcaatcggcgggatgattgtcccggcattgctctatctggcttttaactatgccgatccgattacccgcgaaggctgggcaatcccggcggcgactgacattgcctttgcacttggtgtgttggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgtggtattgaatctgtgtggtgtacgccgcacgggcgtttatattctggttggcgtggtgctgtggacagcggtgttgaaatcgggggttcacgcaaccctggctggcgtcattgtcggcttctttattcctttgaaagagaagcatgggcgctctccggctaaacgtctggagcatgttttgcatccatgggtggcgtatctgattttgccgctgtttgcatttgctaatgctggcgtttcactgcaaggtgtcacgctggaaggtttgacctccatcctgccattagggatcatcgctggtttgctgattggcaagccactgggtattagtctgttctgctggttggcgctgcgtttgaaattggcacatctgccagagggaacgacttaccagcaaattatggcggttggtatcctgtgcggtatcggttttactatgtctatctttattgccagcctggcatttggtagcgtagatccagaactgattaactgggcaaaattaggtatccttgtcggttcaatttcttcggcggtaattggatatagctggttacgcgttcgtttacgtccatcagtttga

SEQ ID NO: 244 - protein, 361 aa, Escherichia coli
MANSGATSGWYHDFLETPVQLRVGTLEINKNMLLWINDALMAVFFLLVGLEVKRELMQGSLASLRQAAFPVIAAIGGMIVPALLYLAFNYADPITREGWAIPAATDIAFALGVLALLGSRVPLALKIFLMALAIIDDLGAIIIIALFYTNDLSMASLGVAAVAIAVLVVLNLCGVRRTGVYILVGVVLWTAVLKSGVHATLAGVIVGFFIPLKEKHGRSPAKRLEHVLHPWVAYLILPLFAFANAGVSLQGVTLEGLTSILPLGIIAGLLIGKPLGISLFCWLALRLKLAHLPEGTTYQQIMAVGILCGIGFTMSIFIASLAFGSVDPELINWAKLGILVGSISSAVIGYSWLRVRLRPSV

SEQ ID NO: 245 - DNA, 900 bp, Escherichia coli
atgtctcatatcaattacaaccacttgtattacttctggcatgtctacaaagaaggttctgtggttggcgcagcggaggcgctttatttaacaccacaaaccattaccgggcagatccgggcgctggaagagcgcctgcaagggaaactatttaagcgtaaaggacgtggtctggaacccagcgaactgggggaactggtctatcgctatgccgataaaatgttcaccttaagccaggaaatgctggatatcgtcaactatcgcaaagagtccaacttattgtttgatgttggtgtggcagatgcactttccaaacgtctggtcagcagtgttctggatgccgcagttgtggaagacgagcagatccatctacgctgtttcgaatcgacgcacgagatgcttttagagcagttgagtcagcataaactggatatgatcatctctgactgtccgatcgattccactcagcaggaagggctgttttccatgaaaattggcgaatgtggtgtcagtttctggtgcactaacccactaccagaaaagccgtttcctgcctgtcttgaagagcgtcgtttacttattccggggcgtcgctcaatgttggggcgtaagctattaaactggtttaactcccagggcttgaacgtcgaaattttgggtgagtttgatgatgctgcgttgatgaaagcctttggggcgacgcataacgctattttcgttgcaccttcgctttacgctaatgatttctataacgatgactcggttgtggagataggccgtgttgagaacgtgatggaagagtaccacgcgatttttgccgaaaggatgattcagcaccctgcagtacagcgtatctgcaatacagactattctgcgctgtttactccagcttcaaaataa

SEQ ID NO: 246 - protein, 299 aa, Escherichia coli
MSHINYNHLYYFWHVYKEGSVVGAAEALYLTPQTITGQIRALEERLQGKLFKRKGRGLEPSELGELVYRYADKMFTLSQEMLDIVNYRKESNLLFDVGVADALSKRLVSSVLDAAVVEDEQIHLRCFESTHEMLLEQLSQHKLDMIISDCPIDSTQQEGLFSMKIGECGVSFWCTNPLPEKPFPACLEERRLLIPGRRSMLGRKLLNWFNSQGLNVEILGEFDDAALMKAFGATHNAIFVAPSLYANDFYNDDSVVEIGRVENVMEEYHAIFAERMIQHPAVQRICNTDYSALFTPASK

SEQ ID NO: 247 - DNA, 888 bp, Escherichia coli
gtgctgactattggtaatttcgacggcgtgcatcgcggtcatcgcgcgctgttacagggcttgcaggaagaagggcgcaagcgcaacttaccggtgatggtgatgctttttgaacctcaaccactggaactgtttgctactgataaagccccggcacggctcacccggctgcgggaaaaactgcgttatcttgcagagtgtggcgttgattacgtgctgtgcgtgcgttttgacaggcgttttgcggcgttaaccgcgcaaaacttcatcagtgatcttctggtgaagcacttgcgggtaaaatttcttgccgtaggtgacgatttccgctttggcgctggtcgtgaaggcgatttcttgttattacagaaagcgggcatggaatacggcttcgatatcaccagcacgcaaactttttgcgaaggtggcgtgcgtatcagcagcaccgccgtgcgtcaggcgcttgcggatgacaatctggctctggcagaaagtttactggggcacccgtttgccatctccgggcgtgtagtccacggtgatgaattagggcgcactataggtttcccgacggcgaatgtaccgctacgccgtcaggtttccccggtgaaaggggtttatgcggtagaagtgttgggccttggcgaaaagccgttacccggcgttgcaaacatcggaacacgcccaacggttgccggtattcgccagcaactggaagtgcatttgttagatgttgcaatggacctttatggtcgccatatacaagtagtgctgcgtaaaaaaatacgcaatgagcagcgatttgcatcgctggacgaactgaaagcgcagattgcgcgtgatgaattaaccgcccgcgaattttttgggctaacaaaaccggcttaa

SEQ ID NO: 248 - protein, 295 aa, Escherichia coli
MLTIGNFDGVHRGHRALLQGLQEEGRKRNLPVMVMLFEPQPLELFATDKAPARLTRLREKLRYLAECGVDYVLCVRFDRRFAALTAQNFISDLLVKHLRVKFLAVGDDFRFGAGREGDFLLLQKAGMEYGFDITSTQTFCEGGVRISSTAVRQALADDNLALAESLLGHPFAISGRVVHGDELGRTIGFPTANVPLRRQVSPVKGVYAVEVLGLGEKPLPGVANIGTRPTVAGIRQQLEVHLLDVAMDLYGRHIQVVLRKKIRNEQRFASLDELKAQIARDELTAREFFGLTKPA

SEQ ID NO: 249 - DNA, 2817 bp, Escherichia coli
atgagtgactataaatcaaccctgaatttgccggaaacagggttcccgatgcgtggcgatctcgccaagcgcgaaccgggaatgctggcgcgttggactgatgatgatctgtacggcatcattcgtgcagctaaaaaaggcaaaaaaaccttcattctgcatgatggccctccttatgcgaatggcagtattcatattggtcactcggttaacaagattctgaaagacattatcattaagtccaaagggctttctggatatgactcgccgtatgtgcctggctgggactgtcatggtctgccaatcgagctgaaagtagagcaagaatacggtaagccgggggagaaattcaccgccgctgagttccgcgccaagtgccgcgaatacgctgcgacccaggttgacggtcagcgcaaagactttatccgtctgggcgtgctgggcgactggtcgcacccgtacctgaccatggacttcaaaactgaagccaacatcatccgcgcgctgggcaaaatcatcggcaacggtcacctgcacaaaggcgcgaagccggtgcactggtgcgttgactgccgttctgcactggcagaagcggaagttgagtattacgacaaaacttctccgtccatcgacgtcgctttcctggcggtcgatcaggatgcgcttaaaacgaaatttggcgtaagcaatgttaacggcccaatttcgctggttatatggaccaccacgccgtggacgctgcctgctaaccgcgcaatctccattgcacctgattttgattatgcgctggtgcaaatcgacggtcaggccgtgatcctcgcgaaagatctggttgaaagcgtaatgcagcgtatcggcgttagcgattacaccattcttggcacggtgaaaggtgccgagctggaactgttgcgctttacccatccgtttatggacttcgatgttccggcaattctcggcgaccacgttacgctggatgccggtaccggtgccgttcataccgcgccaggccacggtccggacgactatgtgatcggtcaaaaatatggtctggaaaccgctaacccggttggcccggacggcacttatctgccgggtacttacccgactctggatggcgttaacgtcttcaaagcgaacgatattgtcattgcgttgttgcaggaaaaaggcgcactgttgcacgttgagaaaatgcaacacagctatccgtgctgctggcgtcataaaacgccgatcatcttccgcgcgacgccgcagtggttcgtcagcatggatcagaaaggtctgcgtgcgcagtcactgaaagagatcaaaggcgtgcagtggatccctgactggggccaggcgcgtatcgagtcgatggttgctaaccgtcctgactggtgtatctctcgtcagcgtacctggggcgtgccgatgtcactgttcgtgcacaaagacacagaagaactgcatccgcgtactctcgaactgatggaagaagtggcaaaacgcgttgaagttgacggcattcaggcgtggtgggatctcgatgcgaaagagatcctcggcgacgaagctgaccagtatgtgaaagtaccggatacgctggatgtatggtttgactccggatctacccactcttccgttgttgatgtgcgtccggaatttgccggtcacgcagcggacatgtatctggaaggttctgaccaacaccgtggctggttcatgtcttccctgatgatctctaccgcgatgaagggcaaagcgccatatcgtcaggtactgactcacggctttaccgtggatggtcagggtcgcaagatgtctaaatccatcggtaacaccgtttcgccgcaggatgtgatgaacaaactgggtgcggatattctgcgtctgtgggtggcatcaaccgactacactggcgaaatggccgtttctgacgagatcctgaaacgtgctgccgacagctatcgtcgtatccgtaacaccgcgcgcttcctgctggcaaacctgaacggttttgatccggcaaaagatatggtgaaaccggaagagatggtggtactggatcgctgggccgtaggttgtgcgaaagcggcacaggaagacatcctcaaagcgtacgaagcatacgatttccacgaagtggtacagcgtctgatgcgcttctgctccgttgagatggggtccttctacctcgacatcatcaaagaccgtcagtataccgccaaagcggacagcgtggcgcgtcgtagctgccagactgcgctgtatcacatcgcagaagcgctggttcgctggatggcaccaatcctctccttcaccgctgatgaagtgtggggttacctgccgggcgaacgtgaaaaatacgtcttcaccggcgagtggtacgaaggcctgtttggtctggcagacagtgaagcaatgaacgatgcgttctgggacgagctgttgaaagtgcgtggcgaagtgaacaaagtcattgagcaagcgcgtgccgataagaaagtgggcggctcgctggaagcggcagtaaccttgtatgcagaaccggaactggcggcgaaactgaccgcgctgggcgatgaattacgatttgtcctgttgacctccggcgctaccgttgcagactataacgacgcacctgctgatgcccagcagagcgaagtcctcaaagggctgaaagtcgcgttgagtaaagccgaaggtgagaagtgccctcgctgctggcactacacccaggatgtcggcaaggtggcggaacacgcagaaatctgcggccgctgtgtcagcaacgtcgccggtgacggtgaaaaacgtaagtttgcctga

SEQ ID NO: 250 - protein, 938 aa, Escherichia coli
MSDYKSTLNLPETGFPMRGDLAKREPGMLARWTDDDLYGIIRAAKKGKKTFILHDGPPYANGSIHIGHSVNKILKDIIIKSKGLSGYDSPYVPGWDCHGLPIELKVEQEYGKPGEKFTAAEFRAKCREYAATQVDGQRKDFIRLGVLGDWSHPYLTMDFKTEANIIRALGKIIGNGHLHKGAKPVHWCVDCRSALAEAEVEYYDKTSPSIDVAFLAVDQDALKTKFGVSNVNGPISLVIWTTTPWTLPANRAISIAPDFDYALVQIDGQAVILAKDLVESVMQRIGVSDYTILGTVKGAELELLRFTHPFMDFDVPAILGDHVTLDAGTGAVHTAPGHGPDDYVIGQKYGLETANPVGPDGTYLPGTYPTLDGVNVFKANDIVIALLQEKGALLHVEKMQHSYPCCWRHKTPIIFRATPQWFVSMDQKGLRAQSLKEIKGVQWIPDWGQARIESMVANRPDWCISRQRTWGVPMSLFVHKDTEELHPRTLELMEEVAKRVEVDGIQAWWDLDAKEILGDEADQYVKVPDTLDVWFDSGSTHSSVVDVRPEFAGHAADMYLEGSDQHRGWFMSSLMISTAMKGKAPYRQVLTHGFTVDGQGRKMSKSIGNTVSPQDVMNKLGADILRLWVASTDYTGEMAVSDEILKRAADSYRRIRNTARFLLANLNGFDPAKDMVKPEEMVVLDRWAVGCAKAAQEDILKAYEAYDFHEVVQRLMRFCSVEMGSFYLDIIKDRQYTAKADSVARRSCQTALYHIAEALVRWMAPILSFTADEVWGYLPGEREKYVFTGEWYEGLFGLADSEAMNDAFWDELLKVRGEVNKVIEQARADKKVGGSLEAAVTLYAEPELAAKLTALGDELRFVLLTSGATVADYNDAPADAQQSEVLKGLKVALSKAEGEKCPRCWHYTQDVGKVAEHAEICGRCVSNVAGDGEKRKFA

SEQ ID NO: 251 - DNA, 495 bp, Escherichia coli
atgagtcaatcgatctgttcaacagggctacgctggctgtggctggtggtagtcgtgctgattatcgatctgggcagcaaatacctgatcctccagaactttgctctgggggatacggtcccgctgttcccgtcgcttaatctgcattatgcgcgtaactatggcgcagcgtttagtttccttgccgatagcggcggctggcagcgttggttctttgccggtattgcgattggtattagcgtgatcctggcagtgatgatgtatcgctcgaaggccacgcagaagctaaacaatatcgcttacgcgctgattattggcggcgcactgggcaacctgttcgaccgcctgtggcacggcttcgttgtcgatatgatcgacttctatgtcggcgactggcacttcgccaccttcaaccttgccgatactgccatttgtgtcggtgcggcactgattgtgctggaaggttttttaccttctaaagcgaaaaaacaataa

SEQ ID NO: 252 - protein, 164 aa, Escherichia coli
MSQSICSTGLRWLWLVVVVLIIDLGSKYLILQNFALGDTVPLFPSLNLHYARNYGAAFSFLADSGGWQRWFFAGIAIGISVILAVMMYRSKATQKLNNIAYALIIGGALGNLFDRLWHGFVVDMIDFYVGDWHFATFNLADTAICVGAALIVLEGFLPSKAKKQ

SEQ ID NO: 253 - DNA, 450 bp, Escherichia coli
atgtctgaatctgtacagagcaatagcgccgtcctggtgcacttcacgctgaaactcgatgatggcaccaccgctgagtctacccgcaacaacggtaaaccggcgctgttccgcctgggtgatgcttctctttctgaagggctggagcaacacctgctggggctgaaagtgggcgataaaaccaccttctcgctggagccagatgcggcgtttggcgtgccgtcaccggacctgattcagtacttctcccgccgtgaatttatggatgcaggcgagccagaaattggcgcaatcatgctttttaccgcaatggatggcagtgagatgcctggcgtgatccgcgaaattaacggcgactccattaccgttgatttcaaccatccgctggccgggcagaccgttcattttgatattgaagtgctggaaatcgatccggcactggaggcgtaa

SEQ ID NO: 254 - protein, 149 aa, Escherichia coli
MSESVQSNSAVLVHFTLKLDDGTTAESTRNNGKPALFRLGDASLSEGLEQHLLGLKVGDKTTFSLEPDAAFGVPSPDLIQYFSRREFMDAGEPEIGAIMLFTAMDGSEMPGVIREINGDSITVDFNHPLAGQTVHFDIEVLEIDPALEA

SEQ ID NO: 255 - DNA, 951 bp, Escherichia coli
atgcagatcctgttggccaacccgcgtggtttttgtgccggggtagaccgcgctatcagcattgttgaaaacgcgctggccatttacggcgcaccgatatatgtccgtcacgaagtggtgcataaccgctacgtggtcgatagcctgcgcgagcgtggggctatctttattgagcagattagcgaagtaccggacggcgcgatcctgattttctccgcacacggtgtttctcaggcagtacgtaacgaagcgaaaagccgcgatttgacggtgtttgatgccacctgtccgctggtgaccaaagtgcatatggaagtcgcccgcgccagccgtcgtggtgaagaatctattctcatcggtcacgccgggcacccggaagtggaagggacgatgggccagtacagcaacccggaagggggaatgtatctggtcgaatcgccagacgatgtgtggaaactgacggtcaaaaacgaagagaagctctcctttatgacccaaaccacgctgtcggtggatgacacgtctgatgtgatcgacgcgctgcgtaaacgcttcccgaaaattgtcggtccgcgcaaagatgacatctgctacgccacgactaaccgtcaggaagcggtacgcgccctggcagagcaggcggaagtagtactggtggttggttcgaaaaactcctccaactccaaccgtctggcggaactggcccagcgtatgggcaagcgcgcgtttttgattgacgatgcgacagatatccaggaagagtgggtgaaagaggcgaaatgcgtcggcgtgactgctggcgcatcagctccggatattctggtacagaacgtagtcgcacgtttacagcagcttggcggtggcgaagccattccgctggaaggtcgtgaagaaaacattgttttcgaagtgccgaaagagctgcgtgtcgatattcgtgaagtcgattaa

SEQ ID NO: 256 - protein, 316 aa, Escherichia coli
MQILLANPRGFCAGVDRAISIVENALAIYGAPIYVRHEVVHNRYVVDSLRERGAIFIEQISEVPDGAILIFSAHGVSQAVRNEAKSRDLTVFDATCPLVTKVHMEVARASRRGEESILIGHAGHPEVEGTMGQYSNPEGGMYLVESPDDVWKLTVKNEEKLSFMTQTTLSVDDTSDVIDALRKRFPKIVGPRKDDICYATTNRQEAVRALAEQAEVVLVVGSKNSSNSNRLAELAQRMGKRAFLIDDATDIQEEWVKEAKCVGVTAGASAPDILVQNVVARLQQLGGGEAIPLEGREENIVFEVPKELRVDIREVD

SEQ ID NO: 257 - DNA, 915 bp, Escherichia coli
atgcgtttacctatcttcctcgatacagaccccggcattgacgatgccgttgccattgccgccgcgatttttgcccccgaactcgatctgcaactgatgaccactgtcgcgggtaatgtttcggtagagaaaaccacccgcaacgccctgcaactgctgcatttctggaatgtggatattccgcttgcccagggcgctgccgtaccactggttcgtgcgccgcgcgatgcggcatctgtacacggtgaatcgggaatggctggctatgactttgttgaacacaaccgtcagccactgggtataccggcgtttctggcaattcgtgatgccctgatgcgtgcgccagagcccgttaccctggtggccatcggcccgttaaccaatattgcgctgttactttcacaatgcccggaatgtaagccgtatattcgccgtctggtgatcatgggcggttctgctggtcgcggcaactgcacaccaaacgccgagtttaatatcgctgccgatccagaagcggcagcctgtgtcttccgtagcggcatcgaaatcgtcatgtgcggtctggatgtcaccaatcaggcaatattaacccctgactatctcgctactttgccggaattgaatcgcaccggaaaaatgctacacgccctgtttagccactaccgtagcggcagtatgcaaagtggactacgtatgcacgatctttgcgctatcgcctggctggtgcgcccggaattgttcactctcaaaccgtgttttgtcgcggtagaaactcagggtgaatttacctcaggcacgacggttgttgatatcgacggttgcctgggcaaaccagccaatgtacaggtggcgctggatctggatgtgaaaggcttccagcaatgggtggctgaggtgctggccctggcgctctaa

SEQ ID NO: 258 - protein, 304 aa, Escherichia coli
MRLPIFLDTDPGIDDAVAIAAAIFAPELDLQLMTTVAGNVSVEKTTRNALQLLHFWNVDIPLAQGAAVPLVRAPRDAASVHGESGMAGYDFVEHNRQPLGIPAFLAIRDALMRAPEPVTLVAIGPLTNIALLLSQCPECKPYIRRLVIMGGSAGRGNCTPNAEFNIAADPEAAACVFRSGIEIVMCGLDVTNQAILTPDYLATLPELNRTGKMLHALFSHYRSGSMQSGLRMHDLCAIAWLVRPELFTLKPCFVAVETQGEFTSGTTVVDIDGCLGKPANVQVALDLDVKGFQQWVAEVLALAL

SEQ ID NO: 259 - DNA, 366 bp, Escherichia coli
atgacgtatggagaagcgtatctggaagggtggaaaaacatctttaattatgaaggtgtttccaatcgcttcgagttctggtcgtttatgattggtagtggcgttatctgtctgcttccgcttttatgttggtggttagcggtaacaattaacaatgactatggtgttttcattttttttgcgctgcccgcgtcatttattttaacgttgatttttgccataccggcgatagcgttagccgtcagaaggatgcacgatatcggatattcagggtggtgggttaccattgtcgtgttgatccctgttacgggcgtaattctgcttatactgtgctgcctgccgtcaaagtcacaagaccaggcataa

SEQ ID NO: 260 - protein, 121 aa, Escherichia coli
MTYGEAYLEGWKNIFNYEGVSNRFEFWSFMIGSGVICLLPLLCWWLAVTINNDYGVFIFFALPASFILTLIFAIPAIALAVRRMHDIGYSGWWVTIVVLIPVTGVILLILCCLPSKSQDQA

SEQ ID NO: 261 - DNA, 774 bp, Escherichia coli
atgggccgccagttgattcaggcggcgctggcattagaaggcgtgcagctgggcgcggcgctggagcgcgaaggatcttctttactgggcagcgatgcgggcgaactggccggagccgggaaaacaggcgttactgtgcaaagtagtcttgatgcgataaaagatgattttgatgtgtttatcgattttacccgtccggaaggtacgctgaaccatctcgctttttgtcgccagcatggcaaagggatggtgatcggcactacggggtttgacgaagccggtaaacaggcgattcgtgacgccgccgccgatattgcgattgtctttgccgccaattttagcgttggcgttaacgtcatgcttaaactgctggagaaagcagccaaagtgatgggggactacaccgatatcgaaattattgaagcacatcatagacataaagttgatgcgccgtcaggcaccgcactggcaatgggagaggcgatcgcccacgctcttgataaagatctgaaagattgcgcggtctacagtcgtgaaggccataccggtgaacgtgtgcctggcaccattggttttgccaccgtgcgtgcaggtgacatcgttggcgaacataccgcgatgtttgccgatattggcgagcgtctggagatcacccataaggcatccagccgcatgacatttgctaacggtgcggtaagatcggctttgtggttgagtggtaaggaaagtggtctttttgatatgcgagatgtgcttgatctcaataatctgtaa

SEQ ID NO: 262 - protein, 257 aa, Escherichia coli
MGRQLIQAALALEGVQLGAALEREGSSLLGSDAGELAGAGKTGVTVQSSLDAIKDDFDVFIDFTRPEGTLNHLAFCRQHGKGMVIGTTGFDEAGKQAIRDAAADIAIVFAANFSVGVNVMLKLLEKAAKVMGDYTDIEIIEAHHRHKVDAPSGTALAMGEAIAHALDKDLKDCAVYSREGHTGERVPGTIGFATVRAGDIVGEHTAMFADIGERLEITHKASSRMTFANGAVRSALWLSGKESGLFDMRDVLDLNNL

SEQ ID NO: 263 - DNA, 1149 bp, Escherichia coli
ttgattaagtcagcgctattggttctggaagacggaacccagtttcacggtcgggccataggggcaacaggttcggcggttggggaagtcgttttcaatacttcaatgaccggttatcaagaaatcctcactgatccttcctattctcgtcaaatcgttactcttacttatccccatattggcaatgtcggcactaatgacgccgatgaagaatcttctcaggttcatgcccaaggtctggtgattcgcgacctgccgctgattgccagcaacttccgtaataccgaagacctctcttcttacctgaagcgccataacatcgtggcgattgccgatatcgatacccgtaagctgacgcgtttactgcgtgagaaaggtgctcagaatggctgcattatcgcaggcgataacccggatgcggcgctggcattagaaaaagcccgcgcgttcccaggtctgaacggcatggatctggcaaaagaagtaaccaccgcagaaccctatagctggacacaagggagctggacactgaccggcggcctgccagaagcgaaaaaagaagacgagctgccgtaccacgtcgtggcctacgatttcggtgccaagcgcaacatcctgcgtatgctggtggatagaggctgtcgcctgaccatcgttccggcgcaaacttctgcggaagatgtgctgaaaatgaatccggacggcatcttcctctccaacggtcctggcgacccggccccgtgcgattacgccattaccgctatccagaaattcctcgaaactgatattccggtattcggcatctgcctcggtcatcagctgctggcgctggcgagcggtgcgaagactgtcaaaatgaaatttggtcaccacggcggcaaccatccggttaaagatgttgagaaaaatgtggtgatgatcaccgcccagaaccacggttttgcggtggatgaagcaacattacctgcaaacctgcgtgtcacacataaatccctgttcgacggtacgttacagggcattcatcgtaccgataaaccggcgttcagcttccagggacacccggaagccagccctggtccacacgacgccgcgccgttgtttgaccactttatcgcgttaattgagcagtaccgtaaaaccgctaagtaa

SEQ ID NO: 264 - protein, 382 aa, Escherichia coli
MIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEPYSWTQGSWTLTGGLPEAKKEDELPYHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIHRTDKPAFSFQGHPEASPGPHDAAPLFDHFIALIEQYRKTAK

SEQ ID NO: 265 - DNA, 3222 bp, Escherichia coli
atgccaaaacgtacagatataaaaagtatcctgattctgggtgcgggcccgattgttatcggtcaggcgtgtgagtttgactactctggcgcgcaagcgtgtaaagccctgcgtgaagagggttaccgcgtcattctcgtgaactccaacccggcgactatcatgaccgacccggaaatggctgatgcaacctacatcgagccgattcactgggaagtggtacgcaagattattgaaaaagagcgcccggacgcggtgctgccaaccatgggggggcagacggcgctgaactgtgcgctggagcttgagcgtcagggcgtgctggaagagttcggcgtcaccatgattggtgccactgccgatgcgattgataaagccgaagaccgccgccgtttcgacgtagcgatgaagaaaatcggtctggaaactgcgcgttccggtatcgctcattcaatggaagaagcgctggcggttgccgctgaagttggcttcccgtgcattattcgcccatcctttaccatgggcggtagcggtggcggtatcgcttataaccgtgaagaatttgaagaaatttgcgcccgcggtctggatctttctccgactaaagagctgctgattgatgagtcgctgatcggctggaaagagtacgagatggaagtggtgcgtgataaaaacgacaactgcatcatcgtctgctctatcgaaaactttgatgcgatgggcatccacaccggtgactccatcactgtcgcgccagcccaaacgctgaccgataaagaatatcaaatcatgcgtaacgcctcgatggcggtactgcgtgaaatcggcgttgaaaccggtggttccaacgtccagtttgcggtgaacccgaaaaacggtcgcctgattgttatcgaaatgaacccacgcgtgtctcgctcctctgcgctggcgtcgaaagccactggtttcccgattgccaaagtggcggcgaaactggcggtgggttacaccctcgacgagctgatgaacgacatcaccggtgggcgtactccggcctccttcgagccgtccatcgactatgtggttactaaaattcctcgcttcaacttcgagaaattcgccggtgctaacgaccgtctgaccactcagatgaaatcggttggcgaagtgatggcgattggtcgcacgcagcaggaatccctacaaaaagcgctgcgcggcctggaagtgggcgcaactggcttcgatccgaaagtgagtctcgacgacccggaagcgctgactaaaatccgccgcgaactgaaagatgctggcgcagagcgtatctggtatatcgctgatgccttccgcgcgggcctgtctgtagacggtgtatttaatttgaccaacattgaccgctggttcctggtacagattgaagagctggtgcgtctggaagagaaagtcgcagaagtgggcatcactggcctgcacgctgaattcctgcgccagctgaaacgcaaaggctttgccgatgcgcgtctggcaaaactcgcgggcgtgcgtgaagcagaaatccgcaagctgcgcgaccagtatgacctgcacccggtttacaagcgcgtggatacttgtgcggcagagttcgccaccgacaccgcttacatgtactccacttatgaagaagagtgcgaagcgaatccgtccaccgatcgtgaaaaaatcatggtgctcggcggcggcccgaaccgtatcggtcagggtatcgaattcgactactgctgtgtacacgcctcgctggcgctgcgcgaagacggttatgaaaccattatggttaactgtaacccggaaaccgtctccaccgactacgacacctctgaccgtctctacttcgagccggtaactctggaagacgtgctggaaattgtgcgtattgagaagccgaaaggcgttatcgtccagtacggcggtcagaccccgctgaaactggcgcgcgcgctggaagctgctggcgtaccggttatcggtaccagcccggatgccatcgaccgtgcggaagaccgtgaacgcttccagcatgcggttgagcgtctgaaactgaaacaaccggcgaacgccaccgttaccaccatcgaaatggcggttgagaaagcgaaagagattggctacccgctggtggtgcgtccgtcttacgttctcggcggtcgggcgatggaaatcgtctatgacgaagctgacctgcgtcgctacttccagacagcggtcagcgtatctaacgatgcgccagtgttgctggaccacttccttgatgacgcagtagaagttgacgtggatgccatctgcgacggcgaaatggtgctgattggcggcatcatggagcatattgagcaggcgggtgtgcactccggtgactccgcatgttcactgccagcttacaccttaagtcaggaaattcaggatgtgatgcgccagcaggtgcagaaactggccttcgaactgcaggtgcgcggcctgatgaacgtgcagtttgcggtgaaaaacaacgaagtctacctgattgaagttaacccgcgtgcggcgcgtaccgttccgttcgtctccaaagccaccggcgtaccgctggcaaaagtggcggcgcgtgtgatggctggcaaatcgctggctgagcagggcgtaaccaaagaagttatcccgccgtactactcggtgaaagaagtggtgctgccgttcaataaattcccgggcgttgacccgctgttagggccagaaatgcgctctaccggggaagtaatgggcgtgggccgcaccttcgctgaagcgtttgccaaagcgcagctgggcagcaactccaccatgaagaaacacggtcgtgcgctgctttccgtgcgcgaaggcgataaagaacgcgtggtggacctggcggcaaaactgctgaaacagggcttcgagctggatgcgactcacggcacggcgattgtgctgggcgaagcgggtatcaatccgcgtctggtgaacaaggtgcatgaaggccgtccgcacattcaggaccgtattaagaatggcgaatatacctacatcatcaacaccacctcaggtcgtcgtgcgattgaagactcccgcgtgatccgtcgcagtgcgctgcaatataaagtgcattacgacaccaccctgaacggcggctttgccaccgcgatggcgctgaatgccgatgcgaccgaaaaagtaatttcggtgcaggaaatgcacgcgcagatcaaataa

SEQ ID NO: 266 - protein, 1073 aa, Escherichia coli
MPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLEEFGVTMIGATADAIDKAEDRRRFDVAMKKIGLETARSGIAHSMEEALAVAAEVGFPCIIRPSFTMGGSGGGIAYNREEFEEICARGLDLSPTKELLIDESLIGWKEYEMEVVRDKNDNCIIVCSIENFDAMGIHTGDSITVAPAQTLTDKEYQIMRNASMAVLREIGVETGGSNVQFAVNPKNGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGAERIWYIADAFRAGLSVDGVFNLTNIDRWFLVQIEELVRLEEKVAEVGITGLHAEFLRQLKRKGFADARLAKLAGVREAEIRKLRDQYDLHPVYKRVDTCAAEFATDTAYMYSTYEEECEANPSTDREKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQHAVERLKLKQPANATVTTIEMAVEKAKEIGYPLVVRPSYVLGGRAMEIVYDEADLRRYFQTAVSVSNDAPVLLDHFLDDAVEVDVDAICDGEMVLIGGIMEHIEQAGVHSGDSACSLPAYTLSQEIQDVMRQQVQKLAFELQVRGLMNVQFAVKNNEVYLIEVNPRAARTVPFVSKATGVPLAKVAARVMAGKSLAEQGVTKEVIPPYYSVKEVVLPFNKFPGVDPLLGPEMRSTGEVMGVGRTFAEAFAKAQLGSNSTMKKHGRALLSVREGDKERVVDLAAKLLKQGFELDATHGTAIVLGEAGINPRLVNKVHEGRPHIQDRIKNGEYTYIINTTSGRRAIEDSRVIRRSALQYKVHYDTTLNGGFATAMALNADATEKVISVQEMHAQIK

SEQ ID NO: 267 - DNA, 459 bp, Escherichia coli
atggggaacgaaaagagcttagcgcacacccgatggaactgtaaatatcacatagtatttgcgccaaaataccgaagacaggtgttctacagagagaagcgtagagcaataggctgtattttgagaaagctgtgtgagtggaaaagtgtacggattctggaagctgaatgctgtgcagatcatatccatatgcttgtggagatcccgcccaaaatgagcgtatcaggctttatgggatatctgaaagggaaaagcagtctgatgccttacgagcagtttggtgatttgaaattcaaatacaggaacagggagttctggtgcagagggtattacgtcgatacggtgggtaagaacacggcgaagatacaggattacataaagcaccagcttgaagaggataaaatgggagagcagttatcgattccctatccgggcagcccgtttacgggccgtaagtaa

SEQ ID NO: 268 - protein, 152 aa, Escherichia coli
MGNEKSLAHTRWNCKYHIVFAPKYRRQVFYREKRRAIGCILRKLCEWKSVRILEAECCADHIHMLVEIPPKMSVSGFMGYLKGKSSLMPYEQFGDLKFKYRNREFWCRGYYVDTVGKNTAKIQDYIKHQLEEDKMGEQLSIPYPGSPFTGRK

SEQ ID NO: 269 - DNA, 501 bp, Escherichia coli
gtgaagttgcatactatcgatatatccacaattttaatatggccttgtttaattgctgcaaaacgagtcatagccagtcttttaatttgtgaaactggagttcgtatgtgtgaaggatgtgttgaaaaaccactctatttgttaatcgccgaatggatgatggctgaaaaccggtgggtgatagcaagagagatctctattcatttcgatattgaacacagcaaggcggttaataccctgacttatattctgtcggaagtcacagaaataagctgcgaagttaagatgatccctaataagctggaagggcggggatgccagtgccagcgactggtaaaagtggttgatatcgatgagcaaatttacgcgcgcctgcgcaataacagccgggataaattagtcggcgtaagaaagacgccgcgtattcctgccgttccgctcacggaacttaaccgcgagcagaagtggcagatgatgttgtcaaagagtatgcgtcgttaa

SEQ ID NO: 270 - protein, 166 aa, Escherichia coli
MKLHTIDISTILIWPCLIAAKRVIASLLICETGVRMCEGCVEKPLYLLIAEWMMAENRWVIAREISIHFDIEHSKAVNTLTYILSEVTEISCEVKMIPNKLEGRGCQCQRLVKVVDIDEQIYARLRNNSRDKLVGVRKTPRIPAVPLTELNREQKWQMMLSKSMRR

SEQ ID NO: 271 - DNA, 612 bp, Escherichia coli
gtggaaaggacgttaacaaccgtgagctattacgcctttgaggggttaattccggttgttcacccgacggcgtttgtccatcccagtgcagtattgattggcgatgtgattgtgggagccggtgtctacatcggcccactcgcctcactgcgtggtgactacgggcggttgatcgtgcaagcgggagccaatattcaggatggctgcattatgcatggctactgcgacactgacaccatcgttggggaaaacggtcatatcgggcacggagcgatcctgcatggttgtgtgattggtcgcgatgcactggtcgggatgaacagcgtgattatggatggcgcggtcattggcgaagagagcattgttgccgctatgagctttgtcaaagcgggctttcgcggcgagaaacgccagttgttgatgggtacgccagcccgcgctgtacgcagcgtgagtgacgacgagttacactggaaacggttgaataccaaagagtatcaggatcttgtcgggcgctgtcatgcagcgttacatgaaacgcagccactgaggcaaatggaggaaaatcgcccccgtttgcaggggacgacggatgtgacgccgaaacggtaa

SEQ ID NO: 272 - protein, 203 aa, Escherichia coli
MERTLTTVSYYAFEGLIPVVHPTAFVHPSAVLIGDVIVGAGVYIGPLASLRGDYGRLIVQAGANIQDGCIMHGYCDTDTIVGENGHIGHGAILHGCVIGRDALVGMNSVIMDGAVIGEESIVAAMSFVKAGFRGEKRQLLMGTPARAVRSVSDDELHWKRLNTKEYQDLVGRCHAALHETQPLRQMEENRPRLQGTTDVTPKR

SEQ ID NO: 273 - DNA, 786 bp, Escherichia coli
atgagtgaatcattacatctgacccgcaatggatcaattctggaaattacccttgatcgtccaaaagcgaatgctattgatgcaaaaaccagctttgaaatgggcgaagtatttctaaatttccgtgacgatccgcaattacgtgtcgccattattaccggtgccggagagaaattcttttccgcgggctgggatttaaaagcggcagcagaaggcgaagcaccggatgctgactttggcccgggaggttttgcgggattaaccgaaattttcaatctcgacaaaccggtcatcgccgctgtgaacggctatgcctttggcggcggctttgaactggcgctggcggcagattttattgtttgtgccgataacgccagcttcgccctaccggaagccaaactgggcatcgttcctgacagcggcggcgtgctgcgtctgccgaagatcctgccgcctgccatcgtcaatgaaatggtgatgaccggcagacgaatgggcgcagaagaggcgctgcgttggggggtagtcaaccgcgtggttagccaggcggaactgatggataacgcccgcgaactggcgcagcagctggttaacagcgctccgctggcgattgcggcgctgaaagagatctaccgcaccaccagtgaaatgccggtagaagaagcgtatcgctatattcgcagcggcgtgttgaaacactatccatcggttctgcattcggaggatgccattgaagggccgctggcgtttgccgagaagcgcgatccagtgtggaaaggacgttaa

SEQ ID NO: 274 - protein, 261 aa, Escherichia coli
MSESLHLTRNGSILEITLDRPKANAIDAKTSFEMGEVFLNFRDDPQLRVAIITGAGEKFFSAGWDLKAAAEGEAPDADFGPGGFAGLTEIFNLDKPVIAAVNGYAFGGGFELALAADFIVCADNASFALPEAKLGIVPDSGGVLRLPKILPPAIVNEMVMTGRRMGAEEALRWGVVNRVVSQAELMDNARELAQQLVNSAPLAIAALKEIYRTTSEMPVEEAYRYIRSGVLKHYPSVLHSEDAIEGPLAFAEKRDPVWKGR

SEQ ID NO: 275 - DNA, 1569 bp, Escherichia coli
atggatagaggtgcaatggatatcattggcggacaacatctacgtcaaatgtgggacgatctggcggacgtttacggtcataaaacggcgctgatttgtgaatccagcggcggagtcgttaaccggtatagttatcttgagttaaatcaggagattaaccgcacggcaaacctgttttatacgctggggattcgcaaaggcgacaaggttgctctacatctcgacaactgcccggaatttatcttttgctggttcgggctggcaaaaattggcgcgattatggtgccaattaacgcccgcctgttgcgcgaagaaagcacgtggatcctgcaaaatagccaggcgtgcctgctggtgaccagtgcgcaattttatcctatgtatcaacagattcagcaggaagatgcctctcagttgcggcacatttgcctgatagatatggcacttcccgctgatgatggcgtgagttcgtttactcaactgaaaaatcaacaacctgccaccttgtgctatgcaccgccgctatcgactgacgatacggcggaaattctcttcacctccggcactacctcccgaccgaaaggggtggtgattacccattacaacctgcgcttcgctggatattactccgcctggcagtgtgcactgcgtgacgatgacgtctacctgacggtaatgcctgcgtttcatatcgattgccagtgtactgcggcgatggcggcgttttctgccggggccacctttgtgctggtcgagaaatacagcgcccgcgccttctggggacaggtgcagaagtaccgcgccaccattaccgaatgtattccgatgatgattcgtacgttgatggtgcagccgccttcagcgaacgatcggcaacaccgcctgcgggaagtgatgttttatctcaacttgtcggaacaggaaaaagacgcgttttgtgaacgcttcggcgttcgcttgctgacgtcttatgggatgacggaaaccattgtgggcattatcggcgatcgccctggcgataaacggcgctggccgtcgattggtcgggcgggcttttgctacgaagcggagatccgcgacgatcacaatcgtcccctcccggctggtgagctcggtgaaatctgtattaaaggcgtaccagggaaaaccatcttcaaagagtattttctcaacccgaaagccactgcgaaagtgctggaagccgatggctggctacataccggcgataccggataccgcgacgaagagggctttttttatttcgtcgatcgccgctgcaatatgatcaaacgcggtggcgagaatgtctcctgcgtggagctcgaaaatatcatcgccacccatccaaaaattcaggatatcgtggttgtgggtattaaagattcgattcgcgatgaagccatcaaagcatttgtggtgctgaatgaaggtgaaacattgagcgaagaggaattcttctgcttctgtgaacagaatatggcgaaatttaaagtgccctcttatctggagatcagaaaagatctgccacgtaattgctcggggaaaataattagaaagaatctgaaataa

SEQ ID NO: 276 - protein, 522 aa, Escherichia coli
MDRGAMDIIGGQHLRQMWDDLADVYGHKTALICESSGGVVNRYSYLELNQEINRTANLFYTLGIRKGDKVALHLDNCPEFIFCWFGLAKIGAIMVPINARLLREESTWILQNSQACLLVTSAQFYPMYQQIQQEDASQLRHICLIDMALPADDGVSSFTQLKNQQPATLCYAPPLSTDDTAEILFTSGTTSRPKGVVITHYNLRFAGYYSAWQCALRDDDVYLTVMPAFHIDCQCTAAMAAFSAGATFVLVEKYSARAFWGQVQKYRATITECIPMMIRTLMVQPPSANDRQHRLREVMFYLNLSEQEKDAFCERFGVRLLTSYGMTETIVGIIGDRPGDKRRWPSIGRAGFCYEAEIRDDHNRPLPAGELGEICIKGVPGKTIFKEYFLNPKATAKVLEADGWLHTGDTGYRDEEGFFYFVDRRCNMIKRGGENVSCVELENIIATHPKIQDIVVVGIKDSIRDEAIKAFVVLNEGETLSEEEFFCFCEQNMAKFKVPSYLEIRKDLPRNCSGKIIRKNLK

SEQ ID NO: 277 - DNA, 1218 bp, Escherichia coli
atggatcatctacccatgccgaaattcgggccgctggccggattacgcgttgtcttctccggtatcgaaatcgccgggccgttcgccggacaaatgttcgcagaatggggggcggaagttatctggatcgagaacgtcgcctgggccgacaccattcgcgttcaaccgaactacccgcagctctcccgccgcaatttgcatgcgctgtcgttaaatattttcaaagatgaagggcgcgaagcgtttctgaaattaatggaaaccaccgatatcttcatcgaagccagtaaaggtccggcctttgcccgtcgtggcattaccgatgaagtcctgtggcagcacaacccaaaactggttatcgctcacctttccggttttggtcagtatggcaccgaggagtacaccaatcttccggcctataacactatcgcccaggccttcagtggttacctgattcagaacggtgatgttgaccagccaatgcctgccttcccgtataccgccgattacttttctggcctgaccgccaccacggcggcgctggcagcactgcataaagtgcgtgaaaccggtaaaggcgaaagcatcgacatcgccatgtatgaagtgatgctgcgtatgggccagtacttcatgatggattacttcaacggcggcgaaatgtgcccgcgcatgaccaaaggtaaagatccctactacgccggttgcggtctgtataaatgcgccgacggctacatcgtgatggaactggtgggcattactcaaattgcagagtgctttaaagatattggcctcgcacatctgctcggtacgccggaaatcccggaaggcactcagcttatccaccgtatcgaatgcccttacggcccactggtagaagagaaactcgatgcctggctggcggcacataccatcgcagaagttaaagaacgctttgccgaactgaatatcgcctgtgccaaagtactgaccgtgccggaactggaaagcaatccacagtatgtggctcgcgaatcaatcactcagtggcaaacgatggatggtcgcacctgcaaagggccgaatatcatgccgaaattcaaaaataaccccggacaaatctggcgcggaatgccctcacatggcatggacacggctgccattttgaaaaatatcggctacagcgaaaacgacattcaggagttggtcagcaaaggtctggccaaagttgaggactaa

SEQ ID NO: 278 - protein, 405 aa, Escherichia coli
MDHLPMPKFGPLAGLRVVFSGIEIAGPFAGQMFAEWGAEVIWIENVAWADTIRVQPNYPQLSRRNLHALSLNIFKDEGREAFLKLMETTDIFIEASKGPAFARRGITDEVLWQHNPKLVIAHLSGFGQYGTEEYTNLPAYNTIAQAFSGYLIQNGDVDQPMPAFPYTADYFSGLTATTAALAALHKVRETGKGESIDIAMYEVMLRMGQYFMMDYFNGGEMCPRMTKGKDPYYAGCGLYKCADGYIVMELVGITQIAECFKDIGLAHLLGTPEIPEGTQLIHRIECPYGPLVEEKLDAWLAAHTIAEVKERFAELNIACAKVLTVPELESNPQYVARESITQWQTMDGRTCKGPNIMPKFKNNPGQIWRGMPSHGMDTAAILKNIGYSENDIQELVSKGLAKVED

SEQ ID NO: 279 - DNA, 1143 bp, Escherichia coli
atggattttaatttaaatgatgagcaggaactgtttgtcgccggtatccgcgaactgatggccagcgaaaactgggaggcctattttgccgagtgcgaccgtgacagcgtctacccggaacgttttgtcaaagccctggcggatatgggtatcgacagtctgctgatccctgaagagcacggtggtctggacgcggggtttgttactctcgccgccgtgtggatggaactgggtcgtctgggagcgccaacttacgtgctgtatcagttaccgggcgggtttaacaccttcctgcgtgaaggtacgcaagagcagatcgacaagattatggctttccgcggcaccggtaagcagatgtggaactcagcaattaccgaaccgggcgcaggctccgacgtgggtagcctgaaaacgacttatacccgtagaaatggtaagatttatcttaatggtagtaagtgttttattaccagcagcgcctacaccccgtacatcgtggtgatggcgcgcgacggggcttctccggacaaacctgtctacaccgaatggtttgttgatatgagcaaaccgggcatcaaagtgaccaaacttgaaaagctcggtctgcgtatggatagctgctgtgaaatcacctttgacgacgtggaactggacgagaaagacatgttcggtcgggaaggtaacggctttaaccgcgtcaaagaagagttcgaccatgaacgtttcctggtagccctgaccaactacggtacggcgatgtgcgcctttgaagatgcggcgcgctacgccaaccagcgtgtgcagtttggcgaggctattggtcgtttccagttgattcaggaaaaattcgcccacatggcgatcaaattaaactccatgaaaaacatgctgtatgaagcagcgtggaaagcagacaacggcaccatcacctctggcgatgcagcgatgtgcaaatacttctgcgccaatgcggcatttgaagtggtggatagcgcaatgcaggtgctgggcggtgtcgggattgcgggcaaccaccgcatcagccgcttctggcgtgacctgcgtgtagaccgcgtttccggaggatctgacgaaatgcagatcctgacgctgggtcgcgcggtgctgaagcaataccgttaa

SEQ ID NO: 280 - protein, 380 aa, Escherichia coli [sequence omitted]

SEQ ID NO: 281 - DNA, 1515 bp, Escherichia coli
atgaagaatgaaaagagaaaaacgggaatagaaccgaaggttttctttccgccgttaataatcgtcggcatactttgttggcttacagtcagagatctggatgcggcgaatgtcgttattaatgctgtattcagttacgtcaccaatgtatggggatgggcatttgaatggtatatggtggtgatgcttttcggctggttctggctggtgtttggcccgtatgccaaaaagcgtttaggtaacgaaccaccagaatttagtaccgccagttggatctttatgatgttcgcctcctgtacgtctgctgccgtactgttctggggatcgattgagatctactactacatctccaccccgccgtttggcttagaaccgaactcaacaggcgcgaaagagttggggctggcttacagcttgttccactggggacctctgccgtgggccacttacagcttcctttcagtcgccttcgcttacttcttctttgtccgcaaaatggaagtgattcgccccagctccaccctggtgccgctggtaggtgaaaaacacgccaaagggttgttcggcactatcgtcgacaacttctatctcgtcgccttgatcttcgcgatgggtaccagtctgggccttgccacgccgctggtgaccgagtgtatgcaatggttgtttggcattccgcataccctgcaactggacgctatcatcattacctgctggattatcctcaacgccatttgcgtcgcttgcggtctgcaaaaaggggtacgtatcgccagtgacgtgcgtagttacctgagcttcctgatgctgggttgggtgttcatcgtcagcggtgccagcttcatcatgaactacttcaccgattcggtggggatgttactgatgtatctgccgcgcatgttgttctataccgatcccatcgctaaaggcggcttcccgcagggctggaccgtgttctactgggcatggtgggtgatttacgctatccagatgagcatcttcctcgcccgcatctcccgtggtcgtaccgtgcgtgaactgtgcttcggcatggtgctggggctgacagcgtcaacctggatcctgtggactgtactcggtagtaacactctgctgttgatagataaaaacatcatcaacattccaaatctgatcgaacagtacggtgtggcgcgcgccatcatcgaaacctgggccgctctgccactcagcaccgccaccatgtggggcttcttcatcctctgctttattgccaccgttacgctggttaacgcctgctcttataccctggcgatgtccacttgccgcgaagtacgcgatggtgaagaacccccgctgctggtgcgtatcggctggtcaattctggttggcattatcggtattgttctgctggcgctcggcggcctgaaaccgattcaaaccgccattatcgccggaggatgcccgctgttcttcgtcaacatcatggtgacgctctcctttattaaagacgcgaaacagaactggaaagattaa

SEQ ID NO: 282 - protein, 504 aa, Escherichia coli
MKNEKRKTGIEPKVFFPPLIIVGILCWLTVRDLDAANVVINAVFSYVTNVWGWAFEWYMVVMLFGWFWLVFGPYAKKRLGNEPPEFSTASWIFMMFASCTSAAVLFWGSIEIYYYISTPPFGLEPNSTGAKELGLAYSLFHWGPLPWATYSFLSVAFAYFFFVRKMEVIRPSSTLVPLVGEKHAKGLFGTIVDNFYLVALIFAMGTSLGLATPLVTECMQWLFGIPHTLQLDAIIITCWIILNAICVACGLQKGVRIASDVRSYLSFLMLGWVFIVSGASFIMNYFTDSVGMLLMYLPRMLFYTDPIAKGGFPQGWTVFYWAWWVIYAIQMSIFLARISRGRTVRELCFGMVLGLTASTWILWTVLGSNTLLLIDKNIINIPNLIEQYGVARAIIETWAALPLSTATMWGFFILCFIATVTLVNACSYTLAMSTCREVRDGEEPPLLVRIGWSILVGIIGIVLLALGGLKPIQTAIIAGGCPLFFVNIMVTLSFIKDAKQNWKD

SEQ ID NO: 283 - DNA, 771 bp, Escherichia coli
atgaagattattacttgctataagtgcgtgcctgatgaacaggatattgcggtcaataatgctgatggttcgttagacttcagcaaagccgatgccaaaataagccaatacgatctcaacgctattgaagcggcttgccagctaaagcaacaggcagcagaggcgcaggtgacggccttaagtgtgggcggtaaagccctgaccaacgccaaagggcgtaaagatgtgctatcgcgcggtccggatgaactgattgtggtgattgatgaccagttcgagcaggcactgccgcaacaaacggcgagcgtactggctgcagccgctcagaaagcaggctttgatttgatcctctgtggcgatggttcttccgacctttatgcccagcaggttggtttgctggtaggcgaaatccttaatattccggcagttaacggcgtcagcaaaattatctccctgactgcagataccctcaccgttgagcgcgaactggaagatgaaacagaaaccttaagcattccgctgcctgcggttgttgctgtttccactgatatcaactccccacaaattccttcgatgaaagccattctcggcgcggcgaaaaagccagtccaggtatggtcggcggcggatatcggttttaacgcagaggcagcctggtcagaacaacaggttgccgcgccgaaacagcgcgagcgtcagcgcatcgtgattgaaggcgacggcgaagaacagatcgccgcatttgctgaaaatcttcgcaaagtcatttaa

SEQ ID NO: 284 - protein, 256 aa, Escherichia coli
MKIITCYKCVPDEQDIAVNNADGSLDFSKADAKISQYDLNAIEAACQLKQQAAEAQVTALSVGGKALTNAKGRKDVLSRGPDELIVVIDDQFEQALPQQTASVLAAAAQKAGFDLILCGDGSSDLYAQQVGLLVGEILNIPAVNGVSKIISLTADTLTVERELEDETETLSIPLPAVVAVSTDINSPQIPSMKAILGAAKKPVQVWSAADIGFNAEAAWSEQQVAAPKQRERQRIVIEGDGEEQIAAFAENLRKVI

SEQ ID NO: 285 - DNA, 942 bp, Escherichia coli
atgaacacgttttctcaagtctgggtattcagcgataccccttctcgtctgccggaactgatgaacggtgcgcaggctttagctaatcaaatcaacacgttcgtcctcaatgatgccgacggcacacaggcaatccagctcggcgctaatcatgtctggaaattaagcggcaaaccggacgagcggatgatcgaagattacgccggtgtcatggctgacactattcgccagcacggcgcagacggtctggtgctgttgccaaacacccgtcgcggcaaattactggcggcgaaactgggttaccgccttaacgcggcggtgtctaacgatgccagcgctgttagcgtgcaggacggtaaagcgacagtgaaacacatggtttacggcggtctggcgattggcgaagaacgcattgccacgccgtatgcggtactgaccatcagcagcggcacgttcgatgcggctcagccagacgcgtcacgcactggcgaaacgcacaccgtggagtggcaggctccggctgtggcgattacccgcacggcaacccaggcgcgtcagagcaacagcgtcgatctcgacaaagcccgcctggtggtcagcgttggtcgcggtattggcagcaaagagaacattgcgctggcagaacagctttgcaaggcgataggtgcggagttggcctgttctcgtccggtggcggaaaacgaaaaatggatggagcacgaacgctatgtcggtatctccaacctgatgctgaaacctgaactgtacctggcggtggggatctccgggcagatccagcacatggttggcgctaatgcgtcgcaaaccattttcgccatcaacaaagataaaaatgcgccgatcttccagtacgcggattacggcattgttggcgacgccgtgaagatccttccggcactgaccgtagctttagcgcgttga

SEQ ID NO: 286 - protein, 313 aa, Escherichia coli
MNTFSQVWVFSDTPSRLPELMNGAQALANQINTFVLNDADGTQAIQLGANHVWKLSGKPDERMIEDYAGVMADTIRQHGADGLVLLPNTRRGKLLAAKLGYRLNAAVSNDASAVSVQDGKATVKHMVYGGLAIGEERIATPYAVLTISSGTFDAAQPDASRTGETHTVEWQAPAVAITRTATQARQSNSVDLDKARLVVSVGRGIGSKENIALAEQLCKAIGAELACSRPVAENEKWMEHERYVGISNLMLKPELYLAVGISGQIQHMVGANASQTIFAINKDKNAPIFQYADYGIVGDAVKILPALTVALAR

SEQ ID NO: 287 - DNA, 1287 bp, Escherichia coli
atgtccgaagatatctttgacgccatcatcgtcggtgcagggcttgccggttcggttgccgcactggtgctcgcccgcgaaggtgcgcaagtgttagttatcgagcgaggcaattccgcaggtgccaagaacgtcaccggcgggcgtctctatgcccacagtctggaacacattattcctggtttcgcagactccgcccccgtagaacgcctgatcacccatgaaaaacttgcgtttatgacggaaaagtcagcgatgactatggactactgcaatggcgacgaaacctcgccatcccagcgttcttactccgttttacgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggggtgaattccatccttgccgaaaagctggggatggcaaaacgcgttaaaccgacggatgtggcggttggcgtgaaggaactgatcgagttaccgaagtcggttattgaagaccgttttcagttgcagggtaatcagggcgcggcttgcctgtttgcgggatcacccaccgatggcctgatgggcggtggcttcctttataccaatgaaaataccctgtcgctggggctggtttgtggtttgcatcatctgcatgacgcaaaaaaatcggtgccgcaaatgctggaagatttcaaacaacatccggccgttgcaccgctgatcgcgggcggcaagctggtggaatattccgctcacgtagtgccggaagcgggcatcaacatgctgccggagctggtcggtgacggcgtattgattgctggtgatgccgccggaatgtgtatgaacctcggttttaccattcgcggtatggatctggcgattgccgccggggaagcagcagcaaaaactgtgctttcagcgatgaaaagcgacgatttcagtaagcaaaaactcgcggaatatcgtcagcatcttgagagtggcccgctgcgcgatatgcgcatgtaccagaaactaccggcgtttcttgataacccacgcatgtttagcggctacccggaactggcggtgggcgtggcgcgtgacctgttcaccattgacggcagtgcgccggaactgatgcgcaagaaaatcctccgccacggcaagaaagtgggcttcatcaatctgatcaaggatggcatgaaaggagtgaccgttttatga

SEQ ID NO: 288 - protein, 428 aa, Escherichia coli
MSEDIFDAIIVGAGLAGSVAALVLAREGAQVLVIERGNSAGAKNVTGGRLYAHSLEHIIPGFADSAPVERLITHEKLAFMTEKSAMTMDYCNGDETSPSQRSYSVLRSKFDAWLMEQAEEAGAQLITGIRVDNLVQRDGKVVGVEADGDVIEAKTVILADGVNSILAEKLGMAKRVKPTDVAVGVKELIELPKSVIEDRFQLQGNQGAACLFAGSPTDGLMGGGFLYTNENTLSLGLVCGLHHLHDAKKSVPQMLEDFKQHPAVAPLIAGGKLVEYSAHVVPEAGINMLPELVGDGVLIAGDAAGMCMNLGFTIRGMDLAIAAGEAAAKTVLSAMKSDDFSKQKLAEYRQHLESGPLRDMRMYQKLPAFLDNPRMFSGYPELAVGVARDLFTIDGSAPELMRKKILRHGKKVGFINLIKDGMKGVTVL

SEQ ID NO: 289 - DNA, 288 bp, Escherichia coli
atgacttctcccgtcaatgtggacgtcaaactgggcgtcaataaattcaatgtcgatgaagagcatccgcacattgttgtgaaggccgatgcagataaacaggccctggagctgctggtgaaagcgtgccccgcaggtctgtacaagaagcaggatgacggcagtgtgcgcttcgattacgccggatgtctggagtgcggcacctgtcgcattctggggctggggtcggcgctggaacagtgggaatacccgcgcggcacctttggtgtggagttccgttacggctga

SEQ ID NO: 290 - protein, 95 aa, Escherichia coli
MTSPVNVDVKLGVNKFNVDEEHPHIVVKADADKQALELLVKACPAGLYKKQDDGSVRFDYAGCLECGTCRILGLGSALEQWEYPRGTFGVEFRYG

SEQ ID NO: 291 - DNA, 1332 bp, Escherichia coli
atgcaaccgtccagaaactttgatgatcttaaattctcctctattcaccgccgcattttgctgtggggaagcggtggtccgtttctggatggttatgtactggtaatgattggcgtggcgctggagcaactgactccggcgctgaaactggacgctgactggattggcttgctgggcgcgggaacgctcgccgggctgttcgttggcacatcgctgtttggctatatctccgataaagtcggacggcgcaaaatgttcctcattgatatcatcgccatcggcgtgatatcggtggcgacgatgtttgtctcatcccccgtcgaactgttggtgatgcgggtacttatcggcattgttatcggtgcggattatcccatcgccacctcaatgatcaccgagttctccagtacccgtcagcgggcgttttccatcagctttatcgccgcgatgtggtatgtcggcgcgacctgcgccgatttggtcggctattggctttatgatgtggaaggcggctggcgctggatgctgggtagcgcagcgattccctgtttattgattttgattggtcgattcgaactgcctgaatctccccgctggttgttacgcaaagggcgagtaaaagagtgcgaagagatgatgataaaactgtttggcgaaccggtggctttcgaggaagagcagccgcagcaaacccgttttcgcgatctgtttaatcgccgccattttccttttgttctgtttgttgccgccatctggacctgccaggtgatcccaatgttcgccatttacacctttggcccgcaaatcgttggtttgttaggattgggggttggcaaaaacgcggcgctggggaacgtggtgattagtctgttctttatgctcggctgtattccgccgatgctgtggctaaacactgccggacggcgtccattgttgattggcagctttgccatgatgacgctggcgctggcggttttggggctgatcccggatatggggatctggctggtagtgatggcctttgcggtgtatgcctttttctctggcgggccgggtaatttgcagtggctctatcctaatgaactcttcccgacggatatccgcgcctctgccgtgggcgtgattatgtccttaagccgtattggcactattgtatcgacctgggcactgccgatctttatcaataattacggtatcagtaacacgatgctaatgggggcgggtatctcgctatttggcttgttgatttccgtagcgtttgccccggagactcgagggatgtcactggcgcagaccagcaatatgacgatccgcgggcagagaatggggtaa

SEQ ID NO: 292 - protein, 443 aa, Escherichia coli
MQPSRNFDDLKFSSIHRRILLWGSGGPFLDGYVLVMIGVALEQLTPALKLDADWIGLLGAGTLAGLFVGTSLFGYISDKVGRRKMFLIDIIAIGVISVATMFVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFEEEQPQQTRFRDLFNRRHFPFVLFVAAIWTCQVIPMFAIYTFGPQIVGLLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMG

SEQ ID NO: 293 - DNA, 531 bp, Escherichia coli
atgattcttataatttatgcgcatccgtatccgcattattcccatgcgaataaacggatgcttgaacaggcaaggacgctggaaggcgtcgaaattcgctctctttatcaactctatcctgacttcaatatcgacattgccgccgaacaggaggcgctgtctcgtgccgatctgatcgtctggcagcacccaatgcagtggtacagcattccaccgcttcttaaactttggatcgataaagttttctcgcacggctgggcttacggtcacggcggcacggcgctgcacggcaaacatttgctgtgggcggtgacgaccggcggtggggaaagccattttgagattggtgcgcatccgggctttgatgtgctgtcgcagccgctacaggcgacggcaatctactgcgggctgaactggctgccaccgtttgccatgcactgcacctttatttgtgacgacgaaaccctcgaagggcaggcgcggcactataagcaacgtctgctggaatggcaggaggcacatcatggatag

SEQ ID NO: 294 - protein, 176 aa, Escherichia coli
MILIIYAHPYPHYSHANKRMLEQARTLEGVEIRSLYQLYPDFNIDIAAEQEALSRADLIVWQHPMQWYSIPPLLKLWIDKVFSHGWAYGHGGTALHGKHLLWAVTTGGGESHFEIGAHPGFDVLSQPLQATAIYCGLNWLPPFAMHCTFICDDETLEGQARHYKQRLLEWQEAHHG

SEQ ID NO: 295 - DNA, 1863 bp, Escherichia coli
atggatagccatacgcttattcaggcgctgatttatctcggttcggcggcgctgattgtacccattgcggtacgcctcggtctgggatcggtacttggctatctgatcgccggctgcatcattggcccgtgggggctgcgactggtgaccgatgccgaatctattctgcactttgcagagattggcgtggtgctgatgctgtttattatcggcctcgaactcgatccacaaaggctgtggaagctgcgtgcggcagtgttcggcggtggcgcattgcagatggtgatttgcggcggcctgctggggctgttttgtatgttacttgggctgcgctggcaggtcgcagaattgatcggcatgacgctggcgctctcatcaacggcgattgccatgcaggcgatgaatgaacgcaatctgatggtgacgcaaatgggccgcagtgcctttgcggtgctgctgttccaggatatcgcggcgatcccactggtggcgatgatcccgctactggcagcgagcagtgcttcgacgacgatgggcgcatttgttctctcggcgttaaaagtggcgggcgcgctggcgctggtggtattgctggggcgctatgtcacgcgtccggcactgcgttttgttgcccgctctggcttgcgggaagtgtttagtgccgtggcgttattcctcgtgtttggctttggtttgctgctggaagaggtcggcttgtcgatggcgatgggcgcgtttctggcgggcgtactgctggcaagctcggaataccgtcatgcgctggaaagcgatatcgaaccatttaaaggtttgctgctggggctgtttttcatcggcgttggcatgtcgatagactttggcacgctgattgaaaacccattgcgcattgtcattttgctgctcggtttcctcatcatcaaaatcgccatgctgtggctgattgcccgaccgttgcaggtgccaaataaacagcgtcgctggtttgcggtgctgttaggacagggcagtgagtttgcctttgtagtatttggtgcggcgcagatggcgaatgtgctggagccagagtgggcgaaatcgctgactctggcggtggcactgtcgatggcggcaacgccgattctgctggtaatcctcaatcgccttgagcaatcttctactgaagaggcgcgtgaagccgatgagatcgacgaagaacagccgcgggtaatcattgccggattcggtcgttttgggcagataaccggacgtttactgctctccagcggggtgaaaatggtggtgctcgatcacgacccggaccatatcgaaacgctgcgtaaattcggtatgaaagtgttttatggcgatgccacgcggatggatttactggaatctgccggagcggcgaaagcggaagtgctgattaacgccatcgacgatccgcaaaccaacctgcaactgacggagatggtgaaagaacatttcccacatttgcagattattgcccgcgcccgcgatgtcgaccactacattcgtttgcgtcaggcaggcgttgaaaagccggagcgtgaaaccttcgaaggtgcgctgaaaaccgggcgtctggcactggaaagtttaggtctggggccgtatgaagcgcgagaacgcgccgatgtgttccgccgctttaatattcagatggtggaagagatggcaatggttgagaacgacaccaaagcccgtgcggcggtctataaacgcaccagcgcgatgttaagtgagatcattaccgaagaccgtgaacatctgtcattaattcaacgacatggctggcagggaaccgaagaagggaaacatactggcaatatggcggatgaaccggaaacgaagccctcatcttaa

SEQ ID NO: 296 - protein, 620 aa, Escherichia coli
MDSHTLIQALIYLGSAALIVPIAVRLGLGSVLGYLIAGCIIGPWGLRLVTDAESILHFAEIGVVLMLFIIGLELDPQRLWKLRAAVFGGGALQMVICGGLLGLFCMLLGLRWQVAELIGMTLALSSTAIAMQAMNERNLMVTQMGRSAFAVLLFQDIAAIPLVAMIPLLAASSASTTMGAFVLSALKVAGALALVVLLGRYVTRPALRFVARSGLREVFSAVALFLVFGFGLLLEEVGLSMAMGAFLAGVLLASSEYRHALESDIEPFKGLLLGLFFIGVGMSIDFGTLIENPLRIVILLLGFLIIKIAMLWLIARPLQVPNKQRRWFAVLLGQGSEFAFVVFGAAQMANVLEPEWAKSLTLAVALSMAATPILLVILNRLEQSSTEEAREADEIDEEQPRVIIAGFGRFGQITGRLLLSSGVKMVVLDHDPDHIETLRKFGMKVFYGDATRMDLLESAGAAKAEVLINAIDDPQTNLQLTEMVKEHFPHLQIIARARDVDHYIRLRQAGVEKPERETFEGALKTGRLALESLGLGPYEARERADVFRRFNIQMVEEMAMVENDTKARAAVYKRTSAMLSEIITEDREHLSLIQRHGWQGTEEGKHTGNMADEPETKPSS

SEQ ID NO: 297 - DNA, 591 bp, Escherichia coli
gtggactcgccagcagaatataaaattttcctcaacatcatcctcgcaccagtcgacgacggtttacgctttacgtatagtggcgacaattttttttatcgggaaatctcaatgatcagtctgattgcggcgttagcggtagatcgcgttatcggcatggaaaacgccatgccgtggaacctgcctgccgatctcgcctggtttaaacgcaacactttaaataaacccgtgattatgggccgccatacctgggaatccatcggtcgtccgttgccaggacgcaaaaatattatcctcagcagtcaaccgggtacggacgatcgcgtaacgtgggtgaagtcggtggatgaagccattgcggcgtgtggtgacgtaccagaaatcatggtgattggcggcggtcgcgtttatgagcagttcctgccgaaagcgcaaaaactgtatctgacgcatatcgacgcggaagtggaaggcgacacccatttcccggattacgagccggatgactgggaatcggtattcagtgaattccacgacgccgatgcgcagaactctcatagctattgctttgagattctggagcggcggtaa

SEQ ID NO: 298 - protein, 196 aa, Escherichia coli
MDSPAEYKIFLNIILAPVDDGLRFTYSGDNFFYREISMISLIAALAVDRVIGMENAMPWNLPADLAWFKRNTLNKPVIMGRHTWESIGRPLPGRKNIILSSQPGTDDRVTWVKSVDEAIAACGDVPEIMVIGGGRVYEQFLPKAQKLYLTHIDAEVEGDTHFPDYEPDDWESVFSEFHDADAQNSHSYCFEILERR

SEQ ID NO: 299 - DNA, 234 bp, Escherichia coli
atgactgcaaaacgtaccacacaaagtgtgaccgtcaccgtcgaccgtgagttagtcaatcgcgctcgtgatgcaggcttaaatatgagcgccacccttacggttgcgctcaatgctgaacttaaaaaacatgcagcaacacgttggcgtgaagagaacgcagaagctatcgctgcgttaaatcaattggctgatgaaaccggatgtttctctgatgagtaccggagcttctag

SEQ ID NO: 300 - protein, 77 aa, Escherichia coli
MTAKRTTQSVTVTVDRELVNRARDAGLNMSATLTVALNAELKKHAATRWREENAEAIAALNQLADETGCFSDEYRSF

SEQ ID NO: 301 - DNA, 123 bp, Escherichia coli
atgcaatttacggtataccgcagtcgcggcaggaacgccgcgtttccctttgttattgatgttaccagcgacattgttggtgagattaatcgccgtatcgttattccattaacacctatttga

SEQ ID NO: 302 - protein, 40 aa, Escherichia coli
MQFTVYRSRGRNAAFPFVIDVTSDIVGEINRRIVIPLTPI

SEQ ID NO: 303 - DNA, 123 bp, Escherichia coli
gtgctcatgacgcatgagactgcaactgttccagttaacgcgctgggaacgaaattttgcgatgccagcgcgcaccgaacgttgattaaaggagcattagattttatgctcgacgggatttaa

SEQ ID NO: 304 - protein, 40 aa, Escherichia coli
MLMTHETATVPVNALGTKFCDASAHRTLIKGALDFMLDGI

SEQ ID NO: 305 - DNA, 849 bp, Escherichia coli
atggcgacataccttattggcgacgttcatggttgttacgatgaactgatcgcattgctgcataaagtagaatttacccctgggaaagataccctctggctgacgggcgatctggtcgcgcgcggcccgggttcgctggatgttctgcgctatgtgaaatccttaggcgacagcgtacgtctggtgctgggtaatcacgatctgcatctgctggcggtatttgccgggatcagccgcaataaaccgaaagatcgcctgacaccgctgctggaagcgccggatgccgacgagctgcttaactggctgcgtcgccagcctttgctgcaaatcgacaaagagaaaaagttagtgatggcccacgccgggatcacgccgcagtgggatctgcagacagccaaagagtgcgcgcgcgatgtagaagcggtgctgtcgagtgactcctatcccttcttccttgatgccatgtacggcgatatgccaaataactggtcgccggaattgcgggggctgggaagactgcgttttatcaccaacgcctttacccgtatgcgtttttgcttcccgaacggtcaactggatatgtacagcaaagaatcgccggaagaggcccctgccccactgaaaccgtggtttgcgattcctggccccgtcgctgaagagtacaacatcgcctttggtcactgggcatcgctggaaggcaaaggtacgccggaaggtatttacgcgctggataccggctgctgctggggtggtacattaacctgcctgcgctgggaagataaacagtattttgtccagccgtcgaaccggcataaggatttgagtgagggagaggcggtagcgtcttaa

SEQ ID NO: 306 - protein, 282 aa, Escherichia coli
MATYLIGDVHGCYDELIALLHKVEFTPGKDTLWLTGDLVARGPGSLDVLRYVKSLGDSVRLVLGNHDLHLLAVFAGISRNKPKDRLTPLLEAPDADELLNWLRRQPLLQIDKEKKLVMAHAGITPQWDLQTAKECARDVEAVLSSDSYPFFLDAMYGDMPNNWSPELRGLGRLRFITNAFTRMRFCFPNGQLDMYSKESPEEAPAPLKPWFAIPGPVAEEYNIAFGHWASLEGKGTPEGIYALDTGCCWGGTLTCLRWEDKQYFVQPSNRHKDLSEGEAVAS

SEQ ID NO: 307 - DNA, 378 bp, Escherichia coli
atgatcaattcgccccgagtgtgtattcaggttcaaagcgtctacattgaggcccaatcttcacctgataatgaacgttacgtttttgcttataccgtaaccatacgcaatctggggcgagcgccagtgcagttgttggggcgttactggctgatcaccaatggcaatggccgtgaaaccgaagtccagggcgaaggagtggttggcgtccagccacttatcgcgcctggcgaagagtaccagtacaccagcggtgcaatcattgaaaccccgctgggcaccatgcagggtcactacgaaatgatcgatgaaaatggcgtccctttcagcatcgacattcccgtattccgactcgccgttcccacactcattcattaa

SEQ ID NO: 308 - protein, 125 aa, Escherichia coli
MINSPRVCIQVQSVYIEAQSSPDNERYVFAYTVTIRNLGRAPVQLLGRYWLITNGNGRETEVQGEGVVGVQPLIAPGEEYQYTSGAIIETPLGTMQGHYEMIDENGVPFSIDIPVFRLAVPTLIH

SEQ ID NO: 309 - DNA, 822 bp, Escherichia coli
atgaataatcgagtccaccagggccacttagcccgtaaacgcttcgggcaaaactttctcaacgatcagttcgtgatcgacagcattgtttctgccattaacccgcagaagggccaggcgatggtcgaaatcggccccggtctggcggcattgaccgaaccggtcggcgaacgtctggaccagctgacggtcatcgaacttgaccgcgatctggcggcacgtctgcaaacgcatccattcttaggcccgaaactgacgatttatcagcaggatgcgatgacctttaactttggcgaactggccgcgaaaatgggccagccgctgcgtgttttcggcaacctgccttataacatctccacgccgttgatgttccatctgtttagctatactgatgccattgccgacatgcactttatgttgcaaaaagaagtggtgaatcgtctggttgcaggaccgaacagcaaggcgtatggtcgattaagcgtcatggcgcaatactattgcaacgtgatcccggtgctggaagtaccgccgtcagcctttacaccaccacccaaagtggattccgccgtcgtgcgcctggttcctcatgcaacgatgcctcacccggttaaagatgttcgcgtgttgagccgcatcaccactgaagcctttaaccagcgtcgtaaaaccattcgtaacagcctcggcaacctgtttagcgtcgaggtgttaacgggaatggggatcgacccggcgatgcgagcggaaaatatctctgtcgcgcaatattgccagatggcgaactatctggcggagaacgcgcctttgcaggagagttaa

SEQ ID NO: 310 - protein, 273 aa, Escherichia coli
MNNRVHQGHLARKRFGQNFLNDQFVIDSIVSAINPQKGQAMVEIGPGLAALTEPVGERLDQLTVIELDRDLAARLQTHPFLGPKLTIYQQDAMTFNFGELAAKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHATMPHPVKDVRVLSRITTEAFNQRRKTIRNSLGNLFSVEVLTGMGIDPAMRAENISVAQYCQMANYLAENAPLQES

SEQ ID NO: 311 - DNA, 990 bp, Escherichia coli
atggttaaaacccaacgtgttgtgatcactcccggcgagcccgccgggattggcccggacttaattgtccagcttgcacagcgtgagtggccagtcgaactggttgtttgtgccgatgccactctccttaccgaccgggcagcgatgctcggtttgccgctcaccctccgcccttattcccccaactcccctgcacaaccgcaaactgcgggcacattaacgctacttcctgtcgcgctacgtgaatctgtcactgtggggcagttagcagttgaaaatgggcactatgtggtggaaacgctggcgcgagcgtgtgatggctgtctgaacggtgaatttgctgcgctgatcacaggccccgtgcataaaggcgtcattaacgacgcaggcattccgtttaccgggcataccgagtttttcgaagagcgttcgcaggcgaaaaaagtggtgatgatgctggcgaccgaagaacttcgcgtggcgctggcaacgacgcatttaccgctgcgcgatattgcagatgctatcacccctgcccttttgcacgaagtgattgctattttgcatcacgatttgcggaccaaatttggtattgccgaaccgcgcattctggtctgcgggctgaatccgcacgcgggcgaaggcggtcatatgggtacggaagagatagacactattattccggtactcaacgagctgcgggaacaggggatgaaactcaacgggccgctgcctgccgataccctgtttcagccgaaatatctcgataacgccgacgccgtgctggcgatgtaccacgatcagggtcttcccgtgctaaaataccagggcttcgggcgcggtgtgaacattacgctgggcctgccctttattcgcacatcagtggaccacggcaccgcgcttgaactggcgggacgtggtaaagccgatgtcggcagttttattacggcgcttaatctcgccatcaaaatgattgttaacacccaatga

SEQ ID NO: 312 - protein, 329 aa, Escherichia coli
MVKTQRVVITPGEPAGIGPDLIVQLAQREWPVELVVCADATLLTDRAAMLGLPLTLRPYSPNSPAQPQTAGTLTLLPVALRESVTVGQLAVENGHYVVETLARACDGCLNGEFAALITGPVHKGVINDAGIPFTGHTEFFEERSQAKKVVMMLATEELRVALATTHLPLRDIADAITPALLHEVIAILHHDLRTKFGIAEPRILVCGLNPHAGEGGHMGTEEIDTIIPVLNELREQGMKLNGPLPADTLFQPKYLDNADAVLAMYHDQGLPVLKYQGFGRGVNITLGLPFIRTSVDHGTALELAGRGKADVGSFITALNLAIKMIVNTQ

SEQ ID NO: 313 - DNA, 1287 bp, Escherichia coli
atgaagaactggaaaacgctgcttctcggtatcgccatgatcgcgaataccagtttcgctgccccccaggtagtcgataaagtcgcagccgtcgtcaataacggcgtcgtgctggaaagcgacgttgatggattaatgcagtcggtaaaactgaacgctgctcaggcaaggcagcaacttcctgatgacgcgacgctgcgccaccaaatcatggaacgtttgatcatggatcaaatcatcctgcagatggggcagaaaatgggagtgaaaatctccgatgagcagctggatcaggcgattgctaacatcgcgaaacagaacaacatgacgctggatcagatgcgcagccgtctggcttacgatggtctgaactacaacacctatcgtaaccagatccgcaaagagatgattatctctgaagtgcgtaacaacgaggtgcgtcgtcgcatcaccatcctgccgcaggaagtcgaatccctggcgcagcaagtgggtaaccaaaacgacgccagcactgagctgaacctgagccacatcctgatcccgctgccggaaaacccgacctctgatcaggtgaacgaagcggaaagccaggcacgcgccattgtcgatcaggcgcgtaacggcgctgatttcggtaagctggcgattgctcattctgccgaccagcaggcgctgaacggcggccagatgggctggggccgtattcaggagttgccggggatcttcgcccaggcattaagcaccgcgaagaaaggcgacattgttggcccgattcgttccggcgttggcttccatattctgaaagttaacgacctgcgcggcgaaagcaaaaatatctcggtgaccgaagtccatgctcgccatattctgctgaaaccgtcgccgatcatgactgacgaacaggcccgcgtgaaactggaacagattgctgccgatatcaagagtggtaaaacgacttttgctgccgcagcgaaagagttctctcaggatccaggctctgctaaccagggcggtgatctcggctgggctacaccagatattttcgatccggccttccgtgacgccctgacccgcctgaacaaaggtcaaatgagtgcaccggttcactcttcattcggctggcatttaatcgaactgctggatacccgtaatgtcgataaaaccgacgcggcacagaaagatcgtgcataccgcatgctgatgaaccgtaagttctcggaagaagcagcaagctggatgcaggaacaacgtgccagcgcctacgttaaaatcctgagcaactaa

SEQ ID NO: 314 - protein, 428 aa, Escherichia coli
MKNWKTLLLGIAMIANTSFAAPQVVDKVAAVVNNGVVLESDVDGLMQSVKLNAAQARQQLPDDATLRHQIMERLIMDQIILQMGQKMGVKISDEQLDQAIANIAKQNNMTLDQMRSRLAYDGLNYNTYRNQIRKEMIISEVRNNEVRRRITILPQEVESLAQQVGNQNDASTELNLSHILIPLPENPTSDQVNEAESQARAIVDQARNGADFGKLAIAHSADQQALNGGQMGWGRIQELPGIFAQALSTAKKGDIVGPIRSGVGFHILKVNDLRGESKNISVTEVHARHILLKPSPIMTDEQARVKLEQIAADIKSGKTTFAAAAKEFSQDPGSANQGGDLGWATPDIFDPAFRDALTRLNKGQMSAPVHSSFGWHLIELLDTRNVDKTDAAQKDRAYRMLMNRKFSEEAASWMQEQRASAYVKILSN

SEQ ID NO: 315 - DNA, 1086 bp, Escherichia coli
atgccagaggcgactcgtgttcacctggaaccgaccatcaatctgccgctctctaataactggggcagcatcaatactgaagcgaagttgctggcaacccattatcagcaaaccaatcttgactggtataactccagaaacacgaccaagctggcagagtccgctaaccgtgtaatgccgcagttcaaggtagacggtagaatggtcttcgagcgtgatatggaaatgctggcgccgggctatacccagacactggaaccacgcgcgcagtatctgtatgtgccatatcgcgatcagagcaaaatctataactacgactcgtcgctgctgcaatctgactactccggcctgttccgggaccggacttacggcggtcttgaccgtattgcctccgctaaccaggtgacgaccggtgtcacatctcgcatatatgatgatgctgccgttgaacgttttaatatttccgttggtcaaatctactatttcacggagtctcgcactggcgatgacaacataacatgggagaatgacgacaaaacgggctcactggtatgggcaggcgatacttactggcgcatctctgatcgttggggattgcgtggcgggattcagtacgatacacgtctggataacgtagcgaccagtaactccagcattgaataccgtcgggatgaagaccgtctggtacagctgaattaccgttacgccagcccggaatatattcaggcaacgctgcctaagtactattccactgctgagcaatataagaatggtatttcgcaggtaggtgccgtcgccagctggccaattgccgatcgttggtccattgttggggcctactactacgacaccaatgcgaacaagcaagccgactctatgttaggtgtgcaatacagctcctgctgctatgcgattcgcgtcggttacgagcggaagctgaacggttgggataacgataaacaacatgcggtatatgacaacgcaatcggctttaacatcgaacttcgcggcctgagctccaactacggtctgggtacgcaagagatgctgcgttcgaacattctgccgtatcaaaacactttgtga

SEQ ID NO: 316 - protein, 361 aa, Escherichia coli
MPEATRVHLEPTINLPLSNNWGSINTEAKLLATHYQQTNLDWYNSRNTTKLAESANRVMPQFKVDGRMVFERDMEMLAPGYTQTLEPRAQYLYVPYRDQSKIYNYDSSLLQSDYSGLFRDRTYGGLDRIASANQVTTGVTSRIYDDAAVERFNISVGQIYYFTESRTGDDNITWENDDKTGSLVWAGDTYWRISDRWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 317 - DNA, 1143 bp, Escherichia coli
  n 1121, 1122, 1123, 1124, 1125: n is any nucleotide
atgaaaaaacgtatccccactctcctggccaccatgattgccaccgccctttatagtcaacagggactggcagccgacctcgcctcacagtgcatgttgggcgtgccaagctatgaccgtcctctggtacagggcgataccaatgacttacccgtgactatcaatgctgaccacgcgaaaggggactacccggatgacgccgtgtttactggcagcgtggatatcatgcagggtaacagccgtctgcaggccgacgaagtgcagctccatcaaaaagaggcaccaggacaaccggagccggtacgtaccgttgatgcgctcggtaatgtccattacgacgataaccaggtgatcctcaaagggccgaaaggctgggcgaatctgaacaccaaagataccaacgtctgggagggtgattaccagatggtgggtcgccagggccgcggtaaagcggacctgatgaaacaacgtggcgaaaaccgctataccattctggataacggtagctttacctcctgtctgccgggttctgacacctggagcgtggtaggtagcgaaattattcatgaccgcgaagaacaagttgcggagatctggaacgcccgctttaaggtgggtccggtaccgatcttttatagcccctatttgcagttgccggtgggtgacaaacgtcgctctggtttcttgatcccgaacgccaagtacaccaccaccaactactttgagttctacctgccatattactggaacatcgcgccaaatatggatgccaccatcacgccgcattatatgcatcgtcgtggcaatatcatgtgggagaacgaattccgctacctctcccaggcgggcgctggcttgatggaactggactatctgccttcagataaagtctataaagatgaacacccgaacgatgacagttcacgtcgttggttattctactggaaccactccggggtcatggatcaggtgtggcgtttcaacgtcgactacaccaaggtcagcgatcctagctacttcaatgatttcgataacaagtacggttccagtaccgacggctacgcaacgcaaaaattcagcgttggctatgcggtgcaaaacttcaatgccaccgtttcaannnnncattcattcattaattaa

SEQ ID NO: 318 - protein, 380 aa, Escherichia coli
  Xaa 374, 375: Xaa is any amino acid
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYKDEHPNDDSSRRWLFYWNHSGVMDQVWRFNVDYTKVSDPSYFNDFDNKYGSSTDGYATQKFSVGYAVQNFNATVSXXHSFIN

SEQ ID NO: 319 - DNA, 816 bp, Escherichia coli
atgcagtattggggaaaaatcattggtgtggccgtggccttaataatgggcggcggcttttggggcgtagtattgggcctgttaattggccatatgtttgataaagcccgtagccgtaaaatggcgtggttcgccaaccagcgtgagcgtcaggcgctgttttttgccaccacttttgaagtgatggggcatttaaccaaatccaaaggtcgcgtcacggaggctgatattcatatcgccagtcagttgatggaccgaatgaatctgcatggcgcttcccgtactgcggcgcaaaatgcattccgggtgggaaaatcagacaattacccgctgcgcgaaaagatgcgccagtttcgcagtgtctgctttggtcgttttgacttaattcgtatgtttctggagatccagattcaggcggcgtttgctgatggttcactgcacccgaatgaacgggcggtgctgtatgtcattgccgaagagttaggcatctcccgcgcccagtttgaccagtttttgcgcatgatgcagggcggtgcacagtttggtggcggttatcagcagcaatctggcggtggtaactggcagcaagcgcagcgtggcccgacgctggaagatgcctgtaatgtgctgggcgtgaagccgacggatgatgcgaccaccatcaaacgtgcctaccgtaagctgatgagtgaacaccatcccgataagttggtggcgaaaggtttgccgccagagatgatggagatggcgaagcagaaagcgcaggaaattcagcaggcctatgagctgataaagcagcagaaagggtttaaataa

SEQ ID NO: 320 - protein, 271 aa, Escherichia coli
MQYWGKIIGVAVALIMGGGFWGVVLGLLIGHMFDKARSRKMAWFANQRERQALFFATTFEVMGHLTKSKGRVTEADIHIASQLMDRMNLHGASRTAAQNAFRVGKSDNYPLREKMRQFRSVCFGRFDLIRMFLEIQIQAAFADGSLHPNERAVLYVIAEELGISRAQFDQFLRMMQGGAQFGGGYQQQSGGGNWQQAQRGPTLEDACNVLGVKPTDDATTIKRAYRKLMSEHHPDKLVAKGLPPEMMEMAKQKAQEIQQAYELIKQQKGFK

SEQ ID NO: 321 - DNA, 660 bp, Escherichia coli
atggggatggaaaactacaatccgccgcaggacccctggctggttgtcctgtatcaggatgaccatattatggtggtcaacaagccgagcggtttgttgtctgtgccgggtcgtctggaagagcacaaagacagcgtgatgacgcgcattcagcgtgattatccgcaggcagaatcggtgcatcgtctggatatggctaccagcggcgtgattgtagtggcgctgaccaaagccgcggagcgggagttaaaacgccagttccgcgagcgcgagccgaaaaagcagtatgtggcccgcgtctgggggcatccatcccctgcggaaggtctggtggatctgccgctgatttgcgactggccaaaccgcccgaaacagaaagtctgttacgaaacaggtaaacctgcgcagacggaatatgaagtggtggaatatgcagcggataacacggcaagagtggtgttaaaaccgattaccgggcgttcgcatcagctgcgtgtgcatatgctggcgctgggtcatccgattctcggcgatcgtttttatgcatcaccagaagcgagagcaatggcaccgcgtttgttgctacatgcagagatgctgacgattacccatccggcgtatggcaatagtatgacgtttaaagcaccagcggatttttaa

SEQ ID NO: 322 - protein, 219 aa, Escherichia coli
MGMENYNPPQDPWLVVLYQDDHIMVVNKPSGLLSVPGRLEEHKDSVMTRIQRDYPQAESVHRLDMATSGVIVVALTKAAERELKRQFREREPKKQYVARVWGHPSPAEGLVDLPLICDWPNRPKQKVCYETGKPAQTEYEVVEYAADNTARVVLKPITGRSHQLRVHMLALGHPILGDRFYASPEARAMAPRLLLHAEMLTITHPAYGNSMTFKAPADF

SEQ ID NO: 323 - DNA, 2907 bp, Escherichia coli
atgccttttacacttggtcaacgctggatcagcgatacagaaagcgaattgggacttggaaccgttgtcgcggtggatgcgcgaactgtcactttacttttcccatctactggtgaaaaccgtctgtacgcacgcagtgattcccccgtgacccgcgtgatgttcaaccctggtgataccattaccagccatgacggctggcagatgcaagtcgaagaagtaaaagaagaaaatggcttgctgacctatatcggtactcgccttgatactgaagagtccggcgtggccctgcgtgaagttttccttgatagcaaactggtgttcagcaaaccgcaggaccgtctgtttgccgggcagattgaccgtatggaccgctttgcgctgcgttatcgcgcgcgtaagtattccagcgaacagttccgtatgccgtacagcggcctgcgcggtcagcgtaccagcctgatcccgcaccagctcaacatcgctcatgatgttggtcgccgccacgcgccgcgcgtcctgctggctgacgaagtgggtttagggaaaaccattgaagccgggatgatcctgcatcagcaactgctctctggcgctgctgaacgtgtgctgattatcgtcccggaaaccttacagcatcagtggctggtagaaatgctgcgccgtttcaacctgcgctttgcgctatttgatgatgagcgttatgccgaagctcagcacgatgcttacaacccgttcgacaccgaacagctggtgatttgctcgctggattttgcccgtcgtagcaaacagcgtctggaacatctctgtgaagccgagtgggacctgctggtggtcgatgaagcgcatcacctggtgtggagcgaagatgcgccgagccgtgaatatcaggccattgaacaactggcagagcacgtgcccggcgttctgctgctgaccgcaaccccggaacaactggggatggaaagccacttcgcccgtctgcgtctgctggacccgaaccgtttccacgattttgcgcaattcgttgaagagcagaaaaattatcgtccggttgcggacgccgttgccatgctgctggctggtaacaaactcagcaatgacgaactgaacatgctcggtgagatgatcggcgagcaggatatcgagccgctgttgcaagcagcaaacagcgacagcgaagatgcccagagcgcccgtcaggagctggtttcgatgctgatggatcgccacggcaccagccgcgtgctgttccgtaacacccgtaacggtgtgaaaggcttcccgaaacgcgagctgcacaccattaagctgccgctgccgacgcagtatcagacggctattaaagtctccggcattatgggcgcacgcaaaagtgcggaagatcgcgctcgcgatatgctctacccggagcgtatttatcaggaatttgaaggtgataacgccacctggtggaacttcgatccgcgcgttgagtggctgatgggctacctgaccagccatcgctctcagaaagtgctggtgatctgcgccaaagctgccactgcgctgcaactggagcaggtactgcgcgaacgtgaaggtattcgcgccgcggtattccacgaaggtatgtcgattatcgaacgtgaccgcgctgccgcctggtttgccgaagaagacaccggcgcgcaggtactgctgtgctcggaaatcggttctgaaggacgtaacttccagttcgccagccacatggtaatgtttgacctgccattcaacccggatctgctggagcagcgtattgggcgtctggatcgtatcggtcaggcgcacgatattcagatccatgtgccttatctggaaaaaactgctcagtcggtgctggtgcgctggtatcacgaaggtctggatgcattcgagcacacctgcccgaccggacgcactatttacgatagcgtatacaacgatctgattaactatctggcttcaccggatcaaaccgaaggctttgacgatctgatcaaaaactgccgcgagcaacatgaagcgctgaaagcacagctggaacaaggtcgtgaccgcctgctggaaatccattccaacggtggcgaaaaagcccaggcactggcagaaagcattgaagagcaggatgacgataccaacctgatcgccttcgccatgaacctgttcgatattatcggtatcaatcaggacgatcgcggcgacaacatgatcgtgctgacgccgtccgatcatatgctggtgccggacttccctggcctgtcggaagatggcatcaccatcaccttcgaccgtgaagtggcgctggcgcgtgaagatgcacagtttattacctgggagcatccgctgatccgcaacggtctggatctgatcctttctggcgataccggtagcagcacgatttcactgttgaaaaacaaagcgttgccggtaggtacgctgttggtggaactgatttatgtggttgaagcccaggctccgaagcagttgcagctcaaccgcttcctgccaccgacgccggtacgtatgctgctggataaaaacggcaacaacctggcggcgcaggtagagtttgaaacctttaaccgccagcttaacgcggttaaccgtcacaccggcagcaagctggttaacgccgtgcagcaggatgttcacgctatccttcagctgggggaagcgcagatcgagaaatctgcccgtgcattgattgatgcagcgcgtaacgaagccgacgaaaaactgtctgccgagctgtctcgtctggaagcgctgcgtgcagttaacccgaacattcgtgacgacgaactgaccgccattgagagcaaccgtcagcaggtaatggaaagcctggatcaggcaggctggcgtctggatgccctgcgtttgatcgttgtgacgcatcagtaa

SEQ ID NO: 324 - protein, 968 aa, Escherichia coli
MPFTLGQRWISDTESELGLGTVVAVDARTVTLLFPSTGENRLYARSDSPVTRVMFNPGDTITSHDGWQMQVEEVKEENGLLTYIGTRLDTEESGVALREVFLDSKLVFSKPQDRLFAGQIDRMDRFALRYRARKYSSEQFRMPYSGLRGQRTSLIPHQLNIAHDVGRRHAPRVLLADEVGLGKTIEAGMILHQQLLSGAAERVLIIVPETLQHQWLVEMLRRFNLRFALFDDERYAEAQHDAYNPFDTEQLVICSLDFARRSKQRLEHLCEAEWDLLVVDEAHHLVWSEDAPSREYQAIEQLAEHVPGVLLLTATPEQLGMESHFARLRLLDPNRFHDFAQFVEEQKNYRPVADAVAMLLAGNKLSNDELNMLGEMIGEQDIEPLLQAANSDSEDAQSARQELVSMLMDRHGTSRVLFRNTRNGVKGFPKRELHTIKLPLPTQYQTAIKVSGIMGARKSAEDRARDMLYPERIYQEFEGDNATWWNFDPRVEWLMGYLTSHRSQKVLVICAKAATALQLEQVLREREGIRAAVFHEGMSIIERDRAAAWFAEEDTGAQVLLCSEIGSEGRNFQFASHMVMFDLPFNPDLLEQRIGRLDRIGQAHDIQIHVPYLEKTAQSVLVRWYHEGLDAFEHTCPTGRTIYDSVYNDLINYLASPDQTEGFDDLIKNCREQHEALKAQLEQGRDRLLEIHSNGGEKAQALAESIEEQDDDTNLIAFAMNLFDIIGINQDDRGDNMIVLTPSDHMLVPDFPGLSEDGITITFDREVALAREDAQFITWEHPLIRNGLDLILSGDTGSSTISLLKNKALPVGTLLVELIYVVEAQAPKQLQLNRFLPPTPVRMLLDKNGNNLAAQVEFETFNRQLNAVNRHTGSKLVNAVQQDVHAILQLGEAQIEKSARALIDAARNEADEKLSAELSRLEALRAVNPNIRDDELTAIESNRQQVMESLDQAGWRLDALRLIVVTHQ

SEQ ID NO: 325 - DNA, 108 bp, Escherichia coli
ttgggctattttgagcaaaaaaagagttcgccagataccattttgatgcgtgacgaatgctttgccatccagtaccatagcgccctttccattcctggacctgaataa

SEQ ID NO: 326 - protein, 35 aa, Escherichia coli
MGYFEQKKSSPDTILMRDECFAIQYHSALSIPGPE

SEQ ID NO: 327 - DNA, 2352 bp, Escherichia coli
gtggcgcaggcaggttttatcttaacccgacactggcgggacaccccgcaagggaccgaagtttccttcttgctggcaacggacaacgggccgttgcaggttacgcttgcgccgcaagagtccgtggcatttattcccgccgatcatgttccccgcgctcagcatattttgcagggtgaacaaggctttcgcctgacgccgctggcgttaaaagattttcaccgccagccggtgtatggcctttactgtcgcgcccatcgccagttgatgaattacgaaaagcgcctgcgtgaaggtggcgttaccgtctacgaggccgatgtgcgcccgccagaacgctatctgatggagcggtttatcacctcgccagtgtgggtcgagggtgatatgcgcaacggcgctatcgttaatgcccgtctgaaaccgcatcccgactatcgtccgccgctcaagtgggtttctattgatattgaaaccacccgccacggtgagctgtactgcatcggcctggaaggttgcgggcagcgtatcgtttatatgctggggccagagaatggcgacgcctccgcgctcgattttgaactggaatacgtcgccagccgcccgctgctactggaaaaacttaacgcctggtttgcgactcatgatcctgatgtgatcatcggttggaacgtggtgcagttcgatctgcgaatgctgcaaaaacatgccgagcgttaccgtattccgctgcgtctggggcgtgataacagcgagctggagtggcgcgagcacggctttaaaaacgacgtcttttttgctcaggccaaagggcgactgattatcgacggtatcgaggcgctgaaatccgcgttctggaatttctcttcattctcgctggaaaccgtcgctcaggagttattaggcgaaggaaaatctatcgataacccgtgggatcgaatggacgaaattgaccgccgtttcgccgaagataagcctgcgctggcaacttataacctgaaagattgcgagctggtgacgcagatcttccacaaaactgaaatcatgccgtttttgctcgaacgggcgacggtgaacggcctgccggtagatcgacacggcggttcggtggcagcgtttggtcatctctattttccccgtatgcatcgcgctggttatgtcgcgcctaatctcggcgaagtgccgccgcacgccagccctggcggctacgtgatggattcgcgacctgggctttatgattcggtgctggtgctggactacaaaagcctgtacccgtcgatcatccgcacctttctgattgatcccgtcgggctggtggaaggcatggcgcagcctgatccagagcacagtaccgaaggttttctcgatgcctggttctcacgggagaaacattgcctgccggagattgtgactaacatctggcacgggcgcgatgaagccaaacgtcagggtaataagccgctttcgcaggcgctgaagatcattatgaatgccttttatggtgtgctcggcaccaccgcctgccgtttcttcgatccacgcctggcatcgtcgatcaccatgcgtggtcatcagatcatgcggcaaaccaaaaccttgattgaagcgcagggctatgatgttatctacggcgataccgactcaacgtttgtctggctgaaaggtgcacattcggaagaagaagcagcgaaaatcggtcgtgcactggtgcagcacgttaacgcctggtgggcggaaacgctgcaaaaacaacggctgaccagcgcactggaactggagtatgaaacccatttctgccgttttctgatgccaaccattcgcggggccgataccggcagcaaaaagcgctacgccggactgattcaggagggcgacaaacagcggatggtgtttaaagggctggaaaccgtgcgcaccgactggacgccgctggcccagcagtttcagcaggagctttacctgcgcatcttccgcaacgagccatatcaggaatacgtgcgcgaaaccatcgacaagctgatggcgggcgaactggacacgcggctggtttaccgtaaacgccttcgccgtccgctgagcgaatatcagcgtaatgttccgcctcatgtacgcgccgctcgccttgccgatgaagaaaaccataagcgcggtcgccccttgcaatatcagaaccgcggcaccattaagtacgtatggaccaccaacggcccggagccgctggactaccaacgttcaccgctggattacgaacactatctgacccgccagttacaacccgtggcggagggaatactcccttttattgaggataattttgctacacttatgaccgggcaacttgggctattttga

SEQ ID NO: 328 - protein, 783 aa, Escherichia coli
MAQAGFILTRHWRDTPQGTEVSFLLATDNGPLQVTLAPQESVAFIPADHVPRAQHILQGEQGFRLTPLALKDFHRQPVYGLYCRAHRQLMNYEKRLREGGVTVYEADVRPPERYLMERFITSPVWVEGDMRNGAIVNARLKPHPDYRPPLKWVSIDIETTRHGELYCIGLEGCGQRIVYMLGPENGDASALDFELEYVASRPLLLEKLNAWFATHDPDVIIGWNVVQFDLRMLQKHAERYRIPLRLGRDNSELEWREHGFKNDVFFAQAKGRLIIDGIEALKSAFWNFSSFSLETVAQELLGEGKSIDNPWDRMDEIDRRFAEDKPALATYNLKDCELVTQIFHKTEIMPFLLERATVNGLPVDRHGGSVAAFGHLYFPRMHRAGYVAPNLGEVPPHASPGGYVMDSRPGLYDSVLVLDYKSLYPSIIRTFLIDPVGLVEGMAQPDPEHSTEGFLDAWFSREKHCLPEIVTNIWHGRDEAKRQGNKPLSQALKIIMNAFYGVLGTTACRFFDPRLASSITMRGHQIMRQTKTLIEAQGYDVIYGDTDSTFVWLKGAHSEEEAAKIGRALVQHVNAWWAETLQKQRLTSALELEYETHFCRFLMPTIRGADTGSKKRYAGLIQEGDKQRMVFKGLETVRTDWTPLAQQFQQELYLRIFRNEPYQEYVRETIDKLMAGELDTRLVYRKRLRRPLSEYQRNVPPHVRAARLADEENHKRGRPLQYQNRGTIKYVWTTNGPEPLDYQRSPLDYEHYLTRQLQPVAEGILPFIEDNFATLMTGQLGLF

SEQ ID NO: 329 - DNA, 696 bp, Escherichia coli
atgttagaagatctcaaacgccaggtcttagaagccaacctggcgctgccaaaacacaacctggtcacgctcacctggggcaatgtcagcgccgttgatcgcgggcgcggcgtcctggtgatcaaaccttccggcgtcgactacagcaccatgaccgctgacgatatggtcgtggtcagcatcgaaaccggtgaagtggttgaaggtacgaaaaagccctcctccgacacgccaactcaccggctgctctatcaggcattcccgtctattggcggcattgtgcacacacactcgcgccacgccaccatctgggcgcaggcgggtcagtcgattccagcaaccggtaccacccacgccgactatttctacggcaccattccctgcacccgcaaaatgaccgacgcagaaatcaacggtgaatatgagtgggaaaccggtaacgtcatcgtagaaaccttcgaaaaacagggtatcgatgcagcgcaaatgcccggcgtgctggtccattctcacggcccgtttgcatggggcaaaaatgccgaagatgcggtgcataacgccatcgtgctggaagaagtcgcttatatgggtatattctgccgtcagttagcgccgcagttaccggatatgcagcaaacgctactggataaacactatctgcgtaagcatggcgcgaaggcatattacgggcagtaa

SEQ ID NO: 330 - protein, 231 aa, Escherichia coli
MLEDLKRQVLEANLALPKHNLVTLTWGNVSAVDRGRGVLVIKPSGVDYSTMTADDMVVVSIETGEVVEGTKKPSSDTPTHRLLYQAFPSIGGIVHTHSRHATIWAQAGQSIPATGTTHADYFYGTIPCTRKMTDAEINGEYEWETGNVIVETFEKQGIDAAQMPGVLVHSHGPFAWGKNAEDAVHNAIVLEEVAYMGIFCRQLAPQLPDMQQTLLDKHYLRKHGAKAYYGQ

SEQ ID NO: 331 - DNA, 1503 bp, Escherichia coli
atgacgatttttgataattatgaagtgtggtttgtaattggcagccaacatctttacggcccggagactctgcgccaggtgacgcaacatgcggaacacgttgttaatgcactgaatacagaagcgaagttgccctgcaaactggtgctgaaaccgctgggcaccacgccggatgaaatcaccgctatttgccgcgacgcgaattacgacgatcgttgcgctggtctggtggtgtggctgcacaccttctccccggccaaaatgtggatcaacggcctgaccatgctcaacaaaccgttgctgcaattccacacccagttcaacgcggcgctgccgtgggacagcatcgacatggactttatgaacctgaaccagaccgcgcatggcggtcgcgagttcggcttcatcggcgcgcgtatgcgtcagcaacatgccgttgttaccggtcactggcaggataaacaagcacatgagcgtattggctcctggatgcgtcaggcggtctctaaacaggatacccgtcatctgaaagtctgccgttttggcgataacatgcgtgaagtagcggtcaccgatggcgataaagttgccgcacagatcaagtttggtttctccgtcaatacctgggcggttggcgatctggtgcaggtggtgaactccataagcgacggcgatgttaacgcgctggtcgatgagtacgaaagctgctacaccatgacacctgccacacaaatccacggcgaaaaacgacagaacgtgctggaagcggcgcgtattgagctggggatgaagcgtttcctggaacaaggtggcttccacgctttcactactacctttgaagatttgcacggcctgaaacagcttccgggtctggccgtacagcgtctgatgcagcagggctacggctttgcgggcgaaggcgactggaaaactgccgccctgcttcgcatcatgaaggtgatgtcaaccggtctgcagggcggcacctcctttatggaggactacacctatcacttcgagaaaggtaatgacctggtactcggctcccatatgctggaagtctgtccgtcgatcgctgtggaagagaaaccgatcctcgacgttcagcatctcggtattggcggtaaagacgatcctgcccgcctgatcttcaacactcaaaccggtccagccattgtcgccagcctgattgatctcggcgatcgttaccgtctgctggttaactgcatcgacacggtgaaaacaccgcactccctgccgaaactgccggtggcgaatgcgctgtggaaagcgcaaccggatctgccgaccgcttccgaagcgtggatccttgccggtggcgcgcaccataccgtcttcagccatgcgctgaacctcaacgatatgcgccagttcgccgagatgcacgacattgaaatcacagtgattgataacgatacccgccttccagcgtttaaagacgcgctgcgctggaacgaagtgtattacggatttcgtcgctaa

SEQ ID NO: 332 - protein, 500 aa, Escherichia coli
MTIFDNYEVWFVIGSQHLYGPETLRQVTQHAEHVVNALNTEAKLPCKLVLKPLGTTPDEITAICRDANYDDRCAGLVVWLHTFSPAKMWINGLTMLNKPLLQFHTQFNAALPWDSIDMDFMNLNQTAHGGREFGFIGARMRQQHAVVTGHWQDKQAHERIGSWMRQAVSKQDTRHLKVCRFGDNMREVAVTDGDKVAAQIKFGFSVNTWAVGDLVQVVNSISDGDVNALVDEYESCYTMTPATQIHGEKRQNVLEAARIELGMKRFLEQGGFHAFTTTFEDLHGLKQLPGLAVQRLMQQGYGFAGEGDWKTAALLRIMKVMSTGLQGGTSFMEDYTYHFEKGNDLVLGSHMLEVCPSIAVEEKPILDVQHLGIGGKDDPARLIFNTQTGPAIVASLIDLGDRYRLLVNCIDTVKTPHSLPKLPVANALWKAQPDLPTASEAWILAGGAHHTVFSHALNLNDMRQFAEMHDIEITVIDNDTRLPAFKDALRWNEVYYGFRR

SEQ ID NO: 333 - DNA, 1701 bp, Escherichia coli
atggcgattgcaattggcctcgattttggcagtgattctgtgcgagctttggcggtggattgcgccaccggtgaagagatcgccaccagcgtagagtggtatccccgttggcagaaagggcaattttgtgatgccccaaataaccagttccgtcatcatccgcgtgactacattgagtcaatggaagcggcgctgaaaaccgtgcttgcagagcttagcgccgagcagcgcgcagctgtggtcgggattggcgttgacacaaccggctcgacgcccgcaccgattgacgccgacggtaacgtcctggcgctgcgcccggagtttgccgaaaacccgaacgcgatgttcgtattgtggaaagaccacaccgcggttgaagaagcggaagagattacccgtttgtgccacgcgccgggcaacgttgactactcccgctatattggcggtatttattccagcgaatggttctgggcaaaaatcctgcatgtgactcgccaggacagcgccgtggcgcaatctgccgcatcgtggattgagctgtgcgactgggtaccagctctgctttccggtaccacccgcccgcaggatattcgtcgcggacgttgcagcgccgggcataaatctctgtggcacgaaagctggggtggcctgccgccagccagtttctttgatgagctggacccaatcctcaatcgccatttgccttccccactattcactgacacctggactgccgatattccggtgggcaccttatgcccggaatgggcgcagcgtctcggcctgcctgaaagcgtggtgatttccggcggcgcgtttgactgccatatgggcgcagttggcgcaggcgcacagcctaacgctctggtaaaagttatcggtacttccacctgcgacattctgattgccgacaaacagagcgttggcgagcgggcagtgaaaggtatttgcggtcaggttgatggcagcgtggtgcctggatttatcggtctggaagcaggccaatcggcgtttggtgatatctacgcctggtttggacgcgtactcagctggccgctggaacagcttgccgcccagcatccggaactgaaagagcaaatcaacgccagccagaaacaactgcttccggcgctgaccgaagcatgggccaaaaatccgtctctggatcacctgccggtggtgctcgactggtttaacggtcgccgcacgccaaacgctaaccaacgcctgaaaggagtgattaccgatctgaacctcgccaccgacgctccgctgctgttcggcggtttaattgccgccaccacctttggcgcacgcgcaatcatggagtgctttaccgatcaggggatcgccgtcaataacgtgatggcgctgggcggcatcgcgcggaaaaaccaggtcattatgcaggcctgctgcgacgtgctgaatcgcccgctgcaaattgttgcctctgaccagtgctgtgcgctcggtgcggcgatttttgctgctgtcgccgcgaaagtgcacgcagacatcccatcagcccagcaaaaaatggccagtgcggtagagaaaaccctgcaaccgcgcagcgaacaggcacaacgctttgaacagctttatcgccgctatcagcaatgggcgatgagcgccgaacaacactatcctccaacttccgccccggcacaggctgcccaggccgttccgactctataa

SEQ ID NO: 334 - protein, 566 aa, Escherichia coli
MAIAIGLDFGSDSVRALAVDCATGEEIATSVEWYPRWQKGQFCDAPNNQFRHHPRDYIESMEAALKTVLAELSAEQRAAVVGIGVDTTGSTPAPIDADGNVLALRPEFAENPNAMFVLWKDHTAVEEAEEITRLCHAPGNVDYSRYIGGIYSSEWFWAKILHVTRQDSAVAQSAASWIELCDWVPALLSGTTRPQDIRRGRCSAGHKSLWHESWGGLPPASFFDELDPILNRHLPSPLFTDTWTADIPVGTLCPEWAQRLGLPESVVISGGAFDCHMGAVGAGAQPNALVKVIGTSTCDILIADKQSVGERAVKGICGQVDGSVVPGFIGLEAGQSAFGDIYAWFGRVLSWPLEQLAAQHPELKEQINASQKQLLPALTEAWAKNPSLDHLPVVLDWFNGRRTPNANQRLKGVITDLNLATDAPLLFGGLIAATTFGARAIMECFTDQGIAVNNVMALGGIARKNQVIMQACCDVLNRPLQIVASDQCCALGAAIFAAVAAKVHADIPSAQQKMASAVEKTLQPRSEQAQRFEQLYRRYQQWAMSAEQHYPPTSAPAQAAQAVPTL

SEQ ID NO: 335 - DNA, 846 bp, Escherichia coli
atggctgaagcgcaaaatgatcccctgctgccgggatactcgtttaacgcccatctggtggcgggtttaacgccgattgaggccaacggttatctcgatttttttatcgaccgaccgctgggaatgaaaggttatattctcaatctcaccattcgcggtcagggggtggtgaaaaatcagggacgagaatttgtctgccgaccgggtgatattttgctgttcccgcctggagagattcatcactacggtcgtcatccggaggctcacgaatggtatcaccagtgggtttactttcgtccgcgcgcctactggcatgaatggcttaactggccgtcgatatttgccaataccggtttctttcgcccggatgaagcgcaccagccgcatttcagcgacctgtttgggcaaatcattaatgccggacaaggggaagggcgctattcggaattgctggcgataaatctgcttgagcaattgttactgcggcgcatggaagcgattaacgagtcgctccatccaccgatggataatcgggtacgcgaggcttgtcagtacatcagcgatcacctggcagacagtaattttgatatcgccagcgtcgcacagcatgtctgcctgtcgccgtcgcgtctgtcgcatttgttccgccagcagttagggattagcgtattaagctggcgcgaggaccagcgcatcagtcaggcgaagctgcttttgagcaccacccggatgcctatcgccaccgtcggtcgcaatgtcggttttgatgatcaactctatttctcgcgagtatttaaaaaatgcaccggggcgagtccgagcgagtttagggcaggttgtgaataa

SEQ ID NO: 336 - protein, 281 aa, Escherichia coli
MAEAQNDPLLPGYSFNAHLVAGLTPIEANGYLDFFIDRPLGMKGYILNLTIRGQGVVKNQGREFVCRPGDILLFPPGEIHHYGRHPEAHEWYHQWVYFRPRAYWHEWLNWPSIFANTGFFRPDEAHQPHFSDLFGQIINAGQGEGRYSELLAINLLEQLLLRRMEAINESLHPPMDNRVREACQYISDHLADSNFDIASVAQHVCLSPSRLSHLFRQQLGISVLSWREDQRISQAKLLLSTTRMPIATVGRNVGFDDQLYFSRVFKKCTGASPSEFRAGCE

SEQ ID NO: 337 - DNA, 849 bp, Escherichia coli
atgagcaaacgtaacgatattactgatggaatatttgcaacaacgaaaaagtatggattagtttataccgaagagttaggttggatcgatttggggcatgctcagggacaagatgccagaatattaaaaagaaaattggagcaagaacatttttcaacatattacgatgaatttcatgattggtattttcctgttgattatcatcaggaaatgggaattcggaaaaaaatattaggagtagatcttacatttcataccggtgtttatacgaaggttatggttcgttcatgtctttcacccactcttaaagcaagagttgccttaacgttaatgtatggaactgcgaagaggtttgaagcatggcaaaactcatttatttttaactggtatactgatagcggatttagtgcagaagatttagtctcagacttgattggtttttatcgtgtatttggaacaggccccgatccacttttattggcaaaacctttatcttacacaaaagccttacaaatatgggatacatatggagcgccagggaattttaaaaatactgagtttacgccattcttatttacaacccatcctccttttaaaaaaaatcaactaataaaaaagaagcttccagaatggttaaattatataaagccattagatgagtctttttcaatattgttatataatcaatataataatagacctgttactaattattataaagataaaaacagaataaatcatgagttgtatagttcattatcaagttcgggagctataaagttttcagaatctccctttgaaagaccgctttttcttttcttaaaccctcattatccgcacaggtcgtga

SEQ ID NO: 338 - protein, 282 aa, Escherichia coli
MSKRNDITDGIFATTKKYGLVYTEELGWIDLGHAQGQDARILKRKLEQEHFSTYYDEFHDWYFPVDYHQEMGIRKKILGVDLTFHTGVYTKVMVRSCLSPTLKARVALTLMYGTAKRFEAWQNSFIFNWYTDSGFSAEDLVSDLIGFYRVFGTGPDPLLLAKPLSYTKALQIWDTYGAPGNFKNTEFTPFLFTTHPPFKKNQLIKKKLPEWLNYIKPLDESFSILLYNQYNNRPVTNYYKDKNRINHELYSSLSSSGAIKFSESPFERPLFLFLNPHYPHRS

SEQ ID NO: 339 - DNA, 765 bp, Escherichia coli
atgcaagcattgctggaacactttattacccaatccaccgtgtattcattgatggcggtggtgttggtggcctttctggagtcgctggcgctggtcggtttgattctacccggtacggtgctgatggcggggctgggagcgctgattggtagcggtgagttaagtttctggtacgcctggctggcggggattattggctgcctgatgggcgactggatctccttctggctgggctggcgttttaaaaagccgttgcatcgctggtcatttctgaagaagaacaaagcattactcgataaaaccgaacatgcgctgcatcagcacagcatgttcaccattctggtcggtcgttttgtcggtccgacgcgtccgctggtgccaatggtggcgggaatgctggatctcccggtggcaaaatttattacgccgaatattatcggctgcttgctgtggccacagttttacttcctgccggggattctggcgggtgcggcgatcgatattcctgccgggatgcagagcggtgagtttaaatggttgctgctggcaacagcggtgtttttgtgggttggaggctggctgtgctggcggttatggcgcagcggtaaagcgactgaccgtttgagtcattatttgtcccgcggtcgtttgttgtggctgacgccgttgatttctgccatcggcgtggtggcgctggtggtgttaattcgccacccgttgatgccggtgtatatcgatattttgcgtaaagtggttggggtttag

SEQ ID NO: 340 - protein, 254 aa, Escherichia coli
MQALLEHFITQSTVYSLMAVVLVAFLESLALVGLILPGTVLMAGLGALIGSGELSFWYAWLAGIIGCLMGDWISFWLGWRFKKPLHRWSFLKKNKALLDKTEHALHQHSMFTILVGRFVGPTRPLVPMVAGMLDLPVAKFITPNIIGCLLWPQFYFLPGILAGAAIDIPAGMQSGEFKWLLLATAVFLWVGGWLCWRLWRSGKATDRLSHYLSRGRLLWLTPLISAIGVVALVVLIRHPLMPVYIDILRKVVGV

SEQ ID NO: 341 - DNA, 720 bp, Escherichia coli
ttgaaaaaataccggggcgaaatgttaaaactgactgatatcacctggctttaccaccatttgccgatgcgttttagcttaacggtggaacgcggcgagcaggtggcgatcctcgggccaagcggcgcaggtaaaagtaccctgcttaatttgatcgccggttttctgacgccagccagcggtttgctgactatcgacgacgtagatcacaccacgacgccgccgtcacgccgtccggtgtcgatgctgtttcaggagaacaacctgttcagccatctgacggtcgcgcaaaacatcgggctggggctaaatccggggttgaaactaaatgcggcgcagcagaagaaaatgcacgcgattgcccaccagatggggattgataatttaatggcgcggttacctggcgagctttccggcggtcagcgacagcgcgtggcgttagcgcgttgtctggtacgcgaacagcccattttattgctcgatgaaccgttttccgcactcgatccggcgctacgtcaggagatgctgacgctggtgagttcgagctgccaacagcaaaaaatgacgctcttgatggtgtcgcacagtgtggaagatgcggcgcggatcgccacgcgctcggtggtggtcgccgacgggcgtatcgcctggcagggtaagaccgatgagttgttgagcggtaaggcgagtgcttcggcgctgttgggaattaaaggttaa

SEQ ID NO: 342 - protein, 239 aa, Escherichia coli
MKKYRGEMLKLTDITWLYHHLPMRFSLTVERGEQVAILGPSGAGKSTLLNLIAGFLTPASGLLTIDDVDHTTTPPSRRPVSMLFQENNLFSHLTVAQNIGLGLNPGLKLNAAQQKKMHAIAHQMGIDNLMARLPGELSGGQRQRVALARCLVREQPILLLDEPFSALDPALRQEMLTLVSSSCQQQKMTLLMVSHSVEDAARIATRSVVVADGRIAWQGKTDELLSGKASASALLGIKG

SEQ ID NO: 343 - DNA, 1611 bp, Escherichia coli
atggcaacgcgccgtcagccgttaattcccggctggttaattccaggcgtaagcgccgccacgctggtggtggcggttgcactggcggcgtttctcgccctgtggtggaacgcgccgcagggtgactgggtggcagtctggcaggacagctacctgtggcatgtggtgcgcttctccttctggcaggcgtttctctcggcgctgctctctgtcgtacccgcaatattcctcgcccgcgccctctatcgcaggcgctttcctgggcgacagatgctgttgcgtctgtgcgcaatgaccttgatcctcccggtgctggttgctgttttcggcattcttagcgtctatggtcgccagggctggctggcctcgctctggcaatcacttggtctggagtggaccttttcgccctacggcctgcaaggcattttgctggcccatgtgttttttaatctgccgatggctagccgtttattactccaggcactggaaaacattcccggcgaacaacgtcagcttgccgcccaacttgggatgcacggctggcattttttccgtttcgtcgaatggccgtggttacggcgacaaatcccgccggttgccgcactaatctttatgctctgtttcgccagcttcgccaccgtgctatcgctgggcggcggtccgcaggcgaccactatcgagctggcaatctatcaggcgctgagttacgactacgatcctgcccgcgcggcaatgctggcgctgatccagatggtgtgctgcctcgggctggtgctgttgagtcagcgattgagtaaggccattgcgcctggtaccacactgctgcaaggctggcgcgacccggacgatcgtctgcatagtcgcatttgcgacacggcgttaattgtgctggcgctgctgctgttgctgccaccgttactggcggtgatcgtcgatggggtaaatcgccagttgccggaagtgctggcacaaccggtgctgtggcaggcgctgtggacctcgttgcgtattgcgctggcggcaggcgtattgtgcgtagtgctgaccatgatgctgctatggagcagtcgcgaacttcgggcgcggcagaaaatgctggcgggtcaggcgctggagatgagcggcatgttgatcctcgccatgccggggattgtgctggctacgggcttctttttactgctcaacaacactatcggcctgccacaatctgctgacggcattgtgattttcaccaatgcgttaatggcaatcccttatgcgctgaaagtgctggaaaacccgatgcgcgatatcaccgcccgctacagcatgttgtgtcagtcgctgggcattgaaggctggtcacgcttaaaagtggtggagctgcgcgccctgaaacgtccactggcgcaggcgctggcctttgcttgtgtgctgtcgattggtgattttggcgtggtggcattgttcggtaacgatgatttccgtaccctgccgttttatctctaccagcaaattggctcctatcgcagccaggacggcgcggtcaccgcgttaattctgctgctgctctgttttctgctgtttaccgtgattgaaaaaataccggggcgaaatgttaaaactgactga

SEQ ID NO: 344 - protein, 536 aa, Escherichia coli
MATRRQPLIPGWLIPGVSAATLVVAVALAAFLALWWNAPQGDWVAVWQDSYLWHVVRFSFWQAFLSALLSVVPAIFLARALYRRRFPGRQMLLRLCAMTLILPVLVAVFGILSVYGRQGWLASLWQSLGLEWTFSPYGLQGILLAHVFFNLPMASRLLLQALENIPGEQRQLAAQLGMHGWHFFRFVEWPWLRRQIPPVAALIFMLCFASFATVLSLGGGPQATTIELAIYQALSYDYDPARAAMLALIQMVCCLGLVLLSQRLSKAIAPGTTLLQGWRDPDDRLHSRICDTALIVLALLLLLPPLLAVIVDGVNRQLPEVLAQPVLWQALWTSLRIALAAGVLCVVLTMMLLWSSRELRARQKMLAGQALEMSGMLILAMPGIVLATGFFLLLNNTIGLPQSADGIVIFTNALMAIPYALKVLENPMRDITARYSMLCQSLGIEGWSRLKVVELRALKRPLAQALAFACVLSIGDFGVVALFGNDDFRTLPFYLYQQIGSYRSQDGAVTALILLLLCFLLFTVIEKIPGRNVKTD

SEQ ID NO: 345 - DNA, 984 bp, Escherichia coli
gtgttaaaaaaatgtcttcccctgctgttgctgtgcacagcgcctgttttcgctaaacctgttctgactgtttatacctacgattcctttgccgctgactggggacctggtccggtagtcaaaaaagcctttgaagcagactgtaattgcgaactgaaactggtggcgctggaagatggcgtttcgcttctcaaccgtctgcggatggaaggcaaaaacagtaaagccgatgtggtgctggggctggataacaatctgttagacgccgccagcaaaacagagctgtttgctaaaagcggtgtggcagcggaagccgttaacgttcctggcggctggaataatgacactttcgtaccgtatgattacggctatttcgccttcgtctatgacaagaacaaactgaaaaatccgccgcaaagcctgaaagaactggttgagagcgatcaaaactggcgggtgatttatgaagatccacgtaccagtacaccggggctgggtctgttgctatggatgcaaaaagtctatggcgataacgccccgcaagcctggcagaaactggcgaagaaaactgtcacggtcaccaaaggctggagcgaagcctacggcctgtttttaaaaggcgaaagcgatctggtactgagttacaccacctctccggcttatcacattctcgaagagaagaaagataactacgccgccacaaactttatcgaaggtcactatctgcaggtggaagttgccgcccgcaccgctgccagcaagcagccagagctggcgcaaaaattcctccagtttatggtttctccggcttttcagaatgcgatcccaaccggcaactggatgtatccggtagcaaacgtcactctgcctgcaggatttgaacaattgaccaaaccagccaccacgctagagttcacacccgccgaagtggcggcacaacgtcaggcatggattagcgaatggcaacgcgccgtcagccgttaa

SEQ ID NO: 346 - protein, 327 aa, Escherichia coli
MLKKCLPLLLLCTAPVFAKPVLTVYTYDSFAADWGPGPVVKKAFEADCNCELKLVALEDGVSLLNRLRMEGKNSKADVVLGLDNNLLDAASKTELFAKSGVAAEAVNVPGGWNNDTFVPYDYGYFAFVYDKNKLKNPPQSLKELVESDQNWRVIYEDPRTSTPGLGLLLWMQKVYGDNAPQAWQKLAKKTVTVTKGWSEAYGLFLKGESDLVLSYTTSPAYHILEEKKDNYAATNFIEGHYLQVEVAARTAASKQPELAQKFLQFMVSPAFQNAIPTGNWMYPVANVTLPAGFEQLTKPATTLEFTPAEVAAQRQAWISEWQRAVSR

SEQ ID NO: 347 - DNA, 1656 bp, Escherichia coli
atgccatctgctcgtctgcaacaacagttcatccgcctgtggcaatgctgcgagggtaaatctcaggagaccacgctcaacgaactggcagcgttactgagttgctcgcgtcgtcatatgcgcaccctgctcaacaccatgcaggatcgcggctggctgacgtgggaagcggaagtcgggcgcggtaaacgttcacgcctgacattcctctataccgggctggcgcttcagcaacagcgggcggaagacctgctggagcaggatcgtatcgaccaactagtgcagttggttggcgacaaagcgactgtgcggcaaatgctggtttctcatctgggccgcagcttccgccaggggcggcacatcctgcgcgtgctctactatcgtccgttgcgtaatctgctacctggcagcgcattgcgccgttctgaaacccatatcgcccggcaaatcttcagttcgctaacgcgcataaatgaggaaaatggggaactggaagcagacatcgcacaccactggcagcaaatatcaccgcttcactggcgtttctttttgcgtccaggagtccattttcaccatggtcgtgaactggaaatggacgatgtgatcgcctctttaaaacgaatcaatacgcttccgctctattcgcatattgctaacattgtgtcgccgacgccctggacgctggatatccatctcacgcaaccggaccgctggttgccgttactgctggggcaagttccggcaatgatcctgccgcgcgaatgggaaaccctcagtaactttgccagccatcccatcggcaccggtccgtatgcggtgatccgcaacagcaccaatcaactgaaaattcaggcattcgatgacttcttcggttaccgggcattaatcgacgaagttaacgtctgggttctgccggaaattgccgacgagccagccggagggctgatgctaaaaggtccacagggcgaggaaaaagagattgaaagccgcctggaggaaggttgctactatttactgttcgacagccgcacccatcgaggggcgaatcagcaagtcagagactgggtaagctatgtgctttctccgacgaatctggtctatttcgctgaggaacagtaccagcaactgtggttcccggcttatggactgctcccccgttggcaccatgcccgcaccataaagagcgaaaaaccggctggtctggaaagcctcaccctgaccttttatcaggatcacagcgagcatcgggtgattgccgggatcatgcagcagattctggcaagtcaccaggtcacgctggaaatcaaagagatcagctacgatcagtggcatgaaggagagatcgagagcgatatctggcttaacagcgccaactttacgctgccgctggatttttcgctgttcgcgcacttgtgcgaggtgccgctgctccaacactgtattccgatcgactggcaagccgacgccgcccgctggcgcaatggcgaaatgaatctggcgaactggtgccaacaactggtcgccagcaaagcaatggtgccacttatccaccactggctgatcattcaggggcaacgtagtatgcgcggcctgcgcatgaacaccctcggctggttcgattttaaatcagcgtggtttgcaccaccggatccatga

SEQ ID NO: 348 - protein, 551 aa, Escherichia coli
MPSARLQQQFIRLWQCCEGKSQETTLNELAALLSCSRRHMRTLLNTMQDRGWLTWEAEVGRGKRSRLTFLYTGLALQQQRAEDLLEQDRIDQLVQLVGDKATVRQMLVSHLGRSFRQGRHILRVLYYRPLRNLLPGSALRRSETHIARQIFSSLTRINEENGELEADIAHHWQQISPLHWRFFLRPGVHFHHGRELEMDDVIASLKRINTLPLYSHIANIVSPTPWTLDIHLTQPDRWLPLLLGQVPAMILPREWETLSNFASHPIGTGPYAVIRNSTNQLKIQAFDDFFGYRALIDEVNVWVLPEIADEPAGGLMLKGPQGEEKEIESRLEEGCYYLLFDSRTHRGANQQVRDWVSYVLSPTNLVYFAEEQYQQLWFPAYGLLPRWHHARTIKSEKPAGLESLTLTFYQDHSEHRVIAGIMQQILASHQVTLEIKEISYDQWHEGEIESDIWLNSANFTLPLDFSLFAHLCEVPLLQHCIPIDWQADAARWRNGEMNLANWCQQLVASKAMVPLIHHWLIIQGQRSMRGLRMNTLGWFDFKSAWFAPPDP

SEQ ID NO: 349 - DNA, 606 bp, Escherichia coli
atggcagagaaatttatcaaacacacaggcctggtggttccgttggatgccgccaatgtcgataccgatgcaatcatcccgaaacagtttttgcagaaagtgacccgtacgggttttggcgcgcatctgtttaacgactggcgttttctggatgaaaaaggccaacagccaaacccggacttcgtgctgaacttcccgcagtatcagggcgcttccattttgctggcacgagaaaacttcggctgcggttcctcgcgtgagcacgcgccgtgggcattgaccgattacggttttaaggtggtgattgcgccgagttttgctgacatcttctacggcaatagctttaacaaccagctgctgccggtgaaattaagcgatgcagaagtggatgagctgtttgcgctggtgaaagccaatccggggattcattttgatgtagacctggaagcgcaagaggtgaaagcgggagagaaaacttatcgctttaccatcgatgccttccgccgccactgcatgatgaacggtctggacagcatcggcctgactctgcagcacgacgatgctattgcgtcttatgaagagaagcaaccggcgtttatgcgttag

SEQ ID NO: 350 - protein, 201 aa, Escherichia coli
MAEKFIKHTGLVVPLDAANVDTDAIIPKQFLQKVTRTGFGAHLFNDWRFLDEKGQQPNPDFVLNFPQYQGASILLARENFGCGSSREHAPWALTDYGFKVVIAPSFADIFYGNSFNNQLLPVKLSDAEVDELFALVKANPGIHFDVDLEAQEVKAGEKTYRFTIDAFRRHCMMNGLDSIGLTLQHDDAIASYEEKQPAFMR

SEQ ID NO: 351 - DNA, 1401 bp, Escherichia coli
atggctaagacgttatacgaaaaattattcgacgctcacgtagtgtacgaagccgaaaacgaaaccccgctgttatatatcgaccgccacctggtgcatgaagtgacctcaccgcaggcgttcgatggtctgcgcgcccacggtcgcccggtacgtcagccgggcaaaaccttcgccaccatggatcacaacgtctctactcagacgaaagacattaatgcctgcggtgaaatggcgcgcatccagatgcaggagctgatcaaaaactgcaaagaatttggcgtcgagctgtatgacctgaatcacccgtatcaggggatcgtccacgtaatggggccggaacagggcgtgaccttgccggggatgaccattgtctgcggcgactcacataccgccacccacggcgcgtttggcgcactggcctttggtatcggcacttccgaagttgaacacgtactggcaacgcaaaccctgaaacagggccgggcgaagaccatgaaaattgaagtccagggcaaagccgcgccgggcattaccgcaaaagatatcgtgctggcaattattggtaaaaccggcagcgcaggcggtaccgggcatgtggtggaattttgcggcgaagcaatccgtgatttaagcatggaaggtcgtatgaccctgtgcaatatggcaatcgaaatgggcgcaaaagccggtctggttgcaccggacgaaaccacctttaactatgttaaaggccgtctgcatgcgccgaaaggcaaagatttcgacgacgccgttgcctactggaaaaccctgcaaaccgacgaaggagcaactttcgataccgttgtcactctgcaagcagaagagatttcgccgcaggtcacctggggcaccaatccaggccaggtgatttctgtgaacgacaatattcccgatccggcttcgtttgccgatccggttgaacgcgcgtcggcagaaaaagcgctggcctatatggggctgaaaccgggtattccgctgacagaagtggctatcgacaaagtgtttattggttcctgtactaactcgcgtattgaagatttacgcgcggcagcggaaatcgccaaaggccggaaagtcgcgccaggcgtacaagcgctggtggttcccggctccggtccggttaaagcccaggcggaagcggaaggtctggacaaaatttttatcgaagctggttttgaatggcgcttgccaggttgttcaatgtgcctggcgatgaacaacgaccgcctgaatccgggcgaacgttgcgcctccaccagcaaccgtaactttgaaggccgccaggggcgcggcgggcgcacgcatctggtcagtccggcaatggctgccgccgcggctgtgaccggacatttcgccgacattcgcaacattaaataa

SEQ ID NO: 352 - protein, 466 aa, Escherichia coli
MAKTLYEKLFDAHVVYEAENETPLLYIDRHLVHEVTSPQAFDGLRAHGRPVRQPGKTFATMDHNVSTQTKDINACGEMARIQMQELIKNCKEFGVELYDLNHPYQGIVHVMGPEQGVTLPGMTIVCGDSHTATHGAFGALAFGIGTSEVEHVLATQTLKQGRAKTMKIEVQGKAAPGITAKDIVLAIIGKTGSAGGTGHVVEFCGEAIRDLSMEGRMTLCNMAIEMGAKAGLVAPDETTFNYVKGRLHAPKGKDFDDAVAYWKTLQTDEGATFDTVVTLQAEEISPQVTWGTNPGQVISVNDNIPDPASFADPVERASAEKALAYMGLKPGIPLTEVAIDKVFIGSCTNSRIEDLRAAAEIAKGRKVAPGVQALVVPGSGPVKAQAEAEGLDKIFIEAGFEWRLPGCSMCLAMNNDRLNPGERCASTSNRNFEGRQGRGGRTHLVSPAMAAAAAVTGHFADIRNIK

SEQ ID NO: 353 - DNA, 1092 bp, Escherichia coli
atgtcgaagaattaccatattgccgtattgccgggggacggtattggtccggaagtgatgacccaggcgctgaaagtgctggatgccgtgcgcaaccgatttgcgatgcgtatcaccaccagccattacgatgtaggcggcgcagccattgataaccacggacagccgctgccgcctgcgacggttgaaggttgtgagcaagccgatgccgtgctgtttggctcggtaggtggtccgaagtgggaacatttgccgccagaccagcaaccagaacgcggcgcactgctgcctttgcgtaaacacttcaaattattcagcaatctgcgtccggcaaaactgtatcaggggctggaagcgttctgcccactgcgtgctgacattgccgcaaacggctttgacatcctgtgtgtgcgcgaactgaccggcggcatctatttcggtcagccaaaaggccgcgaaggtagcggacaatatgaaaaagcgtttgataccgaggtgtaccaccgttttgagatcgagcgtattgcccgcatcgcatttgaatctgcccgcaagcgtcgccacaaagtcacctcaatcgacaaagccaacgtgctgcaatcctctattttatggcgggagatcgttaacgagatcgccacggaatacccggatgtcgaactggcgcatatgtacatcgacaacgccaccatgcagctgattaaagatccatcacagtttgacgtcttgctgtgctccaacctgtttggcgacattctgtctgatgagtgcgcaatgatcactggctcaatggggatgttgccttccgccagcctgaacgagcaaggttttggtctgtatgaaccggcgggcggctcggcacccgatatcgcaggtaaaaatatcgccaacccgattgcacaaattctgtcgctggcgctgctgctgcgttacagcctggatgccgatgatgcggcttccgccattgaacgcgccattaaccgcgcattagaagaaggcattcgcactggggatttagcccgtggcgctgccgccgttagtaccgatgaaatgggcgatatcattgcccgctatgtggcagaaggggtgtaa

SEQ ID NO: 354 - protein, 363 aa, Escherichia coli
MSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 355 - DNA, 1572 bp, Escherichia coli
atgagccagcaagtcattattttcgataccacattgcgcgacggtgaacaggcgttacaggcaagcttgagtgtgaaagaaaaactgcaaattgcgctggcccttgagcgtatgggtgttgacgttatggaagtcggtttccccgtctcttcgccgggtgattttgaatcagtgcagaccatcgctcgccaggttaaaaacagccgtgtatgcgcgttagctcgctgcgtggaaaaagatattgacgtggcagccgaatccctgaaagtcgccgaagccttccgtattcatacctttattgccacttcgccaatgcacatcgccaccaagctgcgcagcacgctggacgaagtgatcgaacgcgctatctatatggtgaaacgcgcccgtaattacaccgatgatgttgaattttcttgcgaagatgccggacgcaccccaattgccgatctggcgcgagtggtcgaagcggcgattaatgccggtgccaccaccatcaacattccagacaccgtgggctacaccatgccatttgagttcgccggaatcatcagcggcctgtatgaacgcgtacccaacatcgacaaagccattatttccgtacatacccacgacgatttgggcctggcggtcggcaactcactggcggcggtacatgccggagcacggcaggtagaaggcgcaatgaacgggatcggcgagcgtgccggtaactgttcccttgaagaagtcatcatggcgatcaaagttcgtaaggatattctcaacgtccacaccgccatcaatcaccaggagatatggcgcaccagccagttagttagccagatttgtaatatgccgatcccggcaaacaaagccattgttggcagcggcgcattcgcacactcctccggtatccaccaggatggtgtactgaaaaaccgcgaaaactacgaaatcatgacaccagaatctattggtctgaaccaaatccagctgaatctgacctctcgttcggggcgtgcggcggtgaaacatcgcatggatgagatgggatataaagaaagtgaatataatttagacaacctgtacgacgctttcctgaagctggcggacaaaaaaggccaggtgtttgattacgatctggaggcgctggccttcatcggtaagcagcaagaagagccggagcatttccgtctggattacttcagcgtgcagtcaggttctaacgatattgccactgccgccgtcaaactggcctgtggcgaagaagtcaaagcagaagccgccaacggtaacggtccggtcgatgccgtctaccaggcgataaaccgcatcactgactataacgtcgaactggtgaaatacagcctgaccgccaaaggccacggtaaagatgcgctgggtcaggtggatattgtcgccaactacaacggtcgccgcttccacggcgtcggcctggccaccgatattgtcgagtcctccgccaaagccatggtgcacgtactgaacaatatctggcgtgccgcagaagtcgaaaaagagttgcaacgcaaagctcaacacaacgaaaacaacaaggaaaccgtgtga

SEQ ID NO: 356 - protein, 523 aa, Escherichia coli
MSQQVIIFDTTLRDGEQALQASLSVKEKLQIALALERMGVDVMEVGFPVSSPGDFESVQTIARQVKNSRVCALARCVEKDIDVAAESLKVAEAFRIHTFIATSPMHIATKLRSTLDEVIERAIYMVKRARNYTDDVEFSCEDAGRTPIADLARVVEAAINAGATTINIPDTVGYTMPFEFAGIISGLYERVPNIDKAIISVHTHDDLGLAVGNSLAAVHAGARQVEGAMNGIGERAGNCSLEEVIMAIKVRKDILNVHTAINHQEIWRTSQLVSQICNMPIPANKAIVGSGAFAHSSGIHQDGVLKNRENYEIMTPESIGLNQIQLNLTSRSGRAAVKHRMDEMGYKESEYNLDNLYDAFLKLADKKGQVFDYDLEALAFIGKQQEEPEHFRLDYFSVQSGSNDIATAAVKLACGEEVKAEAANGNGPVDAVYQAINRITDYNVELVKYSLTAKGHGKDALGQVDIVANYNGRRFHGVGLATDIVESSAKAMVHVLNNIWRAAEVEKELQRKAQHNENNKETV

SEQ ID NO: 357 - DNA, 945 bp, Escherichia coli
atgccagaggtacaaacagatcatccagagacggcggagttaagcaagccacagctacgcatggtcgatctcaacttattaaccgttttcgatgccgtgatgcaggagcaaaacatcacccgtgccgctcatgctctgggaatgtcgcaacctgcggtcagtaacgctgttgcacgcctgaaggtgatgtttaatgacgagctttttgttcgttatggccgtggtattcaaccgactgctcgcgcatttcaactttttggctcagttcgtcaggcattgcaactagtacaaaatgaattgcctggttcaggttttgaacccgcgagcagtgaacgtgtatttcatctttgtgtttgcagcccgttagacagcattctgacctcgcagatttataatcacattgagcagattgcgccaaatatacatgttatgttcaagtcttcattaaatcagaacactgaacatcagctgcgttatcaggaaacggagtttgtgattagttatgaagacttccatcgccctgaatttaccagtgtgccattatttaaagatgaaatggtgttggtagccagcaaaaatcatccaacaattaaaggcccgttactgaagcatgatgtttataacgaacaacacgctgcggtttcgctcgatcgtttcgcatcatttagtcaaacctggtatgacacggtagataagcaagccagtatcgcgtatcagggcatggcaatgatgagcgtacttagcgtggtgtcgcaaacgcatctggtcgctattgcgccgcgttggttggctgaagagttcgctgaatccttagagttacaggtattaccgctgccgttaaaacaaaacagcagaacctgttatctctcctggcatgaagctgccgggcgcgataaaggccatcagtggatggaagagcaattagtctcaatttgcaaacgctaa

SEQ ID NO: 358 - protein, 314 aa, Escherichia coli
MPEVQTDHPETAELSKPQLRMVDLNLLTVFDAVMQEQNITRAAHALGMSQPAVSNAVARLKVMFNDELFVRYGRGIQPTARAFQLFGSVRQALQLVQNELPGSGFEPASSERVFHLCVCSPLDSILTSQIYNHIEQIAPNIHVMFKSSLNQNTEHQLRYQETEFVISYEDFHRPEFTSVPLFKDEMVLVASKNHPTIKGPLLKHDVYNEQHAAVSLDRFASFSQTWYDTVDKQASIAYQGMAMMSVLSVVSQTHLVAIAPRWLAEEFAESLELQVLPLPLKQNSRTCYLSWHEAAGRDKGHQWMEEQLVSICKR

SEQ ID NO: 359 - DNA, 1815 bp, Escherichia coli
gtgtttatgtctctgtctgccaattgcttaagcaagatcggacggttaatgtgttttacacattttttccgtcaaacagtgaggcaggccatggagatgttgtctggagccgagatggtcgtccgatcgcttatcgatcagggcgttaaacaagtattcggttatcctggaggcgcggtccttgatatttacgatgcattgcataccgtgggtggtatcgatcatgttttagttcgccatgagcaggcggcggtgcatatggccgatggtctggcgcgcgcgaccggggaagtcggcgtcgtgctggtaacgtcgggtccaggggcgaccaatgcgattactggcattgccaccgcttatatggattccattccattagttgtcctttccgggcaggtagcgacctcgttgataggttatgatgcctttcaggagtgcgacatggtggggatttctcgcccggtggttaaacacagttttctggttaagcaaacggaagacattccgcaggtgctgaaaaaggctttctggctagcggcaagtggtcgtcctggacccgtggtcgttgatttaccgaaagatattctaaatccggcgaacaaattaccctatgtctggccggagtcggtcagtatgcgttcttacaatcccacgacctccgggcataaagggcaaattaagcgcgctctgcaaacgctggtggcggcaaaaaaaccggttgtctacgtaggcggtggggcaatcacggcgggctgccatctgcagttgaaagaagcggtggaggtgttgaatctgcccgttgtttcctctttgatggggctgggggcgtttccggcaacgcatcgccaggcactgggcatgttgggaatgcacggtacctacgaagccaatatgacgatgcataacgcggatgtgattttcgccgtcggggtacgttttgatgaccgaacgacgaacaatctggcaaagtactgcccaaatgccactgttctgcatatcgatattgatccaacctcaatttctaaaaccgtgactgctgatatcccgattgtgggggatgctcgccaggtcctagaacaaatgcttgaactcctgtcgcaagaatccgcccatcaaccgctggatgagatccgcgactggtggcagcagattgaacagtggcgcgctcgtcagtgcctgaaatatgacactcacagtgaaaagattaaaccgcaggcggtgatcgagactctttggcggttgactcatggggacgcttacgtgacgtccgatgtcgggcagcaccagatgtttgctgcgctttattatccattcgacaaaccgcgtcgctggatcaactctggcggcctcggcacgatgggttttggtttacctgcggcactgggcgtcaaaatggcgttgccagaagaaaccgtggtttgcgtcactggtgacggcagtattcagatgaacatccaggaactgtctaccgcgttgcaatatgagttgcccgtactggtggtgaatctcaataaccgctatctggggatggtgaagcagtggcaggacatgatctattccggccgtcattcacaatcttatatgcagtccttaccagacttcgtccgtctggcggaagcctatggtcacgtcgggatccagatctctcatccgcaagaactggaaagcaaacttagcgaggcgctggaacaggtgcgcaataatcgcctggtgtttgttgatgttaccgtcgatggcagtgagcacgtctacccgatgcagattcgcgggggcggaatggatgaaatgtggttaagcaaaacggagagaacctga

SEQ ID NO: 360 - protein, 604 aa, Escherichia coli
MFMSLSANCLSKIGRLMCFTHFFRQTVRQAMEMLSGAEMVVRSLIDQGVKQVFGYPGGAVLDIYDALHTVGGIDHVLVRHEQAAVHMADGLARATGEVGVVLVTSGPGATNAITGIATAYMDSIPLVVLSGQVATSLIGYDAFQECDMVGISRPVVKHSFLVKQTEDIPQVLKKAFWLAASGRPGPVVVDLPKDILNPANKLPYVWPESVSMRSYNPTTSGHKGQIKRALQTLVAAKKPVVYVGGGAITAGCHLQLKEAVEVLNLPVVSSLMGLGAFPATHRQALGMLGMHGTYEANMTMHNADVIFAVGVRFDDRTTNNLAKYCPNATVLHIDIDPTSISKTVTADIPIVGDARQVLEQMLELLSQESAHQPLDEIRDWWQQIEQWRARQCLKYDTHSEKIKPQAVIETLWRLTHGDAYVTSDVGQHQMFAALYYPFDKPRRWINSGGLGTMGFGLPAALGVKMALPEETVVCVTGDGSIQMNIQELSTALQYELPVLVVNLNNRYLGMVKQWQDMIYSGRHSQSYMQSLPDFVRLAEAYGHVGIQISHPQELESKLSEALEQVRNNRLVFVDVTVDGSEHVYPMQIRGGGMDEMWLSKTERT

SEQ ID NO: 361 - DNA, 492 bp, Escherichia coli
atgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtgcttgagcaaatcgaaaagcaattacacaagctggtcgatgtcttgcgcgtgagcgagttggggcagggcgcgcacgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcgataagcttgatgcatttttagcatcgattcgcgatgtggcgaaaattgtggaagttgctcgctctggtgtggtcggactttcgcgcggcgataaaataatgcgttga

SEQ ID NO: 362 - protein, 163 aa, Escherichia coli
MRRILSVLLENESGALSRVIGLFSQRGYNIESLTVAPTDDPTLSRMTIQTVGDEKVLEQIEKQLHKLVDVLRVSELGQGAHVEREIMLVKIQASGYGRDEVKRNTEIFRGQIIDVTPSLYTVQLAGTSDKLDAFLASIRDVAKIVEVARSGVVGLSRGDKIMR

SEQ ID NO: 363 - DNA, 1005 bp, Escherichia coli
gtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctaactatcttgaacgccaggcgcggcaacggggttatcaactgctgattgcctgctcggaagatcagcccgacaacgaaatgcgctgcattgagcaccttttacagcgtcaggttgatgccattattgtttcgacgtcgttgccacctgagcatcctttttatcaacgctgggctaacgacccgttcccgattgtcgcgctggaccgcgccctcgatcgtgaacacttcaccagcgtggttggtgccgatcaggatgatgccgaaatgctggcggaagagttacgtaagtttcccgccgagacggtgctttatcttggcgcgctgccggagctttctgtcagcttcctgcgtgaacaaggcttccgtactgcctggaaagatgatccgcgcgaagtgcatttcctttatgccaacagctatgagcgggaggcagctgcccagttattcgaaaaatggctggaaacgcatccgatgccgcaggcgctgttcacaacgtcgtttgcgctgttgcaaggggtgatggatgtcacgctacgtcgcgacggcaaactgccttctgacctggcaattgccacctttggcgataacgaactgctcgacttcttacagtgcccggtgctggcagtggctcaacgtcaccgcgatgtcgcagaacgtgtgctggagattgtcctggcgagcctcgatgaaccgcgtaagccaaaacctggtttaacgcgcattaaacgtaatctctatcgccgcggcgtgctcagccgtagctaa

SEQ ID NO: 364 - protein, 334 aa, Escherichia coli
MKLDEIARLAGVSRTTASYVINGKAKQYRVSDKTVEKVMAVVREHNYHPNAVAAGLRAGRTRSIGLVIPDLENTSYTRIANYLERQARQRGYQLLIACSEDQPDNEMRCIEHLLQRQVDAIIVSTSLPPEHPFYQRWANDPFPIVALDRALDREHFTSVVGADQDDAEMLAEELRKFPAETVLYLGALPELSVSFLREQGFRTAWKDDPREVHFLYANSYEREAAAQLFEKWLETHPMPQALFTTSFALLQGVMDVTLRRDGKLPSDLAIATFGDNELLDFLQCPVLAVAQRHRDVAERVLEIVLASLDEPRKPKPGLTRIKRNLYRRGVLSRS

SEQ ID NO: 365 - DNA, 459 bp, Escherichia coli
atgttccggggagcaacgttagtcaatctcgacagcaaagggcgcttatcagtgcctacccgttatcgggaacagctgcttgagaacgctgccggtcaaatggtttgcaccattgacattcatcacccgtgcctgctgctttaccccctgcctgaatgggaaattatcgagcaaaaattatcgcgtctgtcgagcatgaacccggttgagcgccgtgtgcagcgcctactgttaggtcatgccagcgaatgtcagatggatggcgcaggtcgattgttaatcgcgccagtactgcggcaacatgccgggctgacaaaagaagtgatgctggttggacagttcaacaagtttgagctgtgggatgaaacaacctggcatcaacaggtcaaggaagatatcgacgcagagcagttggctaccggagacttatcggagcgactgcaggacttgtctctataa

SEQ ID NO: 366 - protein, 152 aa, Escherichia coli
MFRGATLVNLDSKGRLSVPTRYREQLLENAAGQMVCTIDIHHPCLLLYPLPEWEIIEQKLSRLSSMNPVERRVQRLLLGHASECQMDGAGRLLIAPVLRQHAGLTKEVMLVGQFNKFELWDETTWHQQVKEDIDAEQLATGDLSERLQDLSL

SEQ ID NO: 367 - DNA, 942 bp, Escherichia coli
atgatggaaaactataaacatactacggtgctgctggatgaagccgttaatggcctcaatatccgtcctgatggcatctacattgatgggacttttggtcgcggtggtcactcacgtctgatcctctcgcagcttggcgaagaggggcgtttgctggcgatcgatcgcgacccgcaggctatcgccgttgcgaagactattgatgatccgcgcttctccatcatccacggacctttctccgcgctgggcgaatacgttgccgagcgcgatcttatcggcaagatcgacggcattctcctcgatcttggcgtctcttcaccgcaacttgatgatgctgagcgcggcttttcctttatgcgcgatggtccgctggacatgcgtatggacccaacccgtgggcagtcagccgctgaatggctacaaaccgcagaagaagccgatatcgcctgggtattgaaaacctatggtgaagagcgttttgccaaacgcattgcccgcgccattgtcgagcgtaaccgcgaacagccgatgacccgcaccaaagaactggcggaagtcgtggctgccgcaacgccggtgaaagataagtttaaacatcccgcgacccgtaccttccaggcggtgcgcatttgggtaaacagtgaactggaggagatagagcaggcgctaaaaagctcgctcaatgtgctggccccgggtgggcggctttcgatcatcagcttccactcgctggaagaccgcattgtgaaacgttttatgcgtgaaaacagccgcggtccgcaagttccggcagggttaccgatgacagaagagcagctcaaaaaactggggggccgtcagttgcgagcactaggtaagttgatgccgggcgaagaagaggtggctgagaaccctcgtgcccgtagttcagttctgcgtattgcagagaggacgaacgcatga

SEQ ID NO: 368 - protein, 313 aa, Escherichia coli
MMENYKHTTVLLDEAVNGLNIRPDGIYIDGTFGRGGHSRLILSQLGEEGRLLAIDRDPQAIAVAKTIDDPRFSIIHGPFSALGEYVAERDLIGKIDGILLDLGVSSPQLDDAERGFSFMRDGPLDMRMDPTRGQSAAEWLQTAEEADIAWVLKTYGEERFAKRIARAIVERNREQPMTRTKELAEVVAAATPVKDKFKHPATRTFQAVRIWVNSELEEIEQALKSSLNVLAPGGRLSIISFHSLEDRIVKRFMRENSRGPQVPAGLPMTEEQLKKLGGRQLRALGKLMPGEEEVAENPRARSSVLRIAERTNA

SEQ ID NO: 369 - DNA, 366 bp, Escherichia coli
atgatcagcagagtgacagaagctctaagcaaagttaaaggatcgatgggaagccacgagcgccatgccttgcctggcgttatcggtgacgatcttttgcgatttgggaagctgccactctgcctgttcatttgcattattttgacggcggtgaccgtggtaaccacggcgcaccatacccgtttactgaccgctcagcgcgaacaactggtgctggagcgagatgctttagacattgaatggcgcaacctgatccttgaagagaatgcgctcggcgaccatagccgggtggaaagaatagccacggaaaagctgcaaatgcagcatgttgatccgtcacaagaaaatatcgtagtgcaaaaataa

SEQ ID NO: 370 - protein, 121 aa, Escherichia coli
MISRVTEALSKVKGSMGSHERHALPGVIGDDLLRFGKLPLCLFICIILTAVTVVTTAHHTRLLTAQREQLVLERDALDIEWRNLILEENALGDHSRVERIATEKLQMQHVDPSQENIVVQK

SEQ ID NO: 371 - DNA, 1767 bp, Escherichia coli
atgaaagcagcggcgaaaacgcagaaaccaaaacgtcaggaagaacatgccaactttatcagttggcgttttgcgttgttatgcggctgtattctcctggcgctggcttttctgctcggacgcgtagcgtggttacaagttatctccccggatatgctggtgaaagagggcgacatgcgttctcttcgcgttcagcaagtttccacctcccgcggcatgattactgaccgttctggtcgcccgttagcggtgagtgtgccagtaaaagcgatttgggctgacccaaaagaagtgcatgacgctggcggtatcagcgtcggtgaccgctggaaggcgctggctaacgcgctcaatattccgctggatcagctctcagcccgcattaacgccaacccgaaagggcgctttatttatctggcgcgtcaggtaaaccctgacatggcggactacatcaaaaaactgaaactgccggggattcatctgcgtgaagaatctcgccgttattatccatccggcgaagtgactgctcacctcatcggctttactaacgtcgatagccaagggattgagggcgtcgagaagagtttcgataaatggcttaccgggcagccgggtgagcgcattgtgcgtaaagaccgctatggtcgcgtaattgaagatatttcttctactgacagccaggcagcgcacaacctgacgctgagtattgatgaacgcctgcaggcgctggtttatcgcgaactgaacaacgcagtggcctttaacaaggctgaatctggtagcgccgtgctggtggatgtcaacaccggtgaagtgctggcgatggctaacagcccgtcatacaacccaaataatctgagcggcacgccgaaagaagcgatgcgtaaccgtaccatcaccgacgtgtttgaaccgggctcaacggttaaaccgatggtggtgatgaccgcgttgcaacgtggcgtggtgcgggaaaactcggtactcaataccgttccttatcgaattaacggtcacgaaatcaaagacgtggcgcgctacagcgaattaaccctgaccggggtattacagaagtcgagtaacgtcggtgtttccaaactggcgttagcgatgccgtcctcagcgttagtagatacttactcacgttttggactgggaaaagcgaccaatttggggttggtcggagaacgcagtggcttatatcctcaaaaacaacggtggtctgacatagagagggccaccttctctttcggctacgggctaatggtaacaccgttacagttagcgcgagtctacgcaactatcggcagctacggcatttatcgcccactgtcgattaccaaagttgaccccccggttcccggtgaacgtgtcttcccggaatccattgttcgcaccgtggtgcatatgatggaaagcgtggcgctaccgggcggcggcggcgtgaaggcggcgattaaaggctatcgtatcgccattaaaaccggtaccgcgaaaaaggtcgggccggacggtcgctacatcaataaatatattgcttataccgcaggcgttgcgcctgcgagtcagccgcgcttcgcgctggttgttgttatcaacgatccgcaggcgggtaaatactacggcggcgccgtttccgcgccggtctttggtgccatcatgggcggcgtattgcgtaccatgaacatcgagccggatgcgctgacaacgggcgataaaaatgaatttgtgattaatcaaggcgagggtacaggtggcagatcgtaa

SEQ ID NO: 372 - protein, 588 aa, Escherichia coli
MKAAAKTQKPKRQEEHANFISWRFALLCGCILLALAFLLGRVAWLQVISPDMLVKEGDMRSLRVQQVSTSRGMITDRSGRPLAVSVPVKAIWADPKEVHDAGGISVGDRWKALANALNIPLDQLSARINANPKGRFIYLARQVNPDMADYIKKLKLPGIHLREESRRYYPSGEVTAHLIGFTNVDSQGIEGVEKSFDKWLTGQPGERIVRKDRYGRVIEDISSTDSQAAHNLTLSIDERLQALVYRELNNAVAFNKAESGSAVLVDVNTGEVLAMANSPSYNPNNLSGTPKEAMRNRTITDVFEPGSTVKPMVVMTALQRGVVRENSVLNTVPYRINGHEIKDVARYSELTLTGVLQKSSNVGVSKLALAMPSSALVDTYSRFGLGKATNLGLVGERSGLYPQKQRWSDIERATFSFGYGLMVTPLQLARVYATIGSYGIYRPLSITKVDPPVPGERVFPESIVRTVVHMMESVALPGGGGVKAAIKGYRIAIKTGTAKKVGPDGRYINKYIAYTAGVAPASQPRFALVVVINDPQAGKYYGGAVSAPVFGAIMGGVLRTMNIEPDALTTGDKNEFVINQGEGTGGRS

SEQ ID NO: 373 - DNA, 1488 bp, Escherichia coli
gtggcagatcgtaatttgcgcgaccttcttgctccgtgggtgccagacgcaccttcgcgagcactgcgagagatgacactcgacagccgtgtggctgcggcgggcgatctctttgtagctgtagtaggtcatcaggcggacgggcgtcgatatatcccgcaggcgatagcgcaaggtgtggctgccattattgcagaggcgaaagatgaggcgaccgacggtgaaatccgtgaaatgcacggcgtaccggtcatctatctcagccagctcaacgagcgtttatctgcactggcgggccgcttttaccatgaaccctctgacaatttacgtcttgtaggcgtaacgggcaccaacggcaaaaccacgacgacccagctgctggcacagtggagccaactgcttggcgaaaccagcgcggtaatgggcaccgttggtaacggcctgctggggaaagtgatcccgacagaaaataccaccggttcggcagtcgatgttcagcatgagctggcggggctggtggatcagggcgcgactttttgcgcaatggaagtttcatcccacgggctggtacaacaccgtgtggcggcattgaaatttgcggcgtcggtctttaccaacttaagccgcgatcaccttgattatcatggtgatatggaacactacgaagctgcgaaatggctgctttattctgagcatcattgcggtcaggcgattattaacgccgacgatgaagtgggccgccgctggctggcaaaactgccggacgcggttgcggtatcaatggaagatcatatcaatccgaactgtcacggacgctggttgaaagcgaccgacgtgaactatcacgacagcggtgcgaccattcgctttagctcgagttggggcgatggggaaattgaaagtcgcctgatgggcgcattcaacgtcagcaacctgctgctggcgctggcgacactgctggcactcggctatccgctggctgatttgctgaaaaccgccgcgcgtctgcaaccggtttgcggacgtatggaagtgttcactgcaccaggcaaaccgacggtggtggtggattacgcgcatacgccggatgcactggaaaaagccttacaggcggcgcgcctgcactgtgcgggcaagctgtggtgcgtctttggctgcggtggcgatcgtgataaaggcaaacgtccactgatgggcgcaattgctgaagagtttgctgacgtggcggtggtgacggacgataacccgcgtaccgaagagcctcgtgccatcatcaacgatattctggcgggaatgttagatgccggatatgccaaagtgatggaaggccgtgctgaagcggtgacttgcgccgttatgcaggctaaagagaatgatgtggtactggtcgcgggcaaaggccatgaggattaccagattgttggcaatcagcgtctggactactccgatcgcgtcacggtggcgcgtctgctgggggtgattgcatga

SEQ ID NO: 374 - protein, 495 aa, Escherichia coli
MADRNLRDLLAPWVPDAPSRALREMTLDSRVAAAGDLFVAVVGHQADGRRYIPQAIAQGVAAIIAEAKDEATDGEIREMHGVPVIYLSQLNERLSALAGRFYHEPSDNLRLVGVTGTNGKTTTTQLLAQWSQLLGETSAVMGTVGNGLLGKVIPTENTTGSAVDVQHELAGLVDQGATFCAMEVSSHGLVQHRVAALKFAASVFTNLSRDHLDYHGDMEHYEAAKWLLYSEHHCGQAIINADDEVGRRWLAKLPDAVAVSMEDHINPNCHGRWLKATDVNYHDSGATIRFSSSWGDGEIESRLMGAFNVSNLLLALATLLALGYPLADLLKTAARLQPVCGRMEVFTAPGKPTVVVDYAHTPDALEKALQAARLHCAGKLWCVFGCGGDRDKGKRPLMGAIAEEFADVAVVTDDNPRTEEPRAIINDILAGMLDAGYAKVMEGRAEAVTCAVMQAKENDVVLVAGKGHEDYQIVGNQRLDYSDRVTVARLLGVIA

SEQ ID NO: 375 - DNA, 1359 bp, Escherichia coli
atgattagcgtaacccttagccaacttaccgatattctcaacggtgaactgcaaggtgcagatattacccttgatgctgtaaccactgacacgcgaaaactgacgccgggctgcctgtttgttgccctgaaaggcgaacgtttcgatgctcatgattttgccgaccaggcgaaagctggcggcgcaggcgcactactggttagccgtccgctggatattgatctgccgcagttaatcgtcaaggatacgcgtctggcgtttggtgaactggctgcatgggttcgccagcaagttccggcgcgcgtggttgctctgacaggttcctccggcaaaacctccgttaaagagatgacggcggcaattttaagccagtgcggcaacacactttatacggcaggcaatctcaataacgacatcggtgtaccgatgacgctgttgcgcttaacgccggaatacgattacgcagttattgaacttggcgcgaaccatcagggtgaaattgcctggactgtgagtctgactcgcccggaagcggcgctggtcaacaacctggcagcggcgcatttggaaggttttggctcgcttgcgggtgtcgcgaaagcgaaaggtgaaatctttagcggcctgccggaaaacggtatcgccattatgaacgccgacaacaacgactggctgaactggcagagcgtaattggctcacgcaaagtgtggcgtttctcacctaatgccgccaacagcgatttcaccgccaccaatatccatgtaacctcgcacggtacggaatttaccctgcaaacccctacaggtagcgtcgatgttctgctgccgttgccggggcgtcacaatattgcgaatgcgctggcagccgctgcgctctccatgtccgtgggcgcaacgcttgatgctatcaaagcggggctggcaaatctgaaagctgttccaggccgtctgttccccataaaactggcagaaaaccagttgctgctcgacgactcctacaacgccaatgtcggttcaatgaccgccgctgttcaggttctggctgaaatgccgggctaccgcgtgctggtggtgggcgatatggcggaactgggcgctgaaagcgaagcctgccatgtacaggtgggcgaagcggcaaaagctgctggtattgactgcgtgttaagtgtgggtaaacaaagccatgctatcagcaccgccagcggcgttggcgaacatttttccgataaaactgcgcttatcgcgcgtcttaaatcactgattgctgagcaacaggtaattacgattttagttaagggttcacgtagtgctgccatggaagaggtagtacgcgctttacaggagaatgggacatgttag

SEQ ID NO: 376 - protein, 452 aa, Escherichia coli
MISVTLSQLTDILNGELQGADITLDAVTTDTRKLTPGCLFVALKGERFDAHDFADQAKAGGAGALLVSRPLDIDLPQLIVKDTRLAFGELAAWVRQQVPARVVALTGSSGKTSVKEMTAAILSQCGNTLYTAGNLNNDIGVPMTLLRLTPEYDYAVIELGANHQGEIAWTVSLTRPEAALVNNLAAAHLEGFGSLAGVAKAKGEIFSGLPENGIAIMNADNNDWLNWQSVIGSRKVWRFSPNAANSDFTATNIHVTSHGTEFTLQTPTGSVDVLLPLPGRHNIANALAAAALSMSVGATLDAIKAGLANLKAVPGRLFPIKLAENQLLLDDSYNANVGSMTAAVQVLAEMPGYRVLVVGDMAELGAESEACHVQVGEAAKAAGIDCVLSVGKQSHAISTASGVGEHFSDKTALIARLKSLIAEQQVITILVKGSRSAAMEEVVRALQENGTC

SEQ ID NO: 377 - DNA, 1083 bp, Escherichia coli
atgttagtttggctggccgaacatttggtcaaatattattccggctttaacgtcttttcctatctgacgtttcgcgccatcgtcagcctgctgaccgcgctgttcatctcattgtggatgggcccgcgtatgattgctcatttgcaaaaactttcctttggtcaggtggtgcgtaacgacggtcctgaatcacacttcagcaagcgcggtacaccgaccatgggcgggataatgatcctgacggcgattgtgatctccgtgctgctgtgggcttacccgtccaatccgtacgtctggtgcgtactggtggtgctggtaggttatggtgttattggctttgttgatgattatcgcaaagtggtgcgtaaagacaccaagggcctgattgcccgttggaagtatttctggatgtcggtcattgcactgggtgttgccttcgcgctgtaccttgccggcaaagacacgcccgcaacgcagctggtggttccgttctttaaagatgtgatgccgcaactggggctgttctacattctgctggcttactttgtcattgtgggtactggcaacgcggtaaacctgaccgatggtctcgacggtctggcaattatgccgaccgtatttgtcgccggtggttttgcgctggtggcgtgggcgaccggcaacatgaactttgccagctatttacacataccgtatctacgacacgccggggaactggtcattgtctgtaccgcgatagtcggggcagggctgggcttcctgtggtttaacacctatccggcgcaggtctttatgggcgatgtaggttcgctggcgttaggtggtgcgttaggtattatcgccgtactgctgcgtcaggaattcctgctggtgattatggggggcgtgttcgtggtagaaacgctttccgtcatcctgcaggtcggctcctttaaactgcgcggacaacgtattttccgcatggcaccgattcatcaccactatgaactgaaaggctggccggaaccgcgcgtcattgtgcgtttctggattatttcgctgatgctggtcctgattggtctggcaacgctgaaggtacgttaa

SEQ ID NO: 378 - protein, 360 aa, Escherichia coli
MLVWLAEHLVKYYSGFNVFSYLTFRAIVSLLTALFISLWMGPRMIAHLQKLSFGQVVRNDGPESHFSKRGTPTMGGIMILTAIVISVLLWAYPSNPYVWCVLVVLVGYGVIGFVDDYRKVVRKDTKGLIARWKYFWMSVIALGVAFALYLAGKDTPATQLVVPFFKDVMPQLGLFYILLAYFVIVGTGNAVNLTDGLDGLAIMPTVFVAGGFALVAWATGNMNFASYLHIPYLRHAGELVIVCTAIVGAGLGFLWFNTYPAQVFMGDVGSLALGGALGIIAVLLRQEFLLVIMGGVFVVETLSVILQVGSFKLRGQRIFRMAPIHHHYELKGWPEPRVIVRFWIISLMLVLIGLATLKVR

SEQ ID NO: 379 - DNA, 1317 bp, Escherichia coli
atggctgattaccagggtaaaaatgtcgtcattatcggcctgggcctcaccgggctttcttgcgtggactttttcctcgctcgcggtgtgacgccgcgcgttatggatacgcgtatgacaccgcctggcctggataaattacccgaagccgtagaacgccacacgggcggtctgaatgatgaatggctgatggcggcagatctgattgtcgccagtcccggtattgcactggcgcatccatccttaagcgctgccgctgatgccggaatcgaaatcgttggcgatatcgagctgttctgtcgtgaagcacaagcaccgattgtggcgattaccggttctaacggcaaaagcacggtcaccacgctagtgggtgaaatggcgaaagcggcgggggttaacgttggtgtgggtggcaatattggcctgcctgcgttgatgctgttggatgatgagtgcgaactgtacgtgctggaactgtcgagcttccagctggaaaccacctccagcttacaggcggtagcagcgaccattctgaacgtgactgaagatcatatggatcgctatccgtttggtttacaacagtatcgtgcagcaaaactgcgcatttacgaaaacgcaaaagtttgcgtggttaatgctgatgatgccttaacaatgccgattcgcggtgcggatgaacgctgcgtcagctttggcgtcaacatgggcgactatcacctgaatcatcagcagggcgaaacctggctgcgggtgaaaggcgagaaagtgctgaacgtgaaagaaatgaaactttccgggcagcataactacaccaatgcgctggcggcgctggcgctggcagatgccgcagggttaccgcgtgccagcagcctgaaagcgttaaccacattcactggtctgccgcatcgctttgaagttgtgctggagcataacggtgtgcgctgggttaacgattcaaaagcgaccaacgtcggcagtacggaagcggcgctgaatggcctgcacgtagacggcacgctgcatttgttgctggggggcgatggtaaatcggcggactttagcccactggcgcgttacctgaatggcgataatgtacgtctgtattgtttcggtcgggacggcgcgcagctggcggcgctacgcccggaagtggcagaacaaaccgaaaccatggaacaggcgatgcgcttgctggctccgcgtgttcagccgggcgatatggttctgctctccccggcctgtgccagccttgatcaattcaagaactttgaacaacgaggcaatgagtttgcccgtctggcgaaggagttaggttga

SEQ ID NO: 380 - protein, 438 aa, Escherichia coli
MADYQGKNVVIIGLGLTGLSCVDFFLARGVTPRVMDTRMTPPGLDKLPEAVERHTGGLNDEWLMAADLIVASPGIALAHPSLSAAADAGIEIVGDIELFCREAQAPIVAITGSNGKSTVTTLVGEMAKAAGVNVGVGGNIGLPALMLLDDECELYVLELSSFQLETTSSLQAVAATILNVTEDHMDRYPFGLQQYRAAKLRIYENAKVCVVNADDALTMPIRGADERCVSFGVNMGDYHLNHQQGETWLRVKGEKVLNVKEMKLSGQHNYTNALAALALADAAGLPRASSLKALTTFTGLPHRFEVVLEHNGVRWVNDSKATNVGSTEAALNGLHVDGTLHLLLGGDGKSADFSPLARYLNGDNVRLYCFGRDGAQLAALRPEVAEQTETMEQAMRLLAPRVQPGDMVLLSPACASLDQFKNFEQRGNEFARLAKELG

SEQ ID NO: 381 - DNA, 1245 bp, Escherichia coli
atgcgtttatctctccctcgcctgaaaatgccgcgcctgccaggattcagtattctggtctggatctccacggcgctaaagggctgggtgatgggctcgcgggaaaaagataccgacagcctgatcatgtacgatcgcaccttactgtggctgaccttcggcctcgcggcgattggctttatcatggtgacctcggcgtcaatgcccatagggcaacgcttaaccaacgatccgttcttcttcgcgaagcgtgatggcgtctatctgatcctggcattcattctggcgatcattacgctgcgtctgccgatggagttctggcaacgctacagtgccacgatgctgctcggatctatcatcctgctgatgatcgttctggtagtgggtagctcggttaaaggggcatcgcgttggatcgatctcggtttgctgcgtatccagcctgcggagctgacaaaactgtcgctgttttgctatatcgccaactatctggtgcgtaaaggcgacgaagtacgtaataacctgcgcggcttcctgaaaccgatgggcgtaattctggtgttggcagtgttactgctggcacagccagaccttggtacggtggtggtgttgtttgtgactacgctggcgatgttgttcctggcaggagcgaaattgtggcagttcattgccattatcggtatgggcatttcagcggttgtgttgctgatcctcgccgaaccgtaccgtatccgccgtgttaccgcattctggaacccgtgggaagatccctttggcagcggctatcagttaacgcaatcgttgatggcgtttggtcgcggtgaactgtggggacaaggtttaggtaactcggtacaaaaactggagtatctgccggaagcgcatactgactttattttcgccattatcggcgaagaactggggtatgtcggtgtggtgctggcacttttaatggtattcttcgtcgcttttcgcgcgatgtcgattggccgcaaagcattagaaattgaccaccgtttttccggttttctcgcctgttctattggtatctggtttagtttccaggcgctggttaacgtaggcgcggcggcggggatgttaccgaccaaaggtctgacattgccgctgatcagttacggtggttcgagcttactgattatgtcgacagccatcatgatgctgttgcgtattgattatgaaacgcgtctggagaaagcgcaggcgtttgtacgaggttcacgatga

SEQ ID NO: 382 - protein, 414 aa, Escherichia coli
MRLSLPRLKMPRLPGFSILVWISTALKGWVMGSREKDTDSLIMYDRTLLWLTFGLAAIGFIMVTSASMPIGQRLTNDPFFFAKRDGVYLILAFILAIITLRLPMEFWQRYSATMLLGSIILLMIVLVVGSSVKGASRWIDLGLLRIQPAELTKLSLFCYIANYLVRKGDEVRNNLRGFLKPMGVILVLAVLLLAQPDLGTVVVLFVTTLAMLFLAGAKLWQFIAIIGMGISAVVLLILAEPYRIRRVTAFWNPWEDPFGSGYQLTQSLMAFGRGELWGQGLGNSVQKLEYLPEAHTDFIFAIIGEELGYVGVVLALLMVFFVAFRAMSIGRKALEIDHRFSGFLACSIGIWFSFQALVNVGAAAGMLPTKGLTLPLISYGGSSLLIMSTAIMMLLRIDYETRLEKAQAFVRGSR

SEQ ID NO: 383 - DNA, 1068 bp, Escherichia coli
atgagtggtcaagggaagcgattaatggtgatggcaggcggaaccggtggacatgtattcccggggctggcggttgcgcaccatctaatggctcagggttggcaagttcgctggctggggactgccgaccgtatggaagcggacttagtgccaaaacatggcatcgaaattgatttcattcgtatctctggtctgcgtggaaaaggtataaaagcactgatagctgcgccgctgcgtatcttcaacgcctggcgtcaggcgcgggcgattatgaaagcgtacaaacctgacgtggtgctcggtatgggcggctatgtatcaggtccaggtggtctggccgcgtggtcgttaggcattccggttgtacttcatgaacaaaacggtattgcgggcttaaccaataaatggctggcgaagattgctaccaaagtgatgcaggcgtttccaggtgcttttcctaatgcggaagtggtgggtaacccggtgcgtaccgatgtgctggcgctgccgttgccgcagcaacgtttggctggacgtgaaggtccggttcgtgtgttggtagtgggtggttcccagggcgcacgcattcttaatcagacaatgccgcaggttgctgcgaaactgggtgattcagtcactatctggcatcagagcggcaaaggttcgcaacaatccgttgaacaggcgtatgccgaagcggggcaaccgcagcataaagtgacggaatttattgatgatatggcggcggcgtatgcgtgggcggatgtcgtcgtttgccgctccggtgcgttaacggtgagtgaaatcgccgcggcaggactaccggcgttgtttgtgccgtttcaacataaagaccgtcagcaatactggaatgcgctaccgctggaaaaagcgggcgcagccaaaattatcgagcagtcacagcttagcgtggatgctgtcgccaacaccctggccgggtggtcgcgagaaatcttattaaccatggcagaacgcgcccgcgctgcatccattccggatgccaccgagcgagtggcaaatgaagtgagccgggctgcccgggcgtaa

SEQ ID NO: 384 - protein, 355 aa, Escherichia coli
MSGQGKRLMVMAGGTGGHVFPGLAVAHHLMAQGWQVRWLGTADRMEADLVPKHGIEIDFIRISGLRGKGIKALIAAPLRIFNAWRQARAIMKAYKPDVVLGMGGYVSGPGGLAAWSLGIPVVLHEQNGIAGLTNKWLAKIATKVMQAFPGAFPNAEVVGNPVRTDVLALPLPQQRLAGREGPVRVLVVGGSQGARILNQTMPQVAAKLGDSVTIWHQSGKGSQQSVEQAYAEAGQPQHKVTEFIDDMAAAYAWADVVVCRSGALTVSEIAAAGLPALFVPFQHKDRQQYWNALPLEKAGAAKIIEQSQLSVDAVANTLAGWSREILLTMAERARAASIPDATERVANEVSRAARA

SEQ ID NO: 385 - DNA, 1476 bp, Escherichia coli
atgaatacacaacaattggcaaaactgcgttccatcgtgcccgaaatgcgtcgcgttcggcacatacattttgtcggcatcggtggtgccggtatgggcggtattgccgaagttctggccaatgaaggttatcagatcagtggttccgatttagcgccaaatccggtcacgcagcagttaatgaatctgggagcgacgatttatttcaaccatcgcccggaaaacgtacgtgatgccagcgtggtcgttgtttccagcgcgatttctgccgataacccggaaattgttgcagctcatgaagcgcgtattccggtgatccgtcgtgctgaaatgctggctgagttaatgcgttttcgtcatggcatcgccattgccggaacacacggcaaaacgacaaccaccgcgatggtttctagcatctacgcagaagcgggactcgacccaaccttcgttaacggtgggctggtaaaagcggcgggggttcatgcgcgtttggggcatggtcggtacctgattgccgaagcagatgagagtgatgcatcgttcctgcatctgcaaccgatggtggcgattgtcaccaatatcgaagccgaccacatggatacctaccagggcgactttgagaatttaaaacagacttttattaattttctgcacaacctgccgttttacggtcgtgcggtgatgtgtgttgatgatccggtgatccgcgaattgttaccgcgtgtgggacgtcagaccacgacttacggcttcagcgaagatgccgacgtgcgtgtagaagattatcagcagattggcccgcaggggcactttacgctgctgcgccaggacaaagagccgatgcgcgtcaccctgaatgcgccaggtcgtcataacgcgctgaacgccgcagctgcggttgcggttgctacggaagagggaattgacgacgaggctattttgcgtgcgctggaaagcttccaggggacggggcgccgtttcgatttcctcggtgaattcccgctagagccagtgaatggaaaaagcggtacggcaatgctggtcgatgactacggccaccacccgacggaagtggacgccactattaaagcggcgcgcgcaggctggccggataaaaacctggtaatgctgtttcagccgcaccgttttacccgtacgcgcgacctgtatgatgatttcgccaatgtgctgacgcaggttgataccctgttgatgctggaagtgtatccggctggtgaagcgccaattccgggagcggacagccgttcgctgtgtcgcacaattcgtggacgtgggaaaattgatcccattctggtgccggacccggcgcaggtagccgagatgctggcaccggtattaaccggtaacgacctgattctcgttcagggggctggtaatatcggaaaaattgctcgttctttagctgaaatcaaactgaagccgcaaactccggaggaagaacaacatgactga

SEQ ID NO: 386 - protein, 491 aa, Escherichia coli
MNTQQLAKLRSIVPEMRRVRHIHFVGIGGAGMGGIAEVLANEGYQISGSDLAPNPVTQQLMNLGATIYFNHRPENVRDASVVVVSSAISADNPEIVAAHEARIPVIRRAEMLAELMRFRHGIAIAGTHGKTTTTAMVSSIYAEAGLDPTFVNGGLVKAAGVHARLGHGRYLIAEADESDASFLHLQPMVAIVTNIEADHMDTYQGDFENLKQTFINFLHNLPFYGRAVMCVDDPVIRELLPRVGRQTTTYGFSEDADVRVEDYQQIGPQGHFTLLRQDKEPMRVTLNAPGRHNALNAAAAVAVATEEGIDDEAILRALESFQGTGRRFDFLGEFPLEPVNGKSGTAMLVDDYGHHPTEVDATIKAARAGWPDKNLVMLFQPHRFTRTRDLYDDFANVLTQVDTLLMLEVYPAGEAPIPGADSRSLCRTIRGRGKIDPILVPDPAQVAEMLAPVLTGNDLILVQGAGNIGKIARSLAEIKLKPQTPEEEQHD

SEQ ID NO: 387 - DNA, 450 bp, Escherichia coli
  n 427, 428, 429, 430, 431: n is any nucleotide
atgactgataaaatcgcggtcctgttgggcgggacctccgctgagcgggaagtttctctgaattctggcgcagcggtgttagccgggctgcgtgaaggcggtattgacgcgtatcctgtcgacccgaaagaagtcgacgtgacgcaactgaagtcgatgggttttcagaaagtgtttatcgcgctacacggtcgcggcggtgaagatggtacgctgcagggcatgctcgagctgatgggcttgccttataccggcagcggagtgatggcatctgcgctttcaatggataaactacgcagcaaacttctgtggcagggtgccggtttaccggtcgcgccgtgggtagcgttaacccgcgcagagtttgaaaaaggccttaacgataagcagttagcagaaatttcttctctgggtttgccggttatcnnnnncattccattcattaattaa

SEQ ID NO: 388 - protein, 149 aa, Escherichia coli
  Xaa 143, 144: Xaa is any amino acid
MTDKIAVLLGGTSAEREVSLNSGAAVLAGLREGGIDAYPVDPKEVDVTQLKSMGFQKVFIALHGRGGEDGTLQGMLELMGLPYTGSGVMASALSMDKLRSKLLWQGAGLPVAPWVALTRAEFEKGLNDKQLAEISSLGLPVIXXIPFIN

SEQ ID NO: 389 - DNA, 123 bp, Escherichia coli
  n 4, 5, 6, 7, 8: n is any nucleotide
atgnnnnntaatcgcctggtgtttgttgatgttaccgtcgatggcagtgagcacgtctacccgatgcagattcgcgggggcggaatggatgaaatgtggttaagcaaaacggagagaacctga

SEQ ID NO: 390 - protein, 40 aa, Escherichia coli
  Xaa 2, 3: Xaa is any amino acid
MXXNRLVFVDVTVDGSEHVYPMQIRGGGMDEMWLSKTERT

SEQ ID NO: 391 - DNA, 492 bp, Escherichia coli; identical to SEQ ID NO: 361

SEQ ID NO: 392 - protein, 163 aa, Escherichia coli; identical to SEQ ID NO: 362

SEQ ID NO: 393 - DNA, 123 bp, Escherichia coli
atgaaatcgctcggctgggcgggagtgtcgcggaccactgcaagctatgttattaacggcaaagcgaagcaataccgtgtgagcgacaaaaccgttgaaaaagtcatggctggtggtgcgtga

SEQ ID NO: 394 - protein, 40 aa, Escherichia coli
MKSLGWAGVSRTTASYVINGKAKQYRVSDKTVEKVMAGGA

SEQ ID NO: 395 - DNA, 147 bp, Escherichia coli
ttgaaaaagtcatggctggtggtgcgtgagcacaattaccacccgaacgccgtggcagctgggcttcgtgctggacgcacacgttctattggtcttgtgatccccgatctggagaacaccagctatacccgcatcgctactatctga

SEQ ID NO: 396 - protein, 48 aa, Escherichia coli
MKKSWLVVREHNYHPNAVAAGLRAGRTRSIGLVIPDLENTSYTRIATI

SEQ ID NO: 397 - DNA, 123 bp, Escherichia coli; identical to SEQ ID NO: 389
  n 4, 5, 6, 7, 8: n is any nucleotide

SEQ ID NO: 398 - protein, 40 aa, Escherichia coli; identical to SEQ ID NO: 390
  Xaa 2, 3: Xaa is any amino acid

SEQ ID NO: 399 - DNA, 492 bp, Escherichia coli; identical to SEQ ID NO: 361

SEQ ID NO: 400 - protein, 163 aa, Escherichia coli; identical to SEQ ID NO: 362

SEQ ID NO: 401 - DNA, 249 bp, Escherichia coli
gtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctactatctga

SEQ ID NO: 402 - protein, 82 aa, Escherichia coli
MKLDEIARLAGVSRTTASYVINGKAKQYRVSDKTVEKVMAVVREHNYHPNAVAAGLRAGRTRSIGLVIPDLENTSYTRIATI

SEQ ID NO: 403 - DNA, 465 bp, Escherichia coli
  n 4, 5, 6, 7, 8: n is any nucleotide
atgnnnnntcaaagtagtagcagaaatgctctacaagatgcattaagattggcatttcagcacgatgaagaagtattgattgaaaaatggctaagtgggccggagttcacgattgcgatactcggtgaagaaattttaccgtcaatacgtattcaaccggccggaaccttctatgattatgaggcgaagtatctctctgatgagacacagtatttctgccccgcaggtctggaagcgtcacaagaggccaatttgcaggcattagtgctaaaagcatggacgacgttaggttgcaaaggatggggacgtattgacgttatgctggacagtgatggacagttttatctgctggaagccaatacctcaccgggtatgaccagccacagtctggtgccgatggcggcacgtcaggcaggtatgagcttctcgcagttggtagtacgaattctggaactggcggactaa

SEQ ID NO: 404 - protein, 154 aa, Escherichia coli
  Xaa 2, 3: Xaa is any amino acid
MXXQSSSRNALQDALRLAFQHDEEVLIEKWLSGPEFTIAILGEEILPSIRIQPAGTFYDYEAKYLSDETQYFCPAGLEASQEANLQALVLKAWTTLGCKGWGRIDVMLDSDGQFYLLEANTSPGMTSHSLVPMAARQAGMSFSQLVVRILELAD

SEQ ID NO: 405 - DNA, 831 bp, Escherichia coli
atgtcgcaggctgctctgaacacgcgaaatagcgaagaagaggtttcttctcgccgcaataatggaacgcgtctggcggggatccttttcctgctgaccgttttaacgacagtgttggtgagcggctgggtcgtgttgggctggatggaagatgcgcaacgcctgccgctctcaaagctggtgttgaccggtgaacgccattacacgcgtaatgacgatatccggcagtcgatcctggcattgggtgagccaggtacctttatgacccaggatgtcaacatcatccagacgcaaatagaacaacgcctgccgtggattaagcaggtgagcgtcagaaagcagtggcctgatgaattgaagattcatctggttgaatatgtgccgattgcgcggtggaatgatcaacatatggtagacgcggaaggaaacaccttcagcgtgccgccagatcgcaccagcaagcaggtgcttccaatgctgtatggcccggaaggcagcgccaatgaagtgttgcagggctatcgcgaaatggggcagatgctggcaaaggacagatttactctgaaggaagcggcgatgaccgcgcgacgttcctggcagttgacgctgaataacgatattaagctcaatcttggtcggggcgatacgatgaaacgtttggctcgctttgtagaactttatccggttttacagcagcaggcgcaaaccgatggcaaacggattagctacgttgatttgcgttatgactctggagcggcagtaggctgggcgcccttgccgccagaggaatctactcagcaacaaaatcaggcacaggcagaacaacaatga

SEQ ID NO: 406 - protein, 276 aa, Escherichia coli
MSQAALNTRNSEEEVSSRRNNGTRLAGILFLLTVLTTVLVSGWVVLGWMEDAQRLPLSKLVLTGERHYTRNDDIRQSILALGEPGTFMTQDVNIIQTQIEQRLPWIKQVSVRKQWPDELKIHLVEYVPIARWNDQHMVDAEGNTFSVPPDRTSKQVLPMLYGPEGSANEVLQGYREMGQMLAKDRFTLKEAAMTARRSWQLTLNNDIKLNLGRGDTMKRLARFVELYPVLQQQAQTDGKRISYVDLRYDSGAAVGWAPLPPEESTQQQNQAQAEQQ

SEQ ID NO: 407 - DNA, 1263 bp, Escherichia coli
atgatcaaggcgacggacagaaaactggtagtaggactggagattggtaccgcgaaggttgccgctttagtaggggaagttctgcccgacggtatggtcaatatcattggcgtgggtagttgcccgtcgcgtggtatggataaaggtggggtgaacgacctcgaatccgtggtcaagtgcgtacaacgcgccattgaccaggcagaattgatggcagattgtcagatctcttcggtatatctggcgctttctggtaagcacatcagctgccagaatgaaattggtatggtgcctatttctgaagaagaagtgacgcaagaagatgtggaaaacgtcgtccataccgcgaaatcggtgcgtgtgcgcgatgagcatcgtgtgttgcatgtgatcccgcaagagtatgcgattgactatcaggaagggatcaagaatccggtagggctttcgggcgtgcggatgcaggcaaaagtgcacctgatcacatgtcacaatgatatggcgaaaaacatcgtcaaagcggttgaacgttgtgggctgaaagttgaccaactgatatttgccggtctggcatcaagttattcggtattgacggaagatgaacgtgaactgggtgtctgcgtcgttgatatcggtggtggtacaatggatatcgccgtttataccggtggggcattgcgccacacgaaggtaattccttatgctggcaatgtcgtgaccagtgatatcgcttacgcctttggcacaccgccaagtgacgccgaagcgattaaagttcgccacggttgtgcgctgggctccatcgttggaaaagatgagagcgtggaagtgccgagcgtaggcggtcgtccgccgcggagtctacaacgtcagaccctggcagaggtgatcgagccgcgctataccgagctgctcaatctggtcaacgaagagatattgcagttgcaggaaaagcttcgccaacaaggggttaaacatcacctggcggcaggcattgtattaaccggtggcgcagcgcagatcgaaggtcttgcagcctgtgctcagcgcgtgtttcatacgcaagtgcgtatcggcgcgccgctgaacattaccggtttaacggattatgctcaggagccgtattattcgacggcggtgggattgcttcactatgggaaagagtcacatcttaacggtgaagctgaagtagaaaaacgtgttacagcatcagttggctcgtggatcaagcgactcaatagttggctgcgaaaagagttttaa

SEQ ID NO: 408 - protein, 420 aa, Escherichia coli
MIKATDRKLVVGLEIGTAKVAALVGEVLPDGMVNIIGVGSCPSRGMDKGGVNDLESVVKCVQRAIDQAELMADCQISSVYLALSGKHISCQNEIGMVPISEEEVTQEDVENVVHTAKSVRVRDEHRVLHVIPQEYAIDYQEGIKNPVGLSGVRMQAKVHLITCHNDMAKNIVKAVERCGLKVDQLIFAGLASSYSVLTEDERELGVCVVDIGGGTMDIAVYTGGALRHTKVIPYAGNVVTSDIAYAFGTPPSDAEAIKVRHGCALGSIVGKDESVEVPSVGGRPPRSLQRQTLAEVIEPRYTELLNLVNEEILQLQEKLRQQGVKHHLAAGIVLTGGAAQIEGLAACAQRVFHTQVRIGAPLNITGLTDYAQEPYYSTAVGLLHYGKESHLNGEAEVEKRVTASVGSWIKRLNSWLRKEF

SEQ ID NO: 409 - DNA, 669 bp, Escherichia coli
  n 12, 13, 14, 15, 16: n is any nucleotide
atgaatgaatgnnnnnaaactgctgaaagttctgggccgaggtatctcctgctggatgcgtttggcgcagcgaacgatgtactgaaaggcgctgtgcaaggtatcgccgaactgattactcgtccgggtttgatgaacgtggactttgcagacgtacgcaccgtaatgtctgaaatgggctacgcaatgatgggttctggtgtggcgagcggtgaagatcgtgcggaagaagctgctgaaatggctatctcttctccgctgctggaagatatcgacctgtctggcgcacgcggcgtgctggttaacatcacagcgggcttcgacctgcgtctggatgagttcgaaacggtaggtaacaccatccgtgcatttgcttccgacaacgcgaccgtggttatcggtacttctcttgacccggatatgaatgacgagctgcgcgtaactgttgttgcgacaggtatcggcatggacaaacgtcctgaaatcactctggtgaccaataagcaggttcagcagccagtgatggatcgctaccagcagcacggtatggctccgctgacccaggagcagaagccggttgctaaagtcgtgaatgacaatgcgccgcaaactgcgaaagagccggattatctggatatcccagcattcctgcgtaagcaagctgattaa

SEQ ID NO: 410 - protein, 222 aa, Escherichia coli
  Xaa 4, 5, 6: Xaa is any amino acid
MNEXXXTAESSGPRYLLLDAFGAANDVLKGAVQGIAELITRPGLMNVDFADVRTVMSEMGYAMMGSGVASGEDRAEEAAEMAISSPLLEDIDLSGARGVLVNITAGFDLRLDEFETVGNTIRAFASDNATVVIGTSLDPDMNDELRVTVVATGIGMDKRPEITLVTNKQVQQPVMDRYQQHGMAPLTQEQKPVAKVVNDNAPQTAKEPDYLDIPAFLRKQAD

SEQ ID NO: 411 - DNA, 918 bp, Escherichia coli
atgatcaaacaaaggacacttaaacgtatcgttcaggcgacgggtgtcggtttacataccggcaagaaagtcaccctgacgttacgccctgcgccggccaacaccggggtcatctatcgtcgcaccgacttgaatccaccggtagatttcccggccgatgccaaatctgtgcgtgataccatgctctgtacgtgtctggtcaacgagcatgatgtgcggatttcaaccgtagagcacctcaatgctgctctcgcgggcctgggcatcgataacattgttatcgaagttaacgcgccggaaatcccgatcatggacggcagcgccgctccgtttgtatacctgctgcttgacgccggtatcgacgagttgaactgcgccaagaaatttgttcgcattaaagagactgttcgtgtcgaagatggcgataagtgggctgaatttaagccgtacaatggtttttctctggatttcaccatcgattttaaccatccggctattgattccagcaaccagcgctatgcgatgaacttctccgctgatgcgtttatgcgccagatcagccgtgcgcgtacgttcggtttcatgcgtgatatcgaatatctgcagtcccgtggtttgtgcctgggcggcagcttcgattgtgccatcgttgttgacgattatcgcgtactgaacgaagacggcctgcgttttgaagacgaatttgtgcgtcacaaaatgctcgatgcgatcggtgacttgttcatgtgtggtcacaatattattggtgcatttaccgcttataaatctggtcatgcactgaataacaaactgctgcaggctgtccttgcaaaacaggaagcctgggaatatgtgaccttccaggacgacgcagaactgccgttggccttcaaagcgccttcagccgtactggcataa

SEQ ID NO: 412 - protein, 305 aa, Escherichia coli
MIKQRTLKRIVQATGVGLHTGKKVTLTLRPAPANTGVIYRRTDLNPPVDFPADAKSVRDTMLCTCLVNEHDVRISTVEHLNAALAGLGIDNIVIEVNAPEIPIMDGSAAPFVYLLLDAGIDELNCAKKFVRIKETVRVEDGDKWAEFKPYNGFSLDFTIDFNHPAIDSSNQRYAMNFSADAFMRQISRARTFGFMRDIEYLQSRGLCLGGSFDCAIVVDDYRVLNEDGLRFEDEFVRHKMLDAIGDLFMCGHNIIGAFTAYKSGHALNNKLLQAVLAKQEAWEYVTFQDDAELPLAFKAPSAVLA

SEQ ID NO: 413 - DNA, 738 bp, Escherichia coli
ttgaattttataagagctataaaaaacggtgcgaacgctgttttcttaagcacttttacgcacaacttatcttcattcgtgctgtggacttcaggctttaatgataagatttgtgcgctaaatacgtttgaatacgatcgggatggcaataacgtgagtggaatactgacgcgctggcgacagtttggtaaacgctacttctggccgcatctcttattagggatggtcgcggcgagtttaggtttgcctgcactcagcaatgccgccgaaccaaacgcgcccgcaaaagcgacaacccgcaaccacgagccttcagccaaagttaactttggtcaattggccttgctggaagcgaacacgcgccgcccgaattcgaactattccgttgattactggcatcaacatgccattcgcacggtaatccgccatctttccttcgcgatggcaccgcaaacgctgcccgttgctgaagaatctttgcctcttcaggcgcaacatcttgcattactggatacgcttagcgcgcttctgacccaggaaggcacgccgtctgaaaagggttatcgcattgattatgcgcattttaccccacaagcaaaattcagcacgcccgtctgggataagccaggcgcaaggcatccgtgctggcccctcaacgcctcagctaacaacaataaacctttacttcattttattaactcccgcaacgcgggggcgtttgagattttattatgctaa

SEQ ID NO: 414 - protein, 245 aa, Escherichia coli
MNFIRAIKNGANAVFLSTFTHNLSSFVLWTSGFNDKICALNTFEYDRDGNNVSGILTRWRQFGKRYFWPHLLLGMVAASLGLPALSNAAEPNAPAKATTRNHEPSAKVNFGQLALLEANTRRPNSNYSVDYWHQHAIRTVIRHLSFAMAPQTLPVAEESLPLQAQHLALLDTLSALLTQEGTPSEKGYRIDYAHFTPQAKFSTPVWDKPGARHPCWPLNASANNNKPLLHFINSRNAGAFEILLC

SEQ ID NO: 415 - DNA, 114 bp, Escherichia coli
  n 87, 88, 89, 90, 91: n is any nucleotide
atgctaatcaaattattaactaaagttttcggtagtcgtaacgatcgcaccctgcgccggatgcgcaaagtggtcaacatcatcaannnnncattccattcattaattaattaa

SEQ ID NO: 416 - protein, 37 aa, Escherichia coli
  Xaa 29, 30, 31: Xaa is any amino acid
MLIKLLTKVFGSRNDRTLRRMRKVVNIIXXXFHSLIN

SEQ ID NO: 417 - DNA, 2256 bp, Escherichia coli
  n 4, 5, 6, 7, 8: n is any nucleotide
atgnnnnntgtcggtatcaacctgccgggcatgccagcaccggcaaagcgtgaagcctacgctgctgacatcacttacggtacgaacaacgaatacggctttgactacctgcgtgacaacatggcgttcagtcctgaagaacgtgtacagcgtaaactgcactatgcgctggtggacgaagtggactccatcctgatcgatgaagcgcgtacaccgctgatcatttccggcccggcagaagacagctcggaaatgtataaacgcgtgaataaaattattccgcacctgatccgtcaggaaaaagaagactccgaaaccttccagggcgaaggccacttctcggtggatgaaaaatctcgccaggtgaacctgaccgaacgtggtctggtcctgattgaagaactgctggttaaagaaggcatcatggatgaaggagagtctctgtactctccggccaacatcatgctgatgcaccacgtaacggcggcgctgcgcgctcatgcgctgtttacccgtgacgtcgactacatcgttaaagatggtgaagttatcatcgttgacgaacacaccggtcgtaccatgcagggccgtcgctggtccgatggtctgcaccaggctgtggaagcgaaagaaggtgtgcagatccagaacgaaaaccaaacgctggcttcgatcaccttccagaactacttccgtctgtatgaaaaactggcggggatgactggtactgctgataccgaagctttcgaattcagctccatctataagctggatactgtcgttgttccgaccaaccgcccaatgattcgtaaagatctgccggacctggtctacatgactgaagcggaaaaaattcaggcgatcattgaagatatcaaagaacgtactgcgaaaggccagccggtgctggtgggtacaatctccatcgaaaaatcggagctggtgtcaaatgaactgaccaaagccggtattaagcacaacgtcctgaacgccaaattccatgccaacgaagcggcgattgttgctcaggcaggttacccggctgcggtgactatcgcgaccaacatggcgggtcgtggtaccgatattgtgctcggtggtagctggcaggcagaagttgccgcgctggaaaatccgactgcagagcaaattgaaaaaattaaagccgactggcaggtacgtcacgatgcggtactggcagcaggtggcctgcatatcatcggtactgaacgtcacgaatcccgtcgtatcgataaccagctgcgcggtcgttctggtcgtcagggggatgctggttcttcccgtttctacctgtcgatggaagatgcgctgatgcgtatttttgcttccgaccgagtatccggcatgatgcgtaaactgggtatgaagccaggcgaagccattgagcacccgtgggtgaccaaagcgattgccaacgcccagcgtaaagttgaaagccgtaacttcgacattcgtaagcaactgctggaatatgatgacgtggctaacgatcagcgtcgcgccatttactcccagcgtaacgaactgctggatgtcagcgatgtgagcgaaaccatcaacagcattcgtgaagatgtgttcaaagcgaccattgatgcctacattccgccacagtcgctggaagaaatgtgggatattccggggctgcaggaacgtctgaagaacgatttcgacctcgatttaccaattgccgagtggctggataaagaaccagaactgcatgaagagacgctgcgtgagcgcattctggcgcagtccatcgaagtgtatcagcgtaaagaagaagtggttggtgctgagatgatgcgtcacttcgagaaaggcgtcatgctgcaaactctcgactctctgtggaaagagcacctggcagcgatggactatctgcgtcagggtatccacctgcgtggctatgcacagaaagatccgaagcaggaatacaaacgtgaatcgttctccatgtttgcagcgatgctggagtcgttgaaatatgaagttatcagtacgctgagcaaagttcaggtacgtatgcctgaagaggttgaggagctggaacaacagcgtcgtatggaagccgagcgtttagcgcaaatgcagcagcttagctatcaggatgacgactctgcagccgcagctgcactggcggcacaaaccggtgaacgcaaagtaggacgtaacgatccttgcccgtgtggttctggtaaaaaatacaagcagtgccatggccgcctgcaataa

SEQ ID NO: 418 - protein, 751 aa, Escherichia coli
  Xaa 2, 3: Xaa is any amino acid
MXXVGINLPGMPAPAKREAYAADITYGTNNEYGFDYLRDNMAFSPEERVQRKLHYALVDEVDSILIDEARTPLIISGPAEDSSEMYKRVNKIIPHLIRQEKEDSETFQGEGHFSVDEKSRQVNLTERGLVLIEELLVKEGIMDEGESLYSPANIMLMHHVTAALRAHALFTRDVDYIVKDGEVIIVDEHTGRTMQGRRWSDGLHQAVEAKEGVQIQNENQTLASITFQNYFRLYEKLAGMTGTADTEAFEFSSIYKLDTVVVPTNRPMIRKDLPDLVYMTEAEKIQAIIEDIKERTAKGQPVLVGTISIEKSELVSNELTKAGIKHNVLNAKFHANEAAIVAQAGYPAAVTIATNMAGRGTDIVLGGSWQAEVAALENPTAEQIEKIKADWQVRHDAVLAAGGLHIIGTERHESRRIDNQLRGRSGRQGDAGSSRFYLSMEDALMRIFASDRVSGMMRKLGMKPGEAIEHPWVTKAIANAQRKVESRNFDIRKQLLEYDDVANDQRRAIYSQRNELLDVSDVSETINSIREDVFKATIDAYIPPQSLEEMWDIPGLQERLKNDFDLDLPIAEWLDKEPELHEETLRERILAQSIEVYQRKEEVVGAEMMRHFEKGVMLQTLDSLWKEHLAAMDYLRQGIHLRGYAQKDPKQEYKRESFSMFAAMLESLKYEVISTLSKVQVRMPEEVEELEQQRRMEAERLAQMQQLSYQDDDSAAAAALAAQTGERKVGRNDPCPCGSGKKYKQCHGRLQ

SEQ ID NO: 419 - DNA, 399 bp, Escherichia coli
atgaaaaagctgcaaattgcggtaggtattattcgcaacgagaacaatgaaatctttataacgcgtcgcgcagcagatgcgcacatggcgaataaactggagtttcccggcggtaaagttgaaatgggcgaaacgccggaacaggcggtggtgcgtgaacttcaggaagaagtcgggattaccccacaacatttttcgctatttgaaaaactggaatatgaattcccggacaggcatataactctgtggttctggctggtcgaaagctgggaaggggagccgtggggtaaagaagggcaacccggtgagtggatgtcgctggtcggtcttaatgccgatgattttccgccagccaatgaaccggtaattgcgaaacttaagcgtgtgtatgccggataa

SEQ ID NO: 420 - protein, 132 aa, Escherichia coli
MKKLQIAVGIIRNENNEIFITRRAADAHMANKLEFPGGKVEMGETPEQAVVRELQEEVGITPQHFSLFEKLEYEFPDRHITLWFWLVESWEGEPWGKEGQPGEWMSLVGLNADDFPPANEPVIAKLKRVYAG

SEQ ID NO: 421 - DNA, 198 bp, Escherichia coli
atgtcagaaactattacggtgaattgcccaacctgcgggaaaacggtggtgtggggtgaaatcagcccgtttcggccattttgctccaaacgttgtcagctgatcgacctcggagaatgggctgctgaagaaaaacgaatccccagcagtggcgatctttccgaaagcgatgactggagcgaagagccaaagcagtga

SEQ ID NO: 422 - protein, 65 aa, Escherichia coli
MSETITVNCPTCGKTVVWGEISPFRPFCSKRCQLIDLGEWAAEEKRIPSSGDLSESDDWSEEPKQ

SEQ ID NO: 423 - DNA, 744 bp, Escherichia coli
atgcagacccaggtcctttttgaacatccactaaatgaaaaaatgcgtacatggctgcgcattgagtttttgattcagcaactcaccgttaatttacccatcgttgaccacgctggcgcgctgcatttcttccgtaatgtcagcgaattactggatgttttcgagcgcggcgaagtccgcactgagctgttgaaagaacttgaccggcagcaacgtaaactccagacctggattggcgtgcccggcgtggaccagagccgtattgaagcattaattcagcagttaaaagcggcggggagcgtattaatctccgcgccgcgtatcgggcaatttctacgtgaagatcgtttgattgctctggtgcgtcagcgactgagcatcccgggcggctgttgcagctttgatttacctacattgcacatttggctgcatctaccccaggcgcagcgcgacagccaggtagaaacctggattgccagcctgaacccgcttacccaggcacttaccatggtgctggatttaattcgccagtcggcccccttccgtaaacaaaccagcctgaatggtttttatcaggataacggtggcgatgccgacttgctgcgcctgaatctgtcgctcgattcacagctttatccgcaaatttccggtcataagagccgttttgccattcgttttatgccgctggacagtgaaaacggacaggtaccagaacgtctggatttcgaactggcctgttgctaa

SEQ ID NO: 424 - protein, 247 aa, Escherichia coli
MQTQVLFEHPLNEKMRTWLRIEFLIQQLTVNLPIVDHAGALHFFRNVSELLDVFERGEVRTELLKELDRQQRKLQTWIGVPGVDQSRIEALIQQLKAAGSVLISAPRIGQFLREDRLIALVRQRLSIPGGCCSFDLPTLHIWLHLPQAQRDSQVETWIASLNPLTQALTMVLDLIRQSAPFRKQTSLNGFYQDNGGDADLLRLNLSLDSQLYPQISGHKSRFAIRFMPLDSENGQVPERLDFELACC

SEQ ID NO: 425 - DNA, 621 bp, Escherichia coli
atgaggtatatagttgccttaacgggaggcattggcagtggcaagagtaccgttgccaatgcgtttgctaatctcggaattaacgtcattgatgccgatattattgcgcgtcaggtggttgaaccaggtgcacctgcgctacatgccattgctgatcactttggcgctaacatgattgctgctgatggaacattgcagcgccgggccttgcgcgaacggatcttcgccaacccggaagagaaaaactggcttaacgccctgctgcatccgctgattcagcaagagacgcaacaccagatccagcaagctacttccccctatgtactatgggttgtgccattgctggtagaaaactcactgtataaaaaagcgaatcgagtgctggtggtggatgtcagcccagaaacgcaacttaagcgcaccatgcagcgcgacgatgtaactcgcgagcatgtcgaacaaatccttgctgctcaggcaacgcgcgaagctcgccttgccgtggcagatgacgtcattgataataacggcgcaccggatgctatcgcatcggatgttgcccgcctgcacgcacactatttgcagcttgcgtcgcagtttgtctcacaggaaaaaccgtaa

SEQ ID NO: 426 - protein, 206 aa, Escherichia coli
MRYIVALTGGIGSGKSTVANAFANLGINVIDADIIARQVVEPGAPALHAIADHFGANMIAADGTLQRRALRERIFANPEEKNWLNALLHPLIQQETQHQIQQATSPYVLWVVPLLVENSLYKKANRVLVVDVSPETQLKRTMQRDDVTREHVEQILAAQATREARLAVADDVIDNNGAPDAIASDVARLHAHYLQLASQFVSQEKP

SEQ ID NO: 427 - DNA, 1044 bp, Escherichia coli
atgcgtattgaagaagatctgaagttaggttttaaagacgttctcatccgccctaaacgctccactcttaaaagccgttccgatgttgaactggaacgtcaattcaccttcaaacattcaggtcagagttggtccggcgtgccgattattgccgcaaatatggacaccgtaggcacattttctatggcctctgcgctggcttcttttgatattctgactgctgtgcataaacactattctgtcgaagagtggcaagcgtttatcaacaattcttccgctgatgtgctgaaacatgtgatggtttctaccggcacgtctgatgcggatttcgaaaaaactaaacagattctcgacctgaacccggcattaaatttcgtttgtattgacgtggcgaatggttattccgaacacttcgtgcagttcgttgcgaaagcgcgtgaagcgtggccgaccaaaaccatttgtgcaggcaacgtagtgactggtgaaatgtgtgaggagcttatcctctccggtgccgatatcgttaaagttggcattggcccaggttctgtttgtacaactcgcgtcaaaacaggcgtcggttatccgcaactttctgcggtgatcgaatgcgccgatgctgcgcacggtctgggcggaatgatcgtcagcgatggcggctgcaccacgccgggcgatgtcgcgaaagcctttggcggcggtgccgatttcgtaatgcttggcggcatgctggcgggccacgaagagagcggcggtcgcatcgttgaggagaacggcgagaaatttatgttgttctacggcatgagctcagagtctgcgatgaaacgtcacgttggcggcgttgcggaatatcgcgcagcagaaggtaaaaccgttaagctgccgctgcgaggcccggttgaaaataccgcgcgtgatattttgggcggcctgcgttcagcttgtacatacgttggggcttcacgcctgaaagaactgaccaagcgcaccacgtttatccgtgtgcaggaacaagaaaaccgcatcttcaacaacctgtaa

SEQ ID NO: 428 - protein, 347 aa, Escherichia coli
MRIEEDLKLGFKDVLIRPKRSTLKSRSDVELERQFTFKHSGQSWSGVPIIAANMDTVGTFSMASALASFDILTAVHKHYSVEEWQAFINNSSADVLKHVMVSTGTSDADFEKTKQILDLNPALNFVCIDVANGYSEHFVQFVAKAREAWPTKTICAGNVVTGEMCEELILSGADIVKVGIGPGSVCTTRVKTGVGYPQLSAVIECADAAHGLGGMIVSDGGCTTPGDVAKAFGGGADFVMLGGMLAGHEESGGRIVEENGEKFMLFYGMSSESAMKRHVGGVAEYRAAEGKTVKLPLRGPVENTARDILGGLRSACTYVGASRLKELTKRTTFIRVQEQENRIFNNL

SEQ ID NO: 429 - DNA, 1203 bp, Escherichia coli
atggcgagtaagcaactctggcgctggcatggcataaccggcgacggcaatgcgcaagatgggatgctatgggcagagagccgtgctttgctgctcatggcactacagcaacagatggttaccccactaagcctgaagcgaatcaccatcaattctacgcagtggcgaggagatataagcgcggaagtcattcatcaactggcgacgctactcaaagccgggttaacgctttctgaagggctggctctgctggcggaacagcatcccagtaagcagtggcaagcgttgctgcaatcactggcgcacgatcttgaacagggcgttgccttttccaatgccttattaccctggtcagaggtatttccgccgctctatcaggcgatgatccgcacgggtgaactgaccggtaagctggatgaatgctgctttgaactggcgcgtcagcaaaaagcccagcgtcagttgaccgacaaagtgaaatcagcgttacgttatcccattatcattttagcgatggcaatcatggtggttgtggcaatgctgcattttgtactgccggagtttgccgctatctataagacctttaacactccgctaccggcgctaacgcaggggatcatgacgctggcaagttttagtggcgaatggggttggttgctggtgctattcggctttctgctggcgatagccaataagctgctgatgcgccacccaaccaggcttatcgcacggcagaaattgctgttacgcatcccgattatgggttcactgatgcggggacaaaaactcacgcagatctttacgattctgacactgacacaaagtgcaggcatttcttttttacagggcgttgagagcgtcagagaaacaatgcgctgcccgtactgggtgcaacttctgacacaaatccagcacgatatcagtaacggtcaccccatctggctggcgctaaaaaatgccggtgagtttagcccgctctgtttgcaattagtgagaacaggagaggcatccggctcgctggatctcatgttagacaacctcgcccatcatcatcgggataacacaatggcgctggcggataacctcgcagccttactggaaccggcgttgctgatcataacgggaggaattatcggtacgctggtggtggcaatgtatctgccaattttccatttaggcgatgcgatgagtggaatgggataa

SEQ ID NO: 430 - protein, 400 aa, Escherichia coli
MASKQLWRWHGITGDGNAQDGMLWAESRALLLMALQQQMVTPLSLKRITINSTQWRGDISAEVIHQLATLLKAGLTLSEGLALLAEQHPSKQWQALLQSLAHDLEQGVAFSNALLPWSEVFPPLYQAMIRTGELTGKLDECCFELARQQKAQRQLTDKVKSALRYPIIILAMAIMVVVAMLHFVLPEFAAIYKTFNTPLPALTQGIMTLASFSGEWGWLLVLFGFLLAIANKLLMRHPTRLIARQKLLLRIPIMGSLMRGQKLTQIFTILTLTQSAGISFLQGVESVRETMRCPYWVQLLTQIQHDISNGHPIWLALKNAGEFSPLCLQLVRTGEASGSLDLMLDNLAHHHRDNTMALADNLAALLEPALLIITGGIIGTLVVAMYLPIFHLGDAMSGMG

SEQ ID NO: 431 - DNA, 1386 bp, Escherichia coli
atgaatattccacagctcactgccctgtgtctgcgttatcagggagtcttgctggatgccagcgaagaggtggttcatgttgcggtagtcgatgcaccttcgcatgagctactggacgcattgcatttcgctaccaccaaacgtattgagatcacctgctggacacgccaacaaatggaaggtcacgccagtcgcacacaacagacattgcccgtagctgttcaggagaagcatcagcccaaagcagagttgctgactcgaacgttacaatctgcgctagaacaacgcgcgtctgatattcatatcgaaccagcggacaatgcctaccgcatccgcttgcgtatcgacggcgtattgcatcctttaccggacgtttcaccggatgccggagtcgcattaaccgccagattaaaagtgctgggaaacctggatattgcggaacatcgcctgccgcaggacgggcaattcactgtcgaactggcaggaaacgccgtctcatttcgtattgcgaccttagcatgtcgaggtggtgaaaaggtggtattaaggttgttacagcaggtgaaccaggcactggatgttaacacgcttggaatgcagccgtcacaactggtggactttgctcatgccttgcaacaaccacagggactggtgctggtaactggccctacaggcagcggcaaaacggtcacgctttatagtgccctgcaaatgctgaataccgctgacattaatatttgtagcgtcgaagatccggttgagatccccatagccggactaaaccagacgcaaatccattcgcgtgccggactcacctttcagggcgttttgcgtgcgttattgcgccaggatcctgacgtcatcatgatcggagagatccgcgatggcgaaacggcagaaattgccattaaagccgcgcaaaccggtcacctggtgttgtctaccctacacactaactccacctgcgaaacgctggtacgtttacagcaaatgggagtcgcccgctggatgctatcatcggcgcttacgctggtaatagcccagcgtctggtacgcaaactttgcccgcattgtcgccggcagcaaggggagcccatccatattccagacaatgtatggccgtcgccgctgccccactggcaggcacccggttgtgtacattgctaccacggtttttatggtcgcacggccttatttgaagttctgcccataacaccggtcatacgtcagcttatttccgctaataccgacgttgaatcgctggaaacgcacgcccgacaggcgggtatgcgaacgctttttgaaaacggctgcctagccgtggagcaaggcttaaccacctttgaagagttaatccgcgtattagggatgccgcatggcgagtaa

SEQ ID NO: 432 - protein, 461 aa, Escherichia coli
MNIPQLTALCLRYQGVLLDASEEVVHVAVVDAPSHELLDALHFATTKRIEITCWTRQQMEGHASRTQQTLPVAVQEKHQPKAELLTRTLQSALEQRASDIHIEPADNAYRIRLRIDGVLHPLPDVSPDAGVALTARLKVLGNLDIAEHRLPQDGQFTVELAGNAVSFRIATLACRGGEKVVLRLLQQVNQALDVNTLGMQPSQLVDFAHALQQPQGLVLVTGPTGSGKTVTLYSALQMLNTADINICSVEDPVEIPIAGLNQTQIHSRAGLTFQGVLRALLRQDPDVIMIGEIRDGETAEIAIKAAQTGHLVLSTLHTNSTCETLVRLQQMGVARWMLSSALTLVIAQRLVRKLCPHCRRQQGEPIHIPDNVWPSPLPHWQAPGCVHCYHGFYGRTALFEVLPITPVIRQLISANTDVESLETHARQAGMRTLFENGCLAVEQGLTTFEELIRVLGMPHGE

SEQ ID NO: 433 - DNA, 441 bp, Escherichia coli
atggacaagcaacgcggttttacacttatcgaactgatggtggttattggcatcattgccattttaagcgccattggtattcccgcttatcaaaactacctgcgcaaagccgcactcaccgacatgctacaaacctttgtgccttaccgtaccgccgtagagttgtgcgcgctggaacatggtggattaaatacctgcgacggtggcagcaatggcattccctcgcctaccaccacccgctatgtttcagccatgagtgtggcaaagggcgtggtgtcgctgaccgggcaagaaagtctcaatggactaagcgtcgtcatgacgccgggttgggataacgcaaacggcgtcaccggctggacgcgtaactgcaatattcaaagtgacagcgcattgcagcaagcctgcgaagatgtcttccgctttgatgacgccaactaa

SEQ ID NO: 434 - protein, 146 aa, Escherichia coli
MDKQRGFTLIELMVVIGIIAILSAIGIPAYQNYLRKAALTDMLQTFVPYRTAVELCALEHGGLNTCDGGSNGIPSPTTTRYVSAMSVAKGVVSLTGQESLNGLSVVMTPGWDNANGVTGWTRNCNIQSDSALQQACEDVFRFDDAN

SEQ ID NO: 435 - DNA, 894 bp, Escherichia coli
atgccgcctcgccgctataaccctgacacccgacgtgacgagctgctggaacgcattaatctcgatatccccggcgcggtggcccaggcgctacgggaagatttaggcggaacagtcgatgccaacaatgacattacggcaaaacttttaccggaaaactctcgctctcatgccacagtgatcacccgcgagaatggcgtattttgcggcaaacgctgggttgaagaggtgtttattcaactggcaggcgacgatgtcaccataatctggcatgtggatgacggcgatgtcatcaacgccaatcaacccttgttcgaactcgaaggcccatctcgcgtgctgttaacgggcgaacgcactgcgcttaattttgtgcaaaccctttcaggagttgccagtaaggtacgccactatgtcgaattactggaaggcaccaacacgcagctgttggatacgcgcaaaaccttacccggcctgcgttcagctctgaaatacgcggtactttgcggcggcggagcgaatcaccgtctggggctttctgatgccttcctgatcaaagaaaaccatattattgcctccggctcagtgcgccaggcggtcgaaaaagcgtcctggttgcacccggatgcgccagtagaagtcgaagtagagaatctggaagaacttgatgaagccctgaaagcaggtgccgatatcatcatgctggataacttcgaaacagaacagatgcgcgaagccgtcaaacgcaccaacggcaaggcgctactggaagtgtctggcaacgtcactgacaaaacactgcgcgaatttgccgaaacgggcgtggactttatctccgttggtgcgctgactaaacacgtacaggcactcgacctttcaatgcgttttcgctaa

SEQ ID NO: 436 - protein, 297 aa, Escherichia coli
MPPRRYNPDTRRDELLERINLDIPGAVAQALREDLGGTVDANNDITAKLLPENSRSHATVITRENGVFCGKRWVEEVFIQLAGDDVTIIWHVDDGDVINANQPLFELEGPSRVLLTGERTALNFVQTLSGVASKVRHYVELLEGTNTQLLDTRKTLPGLRSALKYAVLCGGGANHRLGLSDAFLIKENHIIASGSVRQAVEKASWLHPDAPVEVEVENLEELDEALKAGADIIMLDNFETEQMREAVKRTNGKALLEVSGNVTDKTLREFAETGVDFISVGALTKHVQALDLSMRFR

SEQ ID NO: 437 - DNA, 552 bp, Escherichia coli
atgttgttagaacaggggtggctggctggcgcgcgccgcgttccctcaccacattacgattgccgcccggatgacgaaacacccactctgctggtggtgcacaatattagcctgccgccaggcgagtttggcggcccgtggatcgacgcattattcactggaactattgatccgcaggcgcatcctttctttgctgagatcgcccatttgcgcgtctccgctcactgtttgattcgccgtgatggtgaaatagtccagtatgttcctttcgataaacgagcctggcatgcgggagtctctcagtatcaggggcgtgaacgctgcaatgatttttctattgggattgagctggaaggcaccgatacgctggcgtataccgatgcgcagtatcaacagcttgcggcggttacacgggcactgattgatcgctatccggatatcgctaataacatgacgggccattgtgatattgcgccggatcggaaaaccgatcccggtcctgcatttgattgggcacggtttcgtgcgctggtcagcaaggagacaacatga

SEQ ID NO: 438 - protein, 183 aa, Escherichia coli
MLLEQGWLAGARRVPSPHYDCRPDDETPTLLVVHNISLPPGEFGGPWIDALFTGTIDPQAHPFFAEIAHLRVSAHCLIRRDGEIVQYVPFDKRAWHAGVSQYQGRERCNDFSIGIELEGTDTLAYTDAQYQQLAAVTRALIDRYPDIANNMTGHCDIAPDRKTDPGPAFDWARFRALVSKETT

SEQ ID NO: 439 - DNA, 855 bp, Escherichia coli
atgacgctatttacaaccttactggtgttaattttcgagcgcctgtttaagttgggcgagcactggcagcttgatcatcgtcttgaagcgttctttcggcgggtgaaacatttttctctcgggcgcacgttatgcatgaccattattgcgatgggcgtgacttttttactgttacgcgcattgcagggagtattgttcaacgttcccacgctgctggtgtggctgctgattggtttgctgtgtattggcgcaggtaaagttcgtcttcattatcatgcttatctgacagctgcttcacgtaatgatagccatgcccgtgccacgatggctggcgaactcaccatgattcacggcgtcccggcaggctgcgatgaacgtgagtatttgcgtgagctgcaaaatgcattgctgtggattaactttcgtttttatcttgcaccgctgttctggctgattgtggggggaacctggggacccgttacgctgatggggtatgcgtttttgcgtgcatggcaatactggctggcgcgataccagacgccgcatcatcgtttacagtccggcattgatgccgtgcttcatgtacttgattgggtgccggttcgtcttgcgggtgtggtatatgccttgatcggtcatggtgagaaagcgttaccggcctggtttgcttcgctgggtgatttccatacttcgcaatatcaggtattaacgcgtctggcacagttctctctggcgcgtgaaccgcatgtcgataaggtggagacgccaaaggcagcggtttcaatggcgaagaaaacctcgttcgtggtcgtggtggttattgcgctactgacgatttacggggcgttggtgtaa

SEQ ID NO: 440 - protein, 284 aa, Escherichia coli
MTLFTTLLVLIFERLFKLGEHWQLDHRLEAFFRRVKHFSLGRTLCMTIIAMGVTFLLLRALQGVLFNVPTLLVWLLIGLLCIGAGKVRLHYHAYLTAASRNDSHARATMAGELTMIHGVPAGCDEREYLRELQNALLWINFRFYLAPLFWLIVGGTWGPVTLMGYAFLRAWQYWLARYQTPHHRLQSGIDAVLHVLDWVPVRLAGVVYALIGHGEKALPAWFASLGDFHTSQYQVLTRLAQFSLAREPHVDKVETPKAAVSMAKKTSFVVVVVIALLTIYGALV

SEQ ID NO: 441 - DNA, 1371 bp, Escherichia coli
atggaaggtcaacagcacggcgagcagctaaagcgcggccttaaaaaccgccatattcagcttatcgcgctgggtggcgcgatagggacagggctattcctgggtagcgcctccgtaatacaatccgcagggccagggattatcctgggttacgccattgctggttttatcgcctttctgatcatgcgtcagctaggtgaaatggtggtcgaagaacctgtcgcaggctcctttagccactttgcttataaatactggggcagttttgccggtttcgcctctggctggaactactgggtactgtacgttttagttgccatggcagagctgactgccgtgggtaaatacattcagttctggtatccggaaatcccaacctgggtttctgccgccgtgttctttgtggtgatcaacgccatcaacctgacaaacgtaaaagtgtttggcgagatggagttctggtttgccattatcaaagttatcgcggtggtagcgatgatcatcttcggcgcctggctgctattcagcggcaacggcggcccgcaggcgagcgttagcaacctgtgggatcagggtggtttcctgccacacggcttcaccggtctggtgatgatgatggcgattatcatgttctctttcggtggtctggaactggtggggatcaccgcagcagaagctgataacccggagcaaagtatcccgaaagcaactaaccaggttatctaccgcatcctgattttctatattggctcgttagccgttctgctctcactaatgccgtggacccgcgttaccgctgataccagtccgtttgtgctgatcttccacgagttaggcgatacctttgtagcgaatgcgctgaatatcgtggtactgaccgctgcgctctccgtgtacaacagctgcgtatattgcaacagccgtatgctgttcggtctggcacaacaagggaacgcgccaaaagcgctggcgtctgtcgataaacgcggcgtaccggttaacactattctggtgtctgcgctggttacggcattgtgcgtactgattaactaccttgccccagagtccgctttcggactgttaatggcgctggtggtatctgcactggtcatcaactgggcgatgatcagtctggcgcatatgaaattccgtcgtgccaaacaagaacaaggcgtggtaactcgcttccctgccctgctttatccgctgggtaactggatctgcctgctgtttatggcggcggtactggtgattatgctgatgaccccaggaatggcgatttcggtatacctgatcccggtatggctgatcgtgttaggtataggctatctgtttaaagagaaaaccgccaaagccgtaaaagcgcattaa

SEQ ID NO: 442 - protein, 456 aa, Escherichia coli
MEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGAWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 443 - DNA, 1782 bp, Escherichia coli
gtgggcgatattgtttacctgagaataatcggtgagaagcagggcgatatttcttcaggctgtgggacgtatgcgtcggttggtaatcgctggcaggttggccatgaagatgaaatttttgcctttgcactcaccaacgccattaccagtactggtaaaggcgttaatctacaggggctacaattttgcaaactcattgataaaagctcaccgctactgtctaatgccatcaatcagaatgagcggttatttattgaaatcgatttgtatcgtataaataaaagcgggcgctgggaacggtattattatattcagctaagaaatgcttcattaactgctattcatgtaaacatttctgacaataatcttcctaccgaatgtgtaaatgttaattatgactacatattatgcaaacatctaatagccaatacggaatttgactggttggcctttcctgctggctataatagcttatttattccacctaaaaacccacctgccagtaatcttaaccctgagccactaccagttgttaaccttccactctctccaccagcggttaaaccggtctatgccaaatcctgtctgaaggagaagggatgtacagatgccggaacggcagaagaacccgctgaaaacttcgggcaagtagcgatttttgctctgccagtggttgatgactgctgtggataccaccatccggaggctaacgatgttgggcaacccgcagaagctcaaaccatgctactgtttccgggtagtgtgttggcggctcaaatatggggaaaatggtcgctcagtggcatactcagtgcaacctgcggctcttacatcggtgcgttggcatctgctttgtatattccctctgcgggcgagggcagtgctcgcgtgcccggacgtgatgagttctggtatgaggaagaactgcggcagaaagcactagcaggcagtaccgccaccacccgggtacgttttttctggggaactgacattcacggcaagcctcaggtgtatggtgttcatacgggtgaaggtacgccgtatgaaaacgtccgcgtggcgaacatgcagtggaacgagcagacgcagcgttatgaatttacccccgctcacgatgtcgatggccccctgattacctggacgccggaaaatccggaacatgggtatgttccgggccataccggtaacgacaggccgccgctggagcagcccaccattctggtgacgccgattccggacggcaccgatacctataccacgccgccattcccggttcctgatccgaaagaattcaacgattatattctggtttttccggcgggatccggtattaagcccatctatgtttacctgaaggaggatccgcgaaagctgcctggtgttgtaacagggcgcggcgtcccgctttcaccaggaactcgctggctggatatgtcggtatccaataacggcaacggcgcaccaatcccggcgcatattgctgataaattgcgcggacgggagtttaaaacctttgatgagtttcgcgaggcgctgtggctggaggtgagtcaggatccggagttgatagcgcagttttcaagtggtaaccaaacacgtataaaacaaggattaaccgcaaaagcacctattgacggttggtattatggccctaaagaaatagttaaaaaattccagatacatcatcgtgttgcagttgaatatggcggcagcgtatacgatattgataatttacgaattgttacccccagactacacgatgagattcactacaggagataa

SEQ ID NO: 444 - protein, 593 aa, Escherichia coli
MGDIVYLRIIGEKQGDISSGCGTYASVGNRWQVGHEDEIFAFALTNAITSTGKGVNLQGLQFCKLIDKSSPLLSNAINQNERLFIEIDLYRINKSGRWERYYYIQLRNASLTAIHVNISDNNLPTECVNVNYDYILCKHLIANTEFDWLAFPAGYNSLFIPPKNPPASNLNPEPLPVVNLPLSPPAVKPVYAKSCLKEKGCTDAGTAEEPAENFGQVAIFALPVVDDCCGYHHPEANDVGQPAEAQTMLLFPGSVLAAQIWGKWSLSGILSATCGSYIGALASALYIPSAGEGSARVPGRDEFWYEEELRQKALAGSTATTRVRFFWGTDIHGKPQVYGVHTGEGTPYENVRVANMQWNEQTQRYEFTPAHDVDGPLITWTPENPEHGYVPGHTGNDRPPLEQPTILVTPIPDGTDTYTTPPFPVPDPKEFNDYILVFPAGSGIKPIYVYLKEDPRKLPGVVTGRGVPLSPGTRWLDMSVSNNGNGAPIPAHIADKLRGREFKTFDEFREALWLEVSQDPELIAQFSSGNQTRIKQGLTAKAPIDGWYYGPKEIVKKFQIHHRVAVEYGGSVYDIDNLRIVTPRLHDEIHYRR

SEQ ID NO: 445 - DNA, 285 bp, Escherichia coli
atgtttaaagaaaagctccaggattataccgaggatgaatttcttaattttttaggcggattgagatcatctatgaaagatggaaaatccttaaaaggtaaggagctagaaatgtactgggattcattagtagatcattttattgaaattacacagcatccgtcagggagcgatctaattttctaccctaaaagtcaaggagatgataagcctgaaaacatcctgaaaattgtcaaagaatggcggcgttcacaggggttacccttgtttaaagactctaaataa

SEQ ID NO: 446 - protein, 94 aa, Escherichia coli
MFKEKLQDYTEDEFLNFLGGLRSSMKDGKSLKGKELEMYWDSLVDHFIEITQHPSGSDLIFYPKSQGDDKPENILKIVKEWRRSQGLPLFKDSK

SEQ ID NO: 447 - DNA, 240 bp, Escherichia coli
gtgagtcagtatccggagttgatagcgcagttttcaagcggtaatcaaacacgtataaaacaaggattaatcgcaaaagcaccacttgaaggttggcattatggcactaaagaaatcgttaaaaaattccacatgtatcatcgtgttgcgattgaatatagtggcggaatttacgatattgataatttaaggagggcacacctcatttgcatgatgaaatttattacaggagatagttaa

SEQ ID NO: 448 - protein, 79 aa, Escherichia coli
MSQYPELIAQFSSGNQTRIKQGLIAKAPLEGWHYGTKEIVKKFHMYHRVAIEYSGGIYDIDNLRRAHLICMMKFITGDS

SEQ ID NO: 449 - DNA, 291 bp, Escherichia coli
atgtataattttaaagatgaaatagaagattacacagagcgggaattcattgagttgcttggcgagtttacaaatccaaccggggataacgctcaattaaaaggggaagagcttgacaaatattgggatgatctagaagaacatcttaccagaattacacaacatccgttgatgagcgatcttatctactatcctgcaaagaagggagatgatgaacctgaaaacatcctgaaaattgtcaaagaatggcggcgttcacaggggctacccttgtttaaagactctaaataa

SEQ ID NO: 450 - protein, 96 aa, Escherichia coli
MYNFKDEIEDYTEREFIELLGEFTNPTGDNAQLKGEELDKYWDDLEEHLTRITQHPLMSDLIYYPAKKGDDEPENILKIVKEWRRSQGLPLFKDSK

SEQ ID NO: 451 - DNA, 291 bp, Escherichia coli
atgcatgatttaaaatataaaatatatttttacacagaaggtgaatttcttgaaatgcttgaggagatagtaaatgcaactagcaaagataaatccctaaaagggaaaaaattagaaaaatatctcgataccttagtggatcatttcattaaaattactgaacatcctaaaaagggagatctcattttctatcctaattccccagaagatggtaaacctgaaaacatcctgaaaatcgtcaaagaatggcggcgttcgcaaggattgcctttgttcaaagattcagaatga

SEQ ID NO: 452 - protein, 96 aa, Escherichia coli
MHDLKYKIYFYTEGEFLEMLEEIVNATSKDKSLKGKKLEKYLDTLVDHFIKITEHPKKGDLIFYPNSPEDGKPENILKIVKEWRRSQGLPLFKDSE

SEQ ID NO: 453 - DNA, 798 bp, Escherichia coli
ttgacttcggcaagtggcttaagacaggaactcatggcctacagcaaaatccgccaaccaaaactctccgatgtgattgagcagcaactggagtttttgatcctcgaaggcactctccgcccgggcgaaaaactcccaccggaacgcgaactggcaaaacagtttgacgtctcccgtccctcattgcgtgaggcgattcaacgtctcgaagcgaagggcttgttgcttcgtcgccagggtggcggcacttttgtccagagcagcctatggcaaagcttcagcgatccgctggtggagctgctctccgaccatcctgaatcacagtatgacttgctcgaaacacgacacgccctggaaggtatcgccgcttattacgccgcgctgcgtagtaccgatgaagacaaggaacgcatccgtgaactccaccacgctatagagctggcgcagcagtctggcgatctggacgcggaatcaaacgccgtactccagtatcagattgccgtcaccgaagcggcccacaatgtggttctgcttcatctgctaaggtgtatggagccgatgttggcccagaatgtccgccagaacttcgaattgctctattcgcgtcgcgagatgctgccgctggtgagtagtcaccgcacccgcatatttgaagcgattatggccggtaagccggaagaagcgcgcgaagcatcgcatcgccatctggcctttatcgaagaaattttgctcgacagaagccgtgaagagagccgccgtgagcgttctctgcgtcgtctggagcaacgaaagaattag

SEQ ID NO: 454 - protein, 265 aa, Escherichia coli
MTSASGLRQELMAYSKIRQPKLSDVIEQQLEFLILEGTLRPGEKLPPERELAKQFDVSRPSLREAIQRLEAKGLLLRRQGGGTFVQSSLWQSFSDPLVELLSDHPESQYDLLETRHALEGIAAYYAALRSTDEDKERIRELHHAIELAQQSGDLDAESNAVLQYQIAVTEAAHNVVLLHLLRCMEPMLAQNVRQNFELLYSRREMLPLVSSHRTRIFEAIMAGKPEEAREASHRHLAFIEEILLDRSREESRRERSLRRLEQRKN

SEQ ID NO: 455 - DNA, 2664 bp, Escherichia coli
atgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtcaacgtagccgcaggcaccggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccacatggcgtccttccagtcttccgcaaccatttatgatgtgtgctttaaccacttcttccgtgcacgcaacgagcaggatggcggcgacctggtttacttccagggccacatctccccaggcgtttacgctcgtgctttcctggaaggtcgtctgactcaggagcagctggataacttccgtcaggaagttcacggcaatggcctctcttcctatccgcacccgaaactgatgccggaattctggcagttcccgaccgtatctatggggctgggtccgattggtgctatttaccaggctaagttcctgaaatatctggaacaccgtggcctgaaagatacctctaaacaaaccgtttacgcgttcctcggcgacggtgaaatggacgaaccggaatccaaaggtgcgatcaccatcgctacccgtgaaaaactggataatctggtcttcgttatcaactgtaacctgcagcgtcttgacggcccggtcaccggtaacggcaagatcatcaacgaactggaaggcatcttcgaaggtgctggctggaacgtgatcaaagtgatgtggggtagccgttgggacgaactgctgcgtaaagataccagcggtaaactgatccagctgatgaacgaaaccgttgacggcgattaccagaccttcaaatcgaaagatggtgcgtatgttcgcgaacactttttcggtaaatatcctgaaaccgcagcactggttgcagactggactgacgagcagatctgggcactgaaccgtggtggtcacgatccgaagaaaatctacgctgcattcaagaaagcgcaggaaaccaaaggcaaagcgacggtaatccttgctcataccattaaaggttacggcatgggcgacgcggctgaaggtaaaaacatcgcgcaccaggttaagaaaatgaacatggacggtgtgcgtcacatccgcgaccgtttcaatgtgccggtgtctgatgcagatatcgaaaaactgccgtacatcaccttcccggaaggttctgaagagcatacctatctgcacgctcaacgtcagaaactgcacggttatctgccaagccgccagccgaacttcaccgagaagctggagctgccgagcctgcaagatttcggcgcgctgctggaagagcagagcaaagagatctctaccactatcgctttcgttcgtgctctgaacgtgatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggtttccagcgtatcggcgatctgtgctgggcggctggcgaccagcaagcgcgtggcttcctgatcggcggtacttccggtcgtaccaccctgaacggcgaaggtctgcagcacgaagatggtcacagccacattcagtcgctgactatcccgaactgtatctcttacgatccggcttacgcttacgaagttgctgtcatcatgcatgacggtctggagcgtatgtacggtgaaaaacaagagaacgtttactactacatcactacgctgaacgaaaactaccatatgccggcaatgccggaaggtgctgaggaaggtatccgtaaaggtatctacaaactcgaaacccttgaaggtagcaaaggtaaagttcagctgctgggctccggttctatcctgcgtcacgtccgtgaagcggcagagatcctggcgaaagattacggcgtaggttctgacgtttatagcgtgacttccttcaccgaattggcgcgtgatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccactttgaagttgatgcttcttatgtcgtggttgcggcgctgggcgaactggctaaacgtggcgaaatcgataagaaagtggttgctgacgcaatcgccaaattcaacatcgatgcagataaagttaacccgcgtctggcgtaa

SEQ ID NO: 456 - protein, 887 aa, Escherichia coli
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETLEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 457 - DNA, 1893 bp, Escherichia coli
atggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagtaccatctccgcaggcgggtatcgttaaagagatcaaagtctctgttggcgataaaacccagaccggcgcactgattatgattttcgattccgccgacggtgcagctgacgctgcacctgctcaggcagaagagaagaaagaagcagctccggcagcagcaccagcggctgccgcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggtagctccggcagctaaacaggaagcagctccggcagcggcccctgcatcagcagctggcgtgaaagaagttaacgttccggatatcggcggtgacgaagttgaagtgaccgaagtgatggtgaaagtgggcgacaaagttgccgctgaacagtcactgatcaccgtagaaggcgataaagcttctatggaagttccggctccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggctccggcagcaaaagctgaagctccagcagcagctccggctgcgaaagccgaaggcaaatctgaatttgctgaaaacgacgcttacgttcacgcgactccgctgatccgccgtctggcacgcgaatttggcgttaacctggcgaaagtgaagggcactggccgtaaaggtcgtatcctgcgcgaagacgttcaggcttacgtgaaagaagctatcaaacgtgcagaagcggctccggcggcgactggcggcggtatcccaggcatgctgccgtggccgaaggtggacttcagcaagtttggtgaaatcgaagaagtggaactgggccgtatccagaaaatctctggtgcgaacctgagccgtaactgggtgatgatcccgcatgttacccacttcgacaaaaccgatatcaccgagctggaagcgttccgtaaacagcagaacgaagaagcggcgaaacgtaagctggatgtgaagataaccccagttgtcttcatcatgaaagccgttgctgcagctcttgagcagatgcctcgcttcaacagttcgttgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctggggactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaa

SEQ ID NO: 458 - protein, 630 aa, Escherichia coli
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAVAPAAKQEAAPAAAPASAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 459 - DNA, 1488 bp, Escherichia coli
gtggataatgggcgtcataaaaaaaacgtcagacccgccggagataaatatatagaggtcatgatgagtactgaaatcaaaactcaggtcgtggtacttggggcaggccccgcaggttactccgctgccttccgttgcgctgatttaggtctggaaaccgtaatcgtagaacgctacaacacccttggcggtgtttgcctgaacgtcggctgtatcccttctaaagcactgctgcacgtagcaaaagttatcgaagaagccaaagcgctggctgaacacggtatcgtctttggcgaaccgaaaaccgatatcgacaagattcgtacctggaaagagaaagtgatcaatcagctgaccggtggtctggctggtatggcgaaaggccgcaaagtcaaagtggtcaacggtctgggtaaatttaccggggctaacaccctggaagttgaaggtgagaacggtaaaaccgtgatcaacttcgacaacgcgatcattgcagcgggttctcgcccgattcaactgccgtttattccgcatgaagatccgcgtatctgggactccactgacgcgctggaactgaaagaagtaccagaacgcctgctggtaatgggtggcggtatcatcggtctggaaatgggcaccgtataccacgcgctgggttcacagattgacgtggttgaaatgttcgaccaggtcatcccggcagctgataaagacatcgttaaagtctttaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagctggcgtggaagttgacgaccgtggtttcatccgcgttgacaaacagctgcgtaccaacgtaccgcacatctttgctatcggtgatatcgtcggtcagccaatgctggcacacaaaggtgttcacgaaggtcacgttgccgctgaagttatcgccggtaaaaaacattacttcgatccgaaagttatcccgtccatcgcctataccgaaccagaagttgcatgggtaggtctgactgagaaagaagcgaaagagaaaggcatcagctacgaaaccgccaccttcccgtgggctgcttctggtcgtgctatcgcttccgactgcgcagacggtatgaccaagctgattttcgacaaagaatctcaccgtgtgatcggtggtgcaattgtcggtactaacggcggtgagctgctgggtgaaatcggcctggcaatcgaaatgggttgtgacgctgaagacatcgcactgaccatccatgcgcacccgactctgcacgagtctgtgggcctggcggcagaagtgttcgaaggtagcattaccgacctgccgaacccgaaagcgaagaagaagtaa

SEQ ID NO: 460 - protein, 495 aa, Escherichia coli
MDNGRHKKNVRPAGDKYIEVMMSTEIKTQVVVLGAGPAGYSAAFRCADLGLETVIVERYNTLGGVCLNVGCIPSKALLHVAKVIEEAKALAEHGIVFGEPKTDIDKIRTWKEKVINQLTGGLAGMAKGRKVKVVNGLGKFTGANTLEVEGENGKTVINFDNAIIAAGSRPIQLPFIPHEDPRIWDSTDALELKEVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 461 - DNA, 1758 bp, Escherichia coli
atgaaaatgactttgccgtttaaaccccatgtgctggcgctaatttgcagtgccgggctttgtgccgcctctgccgggctatatataaaaagccgcacagtggaagcgcctgtggaagcgcaatcgacacaacagactgcgcctgacatctccgcagttacgcttcctgcaacggtttccgcgcctcccgtaacgcctgccgtcgtcaaatccgcattcagcactgctcaaatagatcaatgggttgcacctgtcgcgctataccccgactctctgctttcacaagtgttaatggcatcaacctatccggcaaacgttgctcaagcagtgcaatggtcgcacgataatccacttaaacaaggcgatgctgctattcaggctgtatctgaccagccctgggacgccagcgtcaaatcactggtggcctttccacagttgatggcattgatgggcgaaaacccgcaatgggtgcaaaacctgggcgatgcttttctggcgcagccgcaggacgtgatggactcggtacagcgattgcggcaactggcgcaacaaaccggctcgctgaagtcatcaactgaacaaaagatcatcgcgacaacgaaaaaagtcgtaccggtaaatcagcccgccaacgcccctgccacacaatcaaataccgtttctacgtccagccccgtcgtcgcagaacctgcaccgaccgtaataaccattgagccagccaatccggatgtggtttatattccgaactacaacccaaacgtggtttacggcagttgggccaataccgcttatccgccagtttatctgccgccgccagccggagaaccgtttgttgacagctttgtgcgcggattcggctatagcatgggcgttgctaccacatacgcactattcagcagcatcgactgggacgacgacgatcatgaccatcatcatcatgacgatgatgattatcatcaccacgatggcggtcatcgtgacggtaatgactggcaacacaacggcgacaacatcaatatcgacgtcaacaatttcaaccgtatcaccggtgagcatcttactgataagaatatggcatggcggcacaatccaaactaccgtaatggtgtgacctatcatgatcaggatatggcaaagcggtttcatcaaaccgatgtcaacggcggaatgagcgccacgcagttacctgctccaacacgcgacagccagcgtcatgcggcagcaagtcagtttcagcaacgaacacacgccgcccccgtcattacgcgagatacccaacgtcaggcagcggcacagcggtttaatgaagctgaacactatgggagctatgacgacttccgcgacttcagccgtcgccagccactgacccagcaacaaaaggacgccgctcgtcagcgttatcagtcggcttctcctgagcagcgccaggcagtccgcgagaaaattcaggctaacccgcagaatcagcagagaagagaagcggcacgtcagcgtattcagtccgcgtcgcctgagcagcgccaggcggttcgcgagaaaatgcagactaacccgcagaatcaacagcaaagagatgcagcacgtcagcgtatccagtctgcctcgcctgagcagcgtcaggtttttcgagagaaagttcaggagagccgcccgcagcgtctaaacgacagtaaccatactgcccgattgaataatgagcaacggtcagcggtacgcgaacggttgtctgagcgtggagcaaggagactggaaaggtaa

SEQ ID NO: 462 - protein, 585 aa, Escherichia coli
MKMTLPFKPHVLALICSAGLCAASAGLYIKSRTVEAPVEAQSTQQTAPDISAVTLPATVSAPPVTPAVVKSAFSTAQIDQWVAPVALYPDSLLSQVLMASTYPANVAQAVQWSHDNPLKQGDAAIQAVSDQPWDASVKSLVAFPQLMALMGENPQWVQNLGDAFLAQPQDVMDSVQRLRQLAQQTGSLKSSTEQKIIATTKKVVPVNQPANAPATQSNTVSTSSPVVAEPAPTVITIEPANPDVVYIPNYNPNVVYGSWANTAYPPVYLPPPAGEPFVDSFVRGFGYSMGVATTYALFSSIDWDDDDHDHHHHDDDDYHHHDGGHRDGNDWQHNGDNINIDVNNFNRITGEHLTDKNMAWRHNPNYRNGVTYHDQDMAKRFHQTDVNGGMSATQLPAPTRDSQRHAAASQFQQRTHAAPVITRDTQRQAAAQRFNEAEHYGSYDDFRDFSRRQPLTQQQKDAARQRYQSASPEQRQAVREKIQANPQNQQRREAARQRIQSASPEQRQAVREKMQTNPQNQQQRDAARQRIQSASPEQRQVFREKVQESRPQRLNDSNHTARLNNEQRSAVRERLSERGARRLER

SEQ ID NO: 463 - DNA, 195 bp, Escherichia coli
ttgctccacgctcagacaaccgttcgcgtaccgctgaccgttgctcattattcaatcgggcagtatggttactgtcgtttagacgctgcgggcggctctcctgaactttctctcgaaaaacctgacgctgctcaggcgaggcagactggatacgctgacgtgctgcatctctttgctgttgattctgcgggttag

SEQ ID NO: 464 - protein, 64 aa, Escherichia coli
MLHAQTTVRVPLTVAHYSIGQYGYCRLDAAGGSPELSLEKPDAAQARQTGYADVLHLFAVDSAG

SEQ ID NO: 465 - DNA, 102 bp, Escherichia coli
ttggctggctcaatggttattacggtcggtgcaggttctgcgacgacggggctggacgtagaaacggtatttgattgtgtggcaggggcgttggcgggctga

SEQ ID NO: 466 - protein, 33 aa, Escherichia coli
MAGSMVITVGAGSATTGLDVETVFDCVAGALAG

SEQ ID NO: 467 - DNA, 2751 bp, Escherichia coli
atgttgcttttttgtaaacagattaacacatcgtcaaaatcctgctattctgcccgttgcggtactgggcatttaccctacaaactgctgtctcacaggagcgtgaagagaatcgcctgccgcactatgacaatgagagcgaggagaaccgtcgtgctagaagaataccgtaagcacgtagctgagcgtgccgctgaggggattgcgcccaaacccctggatgcaaaccaaatggccgcacttgtagagctgctgaaaaacccgcccgcgggcgaagaagaattcctgttagatctgttaaccaaccgtgttccccctggcgtcgatgaagccgcctatgtcaaagcaggcttcctggctgctgtcgccaaaggcgaagctaaatccccgctgctgactccggaaaaagccattgaactgctgggcactatgcagggtggttacaacattcatccgctgatcgacgcgctggatgatgccaaactggcaccgatcgctgccaaagcactttctcacacgctgctgatgttcgataacttctatgacgtagaagagaaagccaaagcaggcaacgaatatgcgaagcaggtaatgcagtcctgggcggatgccgaatggttcctgaatcgcccggcgctggctgaaaaactgaccgttaccgtcttcaaagtcactggcgaaaccaacaccgatgacctctctccggcaccagatgcgtggtcacgcccggatatcccactgcacgcgctggcgatgctgaaaaacgcccgtgaaggtattgagccagatcagcctggtgttgttggcccgatcaaacagattgaagctctgcaacagaaaggtttcccgctggcgtacgtcggtgacgttgtgggtacgggttcatcgcgtaaatccgccacgaactccgttctgtggtttatgggcgatgatattccacatgtgccgaacaaacgcggcggtggtttgtgcctcggcggtaaaattgcaccaatcttttttaacacgatggaagacgcgggtgcactgccaatcgaagtcgacgtctctaacctgaacatgggcgacgtaattgacgtttacccgtacaaaggtgaagtgcgtaaccacgaaaccggcgaactgctggcaaccttcgaactgaaaaccgacgtgctgattgatgaagtgcgtgctggcggccgtattccgctgattatcgggcgtggcctgaccaccaaagcgcgtgaagcacttggcctgccgcacagcgatgtgttccgtcaggcgaaagatgtcgctgagagcgaccgtggcttctcgctggcgcagaaaatggtgggccgagcctgtggcgtgaaaggcattcgtccgggcgcgtactgtgaaccgaaaatgacttctgtaggttcccaggacaccaccggcccgatgacccgtgatgaactgaaagacctggcgtgcctgggcttctcggctgacctggtgatgcagtctttctgccacaccgcggcgtatccgaagccagttgacgtgaacacgcaccacacgctgccggacttcattatgaaccgtggcggtgtgtcgctgcgtccgggtgacggcgtaatccactcctggctgaaccgtatgctgctgccggataccgtcggtaccggtggtgactcccatacccgtttcccgatcggtatctctttcccggcgggttctggtctggtggcatttgcagccgcaacaggcgtaatgccgctggatatgccagaatccgttctggtgcgcttcaaaggcaaaatgcagccgggtatcaccctgcgcgatctggtacacgcgatcccgctgtatgcaatcaaacaaggtctgctgaccgttgagaagaaaggtaagaaaaacatcttctctggccgcattctggaaattgaaggtctgccggatctgaaagttgagcaggcatttgagctgaccgatgcgtctgccgagcgttctgctgccggttgtaccatcaagctgaacaaagaaccgatcattgaatacctgaactctaacatcgtcctgctgaagtggatgatcgcggaaggttacggcgatcgtcgtaccctggagcgtcgtattcagggcatggaaaaatggctggcgaatcctgagctgctggaagccgatgcagatgcggaatacgcggcagtgatcgacatcgatctggcggatatcaaagagccaatcctctgtgcaccgaatgacccggacgacgcacgtccgctgtctgcggtacagggcgagaagatcgacgaagtatttatcggttcttgcatgactaacatcggtcacttccgtgctgctggtaaactgctggatgcgcacaaaggtcagttgccgacccgcctgtgggtggcaccgccaacgcgtatggacgctgcgcagctgaccgaagaaggctactacagcgtcttcggtaagagtggtgctcgtatcgagatccctggctgttccctgtgtatgggtaaccaggcgcgtgtagcagacggtgcgacggtggtttccacctctacccgtaacttcccgaaccgtttgggtactggcgcgaatgtcttcctggcttctgcggaactggctgctgttgcggcgctgattggcaaactgccgacgccggaagagtaccagacctacgtggcgcaggtagataaaacagccgttgatacttaccgttatctgaacttcgaccagctttctcagtacaccgaaaaagcggacggggtgattttccagactgcggtttaa

SEQ ID NO: 468 - protein, 916 aa, Escherichia coli
MLLFCKQINTSSKSCYSARCGTGHLPYKLLSHRSVKRIACRTMTMRARRTVVLEEYRKHVAERAAEGIAPKPLDANQMAALVELLKNPPAGEEEFLLDLLTNRVPPGVDEAAYVKAGFLAAVAKGEAKSPLLTPEKAIELLGTMQGGYNIHPLIDALDDAKLAPIAAKALSHTLLMFDNFYDVEEKAKAGNEYAKQVMQSWADAEWFLNRPALAEKLTVTVFKVTGETNTDDLSPAPDAWSRPDIPLHALAMLKNAREGIEPDQPGVVGPIKQIEALQQKGFPLAYVGDVVGTGSSRKSATNSVLWFMGDDIPHVPNKRGGGLCLGGKIAPIFFNTMEDAGALPIEVDVSNLNMGDVIDVYPYKGEVRNHETGELLATFELKTDVLIDEVRAGGRIPLIIGRGLTTKAREALGLPHSDVFRQAKDVAESDRGFSLAQKMVGRACGVKGIRPGAYCEPKMTSVGSQDTTGPMTRDELKDLACLGFSADLVMQSFCHTAAYPKPVDVNTHHTLPDFIMNRGGVSLRPGDGVIHSWLNRMLLPDTVGTGGDSHTRFPIGISFPAGSGLVAFAAATGVMPLDMPESVLVRFKGKMQPGITLRDLVHAIPLYAIKQGLLTVEKKGKKNIFSGRILEIEGLPDLKVEQAFELTDASAERSAAGCTIKLNKEPIIEYLNSNIVLLKWMIAEGYGDRRTLERRIQGMEKWLANPELLEADADAEYAAVIDIDLADIKEPILCAPNDPDDARPLSAVQGEKIDEVFIGSCMTNIGHFRAAGKLLDAHKGQLPTRLWVAPPTRMDAAQLTEEGYYSVFGKSGARIEIPGCSLCMGNQARVADGATVVSTSTRNFPNRLGTGANVFLASAELAAVAALIGKLPTPEEYQTYVAQVDKTAVDTYRYLNFDQLSQYTEKADGVIFQTAV

SEQ ID NO: 469 - DNA, 795 bp, Escherichia coli
ttgaaaaaactgaaactgcatggctttaataatctgaccaaaagtctgagtttttgtatttacgatatctgctacgccaaaactaccgaagagcgcgacggttatattgcttatatcgatgaactctataatgccaaccgtctgaccgaaatcctgtcagaaacctgttccattatcggggccaatattcttaacatcgcccgccaggattacgagccacaaggtgccagcgtcactattctggtgagtgaagaaccggtcgacccgaaacttatcgacaaaacagaacatcccggcccactgccagaaacggtcgttgcccatctcgataaaagtcatatttgcgtacatacctacccggaaagtcatcctgaaggcggtttatgtaccttccgcgccgatattgaagtctctacctgcggcgtgatttctccgctgaaggcgctgaattacctgatccaccagcttgagtccgatattgtgactattgattatcgcgtgcgcggttttacccgcgacattaacggtatgaagcactttatcgaccatgagattaattcgattcagaactttatgtccgaagatatgaaggcgctgtatgacatggtggatgtaaacgtctatcaggagaatatcttccataccaagatgttgcttaaagagttcgaccttaagcactacatgttccacaccaaaccggaagatttaaccgacagcgagcgccaggaaattaccgctgcgctgtggaaagaaatgcgcgagatttattacgggcgcaatatgcccgctgtttaa

SEQ ID NO: 470 - protein, 264 aa, Escherichia coli
MKKLKLHGFNNLTKSLSFCIYDICYAKTTEERDGYIAYIDELYNANRLTEILSETCSIIGANILNIARQDYEPQGASVTILVSEEPVDPKLIDKTEHPGPLPETVVAHLDKSHICVHTYPESHPEGGLCTFRADIEVSTCGVISPLKALNYLIHQLESDIVTIDYRVRGFTRDINGMKHFIDHEINSIQNFMSEDMKALYDMVDVNVYQENIFHTKMLLKEFDLKHYMFHTKPEDLTDSERQEITAALWKEMREIYYGRNMPAV

SEQ ID NO: 471 - DNA, 867 bp, Escherichia coli
atggccgaaaaaaaacagtggcatgaaacgctacacgaccagtttgggcagtactttgcggtagataacgttctgtatcatgaaaagaccgatcaccaggatctgatcatttttgagaacgccgcatttggtcgcgtaatggcgctggatggtgtagtacaaaccaccgagcgtgacgagtttatctatcatgagatgatgacccatgttccgctactggcccacggtcacgcgaaacatgtgctgattatcggcggcggcgacggtgccatgctgcgtgaagtaacccgacataaaaacgttgagtcaatcacgatggtggaaatcgatgcgggtgtcgtgtcgttctgccgtcagtatcttcccaaccataacgccggtagttacgacgatccgcgctttaaactggtgatcgacgatggtgtcaatttcgttaatcaaaccaaccagacctttgatgtcattatctccgactgcaccgatcctatcggtcccggcgaaagtctgtttacttctgcattttatgaaggctgcaaacgttgcctgaatcctggcggtatcttcgtcgcacaaaacggcgtctgctttttacagcaggaagaggccatcgacagtcatcgcaaactcagccattacttcagcgatgttggcttttatcaggcggcgatcccgacctattacggcggcatcatgacctttgcatgggcgacagataacgacgccttacgccatctctcaaccgaaattattcaggcgcgttttctcgcttctggcctgaaatgccgttattacaatccggcagtccatacggcagcttttgccttaccccagtatctgcaagatgcactggcttcacagccgtcctaa

SEQ ID NO: 472 - protein, 288 aa, Escherichia coli
MAEKKQWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVESITMVEIDAGVVSFCRQYLPNHNAGSYDDPRFKLVIDDGVNFVNQTNQTFDVIISDCTDPIGPGESLFTSAFYEGCKRCLNPGGIFVAQNGVCFLQQEEAIDSHRKLSHYFSDVGFYQAAIPTYYGGIMTFAWATDNDALRHLSTEIIQARFLASGLKCRYYNPAVHTAAFALPQYLQDALASQPS

SEQ ID NO: 473 - DNA, 519 bp, Escherichia coli
ttgcatagttatttccttattcttaagcaggcgaaacaaaatcaaacgttgagcatagtccttccccttacgggaaggtcaagccgcagacacaatttaatcgacaataatggtcgtcgcctcgctcgcagtgtgctaacgtttatcttctttaagcccctggtagaagcaatgaagacgtttttcagaacagtgttattcggcagcctgatggccgtttgcgcaaacagttacgcgctcagcgagtctgaagccgaagatatggccgatttaacggcagtttttgtttttctgaagaacgattgtggttaccagaacttacctaacgggcaaattcgtcgcgcgctggtctttttcgcccagcaaaaccagtgggatctcagtaattacgacaccttcgacatgaaagccctcggtgaagacagctaccgcgatctcagcggcattggcattcccgtcgctaaaaagtgcaaagccctggctcgcgattccttaagcctgcttgcctacgtcaaataa

SEQ ID NO: 474 - protein, 172 aa, Escherichia coli
MHSYFLILKQAKQNQTLSIVLPLTGRSSRRHNLIDNNGRRLARSVLTFIFFKPLVEAMKTFFRTVLFGSLMAVCANSYALSESEAEDMADLTAVFVFLKNDCGYQNLPNGQIRRALVFFAQQNQWDLSNYDTFDMKALGEDSYRDLSGIGIPVAKKCKALARDSLSLLAYVK

SEQ ID NO: 475 - DNA, 1551 bp, Escherichia coli
atgcaacgtcgtgatttcttgaaatattccgtcgcgctgggtgtggcttcagccttgccgctgtggagccgcgcagtatttgcggcggaacgcccaacgttaccaatccctgatttgctcacgaccgatgcccgtaatcgcattcagttaactattggcgcaggtcagtccacctttggcgggaaaaccgcaactacctggggctataacggcaatctgctggggccggcggtgaaattacagcgtggcaaagcggtaacggttgatatctacaaccaactgacggaagagacgacgttgcactggcacgggctggaagtaccgggtgaagtggacggcggcccgcagggaattattccgccaggtggcaagcgctcggtgacgttgaacgttgatcaacctgccgctacctgctggttccatccacatcaacatggcaagaccggacgtcaggtggcgatggggctggctggtttggtggtgattgaagatgacgagatcctgaaattaatgctgccaaaacagtggggtattgatgatgtcccggtgattgttcaggataaaaaatttaacgctgacgggcagattgattatcaactggatgtgatgaccgccgccgtgggctggtttggcgatacgctgctgaccaacggtgcaatctacccgcaacacgctgccccgcgcggctggctgcgcctgcgtttgctcaatggctgtaatgcccgttcgctcaatttcgccaccagcgacaatcgcccgctgtatgtgattgccagcgacggtggtctgctacctgaaccagtgaaggtgagcgagctaccggtgctgatgggtgagcgttttgaagtgctggtggaggttaacgacaacaaaccatttgacctggtgacgctgccggtcagtcagatggggatggcgattgcgccgtttgacaagccgcatccggtaatgcggattcagccgattgccattagtgcctctggtgctttgccagacacattaagtagcctgcctgcgttaccttcgctggaagggctgacggtacgcaagctgcaactttctatggacccaatgctcgatatgatggggatgcagatgctgatggagaaatatggcgatcaggcgatggccgggatggatcacagccagatgatgggccatatggggcacggcaatatgaatcatatgaaccacagcgggaagtttgatttccaccatgccaacaaaatcaacggtcaggcgtttgatatgaataagccgatgtttgcggcggcgaaagggcagtacgaacgttgggttatctctggcgtgggcgacatgatgctgcatccgttccatatccacggtacgcagttccgtatcttgtcagaaaatggcaaaccgccagcgacgcatcgtgcaggctggaaagataccgttaaggtagaaggtaatgtcagcgaagtgctggtgaagtttaatcacgatgcaccgaaagaacatgcttatatggcgcactgccatctgctggagcatgaagatacggggatgatgttagggtttacggtataa

SEQ ID NO: 476 - protein, 516 aa, Escherichia coli
MQRRDFLKYSVALGVASALPLWSRAVFAAERPTLPIPDLLTTDARNRIQLTIGAGQSTFGGKTATTWGYNGNLLGPAVKLQRGKAVTVDIYNQLTEETTLHWHGLEVPGEVDGGPQGIIPPGGKRSVTLNVDQPAATCWFHPHQHGKTGRQVAMGLAGLVVIEDDEILKLMLPKQWGIDDVPVIVQDKKFNADGQIDYQLDVMTAAVGWFGDTLLTNGAIYPQHAAPRGWLRLRLLNGCNARSLNFATSDNRPLYVIASDGGLLPEPVKVSELPVLMGERFEVLVEVNDNKPFDLVTLPVSQMGMAIAPFDKPHPVMRIQPIAISASGALPDTLSSLPALPSLEGLTVRKLQLSMDPMLDMMGMQMLMEKYGDQAMAGMDHSQMMGHMGHGNMNHMNHSGKFDFHHANKINGQAFDMNKPMFAAAKGQYERWVISGVGDMMLHPFHIHGTQFRILSENGKPPATHRAGWKDTVKVEGNVSEVLVKFNHDAPKEHAYMAHCHLLEHEDTGMMLGFTV

SEQ ID NO: 477 - DNA, 2409 bp, Escherichia coli
ttgaaatggtgtctctttatggcaattaacaataccggctcgcggcgattactcgtcacgctaacagccctttttgcagcgctttgcgggctgtatctactcattggcggaggctggctggtcgcgattggcggctcctggtactaccctatcgctggccttgtgatgctcggcgtcgcctggatgctgtggcgcagtaaacgcgccgcgctttggctgtacgcagccctgctgctcggcactatgatttggggcgtctgggaagttggtttcgacttctgggcgctgactccgcgcagcgacattctggtcttcttcggcatctggctgatcctgccgtttgtctggcgtcgcctggtcattcctgccagcggcgcagttgccgcactggtggtcgcactgctgattagcggtggtatcctgacctgggccggatttaacgatccgcaggaaatcagcggcaccttaagcgccgataccacgccagcagaagccatctcccccgttgccgatcaggactggcctgcctatggtcgcaatcaggaaggtcaacgcttttcaccactgaagcaaattaacactgataacgtccacaagctgaaagaagcctgggtgttccgtactggcgatgtgaagcagccgaacgatccgggcgaaatcaccaatgaagtgacgccaattaaagtgggcgacaccctttacctgtgtaccgcgcatcaacgtctgtttgcgctggatgccgccagcggtaaagagaaatggcattacgatcctgagctgaaaaccaacgagtccttccagcatgtaacctgccgtggcgtctcttatcatgaagccaaagcagaaactgcttcgccggaagtgatggcggattgcccgcgtcgtatcattcttccggtcaatgatggtcgtctgattgcgattaacgctgaaaacggcaagctgtgcgaaaccttcgccaataaaggcgtgctcaatctgcaaagcaatatgccggacaccaaaccgggtctgtatgagccgacttcgccgccgattatcaccgataaaaccatcgtgatggccggttcagtcaccgacaacttctcaacccgcgaaacgtctggcgtgatccgtggttttgatgtcaacaccggggagctgctgtgggcttttgatccgggcgcgaaagatccgaatgcgatcccgtctgacgaacacacctttacctttaactcaccaaactcgtgggcaccagcggcctatgacgcgaagctggatctggtctatctgccgatgggcgtgaccacgccagatatctggggcggtaatcgcacaccggaacaggaacgttatgccagctcgattctggcgctgaatgccactaccgggaaactggcgtggagctaccagaccgttcaccacgacctgtgggatatggatcttcctgcacagccgacgctggcggacatcaccgttaatggtcagaaagtgccggtcatttatgctccggcgaaaaccggcaacatttttgtgctcgatcgtcgcaatggtgaactggtggttccggccccggaaaaaccggttccccaaggtgctgccaaaggcgattacgtgacccctactcaacccttctcggaactgagcttccgtccgacgaaagatttgagcggtgcggatatgtggggtgccaccatgtttgaccagttggtgtgccgcgtgatgttccaccagatgcgctatgaaggcatttttacgccgccatctgaacagggtacgctggtcttcccgggtaacctggggatgttcgaatggggcgggatttccgttgatccgaatcgtgaagtggcgattgccaacccaatggcactgccgtttgtttcgaaactgatcccacgcggtcctggtaacccgatggaacagccgaaagatgccaaaggcacgggtacggaatccggcatccagccgcagtacggtgtaccgtatggcgtcacgctcaacccgttcctctcaccgtttggtctgccatgtaaacagccagcatggggctatatctcagcattggatctgaaaaccaatgaagtggtgtggaagaaacgtattggtacgccgcaggacagtatgccattcccaatgcctgtaccggtaccgttcaatatgggtatgccgatgctgggcgggccaatctccacggcgggtaacgtgctgtttatcgccgctacggcagataactacctgcgcgcttacaacatgagcaacggtgaaaaactgtggcagggtcgtttaccagcgggtggtcaggctacgccaatgacctatgaagtgaatggcaagcagtatgtggtgatctccgcaggcggtcacggttcatttggtacgaagatgggcgactatattgtggcttatgcgttgccggatgatgtgaagtaa

SEQ ID NO: 478 - protein, 802 aa, Escherichia coli
MKWCLFMAINNTGSRRLLVTLTALFAALCGLYLLIGGGWLVAIGGSWYYPIAGLVMLGVAWMLWRSKRAALWLYAALLLGTMIWGVWEVGFDFWALTPRSDILVFFGIWLILPFVWRRLVIPASGAVAALVVALLISGGILTWAGFNDPQEISGTLSADTTPAEAISPVADQDWPAYGRNQEGQRFSPLKQINTDNVHKLKEAWVFRTGDVKQPNDPGEITNEVTPIKVGDTLYLCTAHQRLFALDAASGKEKWHYDPELKTNESFQHVTCRGVSYHEAKAETASPEVMADCPRRIILPVNDGRLIAINAENGKLCETFANKGVLNLQSNMPDTKPGLYEPTSPPIITDKTIVMAGSVTDNFSTRETSGVIRGFDVNTGELLWAFDPGAKDPNAIPSDEHTFTFNSPNSWAPAAYDAKLDLVYLPMGVTTPDIWGGNRTPEQERYASSILALNATTGKLAWSYQTVHHDLWDMDLPAQPTLADITVNGQKVPVIYAPAKTGNIFVLDRRNGELVVPAPEKPVPQGAAKGDYVTPTQPFSELSFRPTKDLSGADMWGATMFDQLVCRVMFHQMRYEGIFTPPSEQGTLVFPGNLGMFEWGGISVDPNREVAIANPMALPFVSKLIPRGPGNPMEQPKDAKGTGTESGIQPQYGVPYGVTLNPFLSPFGLPCKQPAWGYISALDLKTNEVVWKKRIGTPQDSMPFPMPVPVPFNMGMPMLGGPISTAGNVLFIAATADNYLRAYNMSNGEKLWQGRLPAGGQATPMTYEVNGKQYVVISAGGHGSFGTKMGDYIVAYALPDDVK

SEQ ID NO: 479 - DNA, 576 bp, Escherichia coli
gtgcgaagtgatttgtttttaaatcatatggttatagatatgaaacatactgtagaagtaatgatccccgaagcggagattaaagcgcgtatcgccgaactgggtcgtcagattactgagcgttacaaagacagcggcagcgatatggtgctggtgggtctgctgcgtggctcatttatgtttatggcggacctgtgccgtgaagttcaggtatctcatgaagtcgactttatgaccgcctccagctacggtagcggcatgtccaccacccgtgatgtgaaaatcctcaaagacctggatgaagatatccgtggcaaggacgtgctgattgttgaagatatcatcgactcggggaatacactgtcgaaagtgcgtgagatcttaagcctgcgcgaaccgaagtcgttggcgatttgtacgctgctggataaaccgtcccgtcgtgaagtgaacgtcccggtagaatttatcggtttctcgatcccggatgagtttgtggtgggttacggcattgattacgcacagcgttaccgtcatctgccgtatatcggcaaagtgattctgctggacgagtaa

SEQ ID NO: 480 - protein, 191 aa, Escherichia coli
MRSDLFLNHMVIDMKHTVEVMIPEAEIKARIAELGRQITERYKDSGSDMVLVGLLRGSFMFMADLCREVQVSHEVDFMTASSYGSGMSTTRDVKILKDLDEDIRGKDVLIVEDIIDSGNTLSKVREILSLREPKSLAICTLLDKPSRREVNVPVEFIGFSIPDEFVVGYGIDYAQRYRHLPYIGKVILLDE

SEQ ID NO: 481 - DNA, 663 bp, Escherichia coli
atgaaagacatagatacactcatcagcaacaatgcactatggtcaaaaatgctggtggaagaggatcccgggttttttgagaaactggcacaagcgcaaaaaccgcgctttctatggattggatgttccgacagtcgcgttcctgcagaacgtttaaccggtcttgagccgggcgaactctttgttcaccgtaatgttgctaacctggtcattcacaccgacctgaactgcctttccgtggttcagtatgcagtggatgtactcgaagttgaacacattattatctgtggccactacggttgcggcggcgtacaagccgcagttgaaaacccagaactggggcttatcaacaactggctgctgcatatccgcgatatctggttcaaacatagctcattgctcggcgaaatgccgcaagagcgccgtctggataccttgtgtgaactgaacgtcatggaacaggtgtataacctgggccactccaccattatgcaatcagcgtggaaacgcgggcagaaagttaccattcacggctgggcctacggcattcacgacggcttgctgcgtgatctggatgtcacagcgactaaccgcgaaacccttgagcaacgttaccgtcacgggatctccaacctcaagctgaagcacatcaatcacaaataa

SEQ ID NO: 482 - protein, 220 aa, Escherichia coli
MKDIDTLISNNALWSKMLVEEDPGFFEKLAQAQKPRFLWIGCSDSRVPAERLTGLEPGELFVHRNVANLVIHTDLNCLSVVQYAVDVLEVEHIIICGHYGCGGVQAAVENPELGLINNWLLHIRDIWFKHSSLLGEMPQERRLDTLCELNVMEQVYNLGHSTIMQSAWKRGQKVTIHGWAYGIHDGLLRDLDVTATNRETLEQRYRHGISNLKLKHINHK

SEQ ID NO: 483 - DNA, 927 bp, Escherichia coli
atgaccattgcactggaacttcaacagcttaaaaaaacctatccaggcggcgttcaggcgcttcgtggaatcgatttgcaggtcgaagcgggtgatttttatgcgcttctcgggccgaacggggccggaaaatcgaccactatcggtattatcagctctctggtaaataaaacctccgggcgggtcagcgtatttggttacgatctcgagaaagatgtcgtaaacgctaaacgtcagttggggctggtgccacaggaatttaacttcaacccgtttgaaaccgtgcagcaaattgtggtgaatcaggcagggtactacggtgtggagcgcaaagaagcgtacattcgcagcgaaaagtatcttaaacaactcgatctatggggaaaacgcaacgaacgtgcgcgtatgttatctggcgggatgaagcgccgtttaatgattgcccgtgcgttaatgcatgaacctaaactactgattctcgacgaaccgaccgcaggcgtggatattgaacttcgccgctcaatgtggggctttttgaaggatttaaacgacaaaggcaccaccatcattctcaccacacattacctggaagaagcagaaatgctgtgccgcaatatcggcattattcaacacggtgagctggtggaaaatacttcgatgaaggcgctgctggcgaagctgaaatcagaaacctttattctcgatctcgcaccgaaaagtccgttaccgaagctcgatggctatcagtatcgactggtagataccgccacgctggaagttgaagtgctgcgtgagcagggcatcaacagcgtatttacgcagttaagtgagcagggcattcaggtattaagtatgcgtaacaaagctaaccgtctggaagagctgtttgtttcactggttaatgaaaaacaaggagatcgcacatga

SEQ ID NO: 484 - protein, 308 aa, Escherichia coli
MTIALELQQLKKTYPGGVQALRGIDLQVEAGDFYALLGPNGAGKSTTIGIISSLVNKTSGRVSVFGYDLEKDVVNAKRQLGLVPQEFNFNPFETVQQIVVNQAGYYGVERKEAYIRSEKYLKQLDLWGKRNERARMLSGGMKRRLMIARALMHEPKLLILDEPTAGVDIELRRSMWGFLKDLNDKGTTIILTTHYLEEAEMLCRNIGIIQHGELVENTSMKALLAKLKSETFILDLAPKSPLPKLDGYQYRLVDTATLEVEVLREQGINSVFTQLSEQGIQVLSMRNKANRLEELFVSLVNEKQGDRT

SEQ ID NO: 485 - DNA, 771 bp, Escherichia coli
atgatgcatctttactgggtggcgctaaaaagcatctgggcgaaagagatccatcgctttatgcgcatctgggtgcagacgctggtgccgccagtcatcaccatgaccctttactttattatcttcggtaacctgattggttcgcgtattggcgatatgcatggcttcagctacatgcagttcatcgtaccggggctgatcatgatgtcggtgatcaccaacgcctacgctaacgtcgcgtcatcattttttggtgccaagttccagcgtaatattgaagagctgctggtagcgccggttccgactcatgtcattattgccggatatgtcggtggtggcgtggcgcgtggtctgtttgttggtattttggtgacggcaatttcactgttttttgtgccgtttcaggtgcattcgtgggtattcgttgccttaaccctggtgctcactgcggtgctattctcccttgcgggtttgctgaacggcgtgtttgccaaaacgttcgatgacatcagcctggtgccaacctttgtgttaacgccactcacgtatttgggcggggtgttttactccctgactttgttgccgccgttctggcaagggctgtcgcacctgaacccaatcgtttatatgatcagtggtttccgctacggcttcctcggtatcaatgatgttccgctggtcactaccttcggtgtactggtggtctttattgtggcgttttatttgatctgttggtcgctgatccaacgtggacgtggtttgcgtagctaa

SEQ ID NO: 486 - protein, 256 aa, Escherichia coli
MMHLYWVALKSIWAKEIHRFMRIWVQTLVPPVITMTLYFIIFGNLIGSRIGDMHGFSYMQFIVPGLIMMSVITNAYANVASSFFGAKFQRNIEELLVAPVPTHVIIAGYVGGGVARGLFVGILVTAISLFFVPFQVHSWVFVALTLVLTAVLFSLAGLLNGVFAKTFDDISLVPTFVLTPLTYLGGVFYSLTLLPPFWQGLSHLNPIVYMISGFRYGFLGINDVPLVTTFGVLVVFIVAFYLICWSLIQRGRGLRS

SEQ ID NO: 487 - DNA, 441 bp, Escherichia coli
atgttaggttgggtaattacctgtcacgatgaccgggcgcaagagatactggatgcgctggagaaaaaacatggggcacttcttcagtgccgggccgtgaatttctggcgcggattaagctctaatatgctcagccgcatgatgtgcgatgccttgcatgaaacggactctggtgagggcgttatctttttaaccgatatagccggagcgccaccgtaccgcgtggcttcattattaagccacaaacactcccgttgcgaagtgatttctggtgtcacgttaccgttaattgaacagatgatggcttgccgtgaaaccatgaccagttcagcgtttcgcgagcatattgtcgaactgggtgcgccggaggtgagtagtctttggcaccaacaacaaaaaaatccgcctttcgtcctcaaacataatttgtatgagtattaa

SEQ ID NO: 488 - protein, 146 aa, Escherichia coli
MLGWVITCHDDRAQEILDALEKKHGALLQCRAVNFWRGLSSNMLSRMMCDALHETDSGEGVIFLTDIAGAPPYRVASLLSHKHSRCEVISGVTLPLIEQMMACRETMTSSAFREHIVELGAPEVSSLWHQQQKNPPFVLKHNLYEY

SEQ ID NO: 489 - DNA, 1230 bp, Escherichia coli
atgtacaaacaagctgttattctcctgctgatgctgtttaccgcaagtgtcagtgccgcgttacctgcccgttatatgcaaaccatcgaaaatgccgcggtctgggcgcaaattggcgacaaaatggtgacggtagggaatattcgggccggacaaatcattgccgtggagcccactgccgcaagttattacgtatttaattttggctttggtaaagggtttatcgataaaggccatctcgagccggttcaggggcgacaaaaagttgaagatggtttgggtgacctcaacaagccgctgagtaatcagaacttaataaccaggaaagatacgccggtttataacgcaccgagtgtgggcagtgcgccatttggagtactggcggacaatttgcgctacccgattttgcataaactgaaagacaggttaaatcaaacctggtatcagatccgtattggcgatcgactggcctatatcagcgcgctggatgcccaacccgataatggcttgccggtgctaacctatcaccatattttgcgcgacgaagaaaacacccgttttcgccatacttcgacgaccacctcggtacgcgctttcaataaccagatggcctggctgcgcgacaggggatacgcgacactgagcatggcgcagctggaaggttacgtgaagaataagatcaatctccctgcgcgagcggtggtaattacctttgatgatggcctcaagtcggtgagccgctatgcgtatcctgtgttgaaacaatatggtatgaaggcgacggcgtttattgttacctcgcgcatcaaacgtcacccgcagaaatggaacccaaaatcgctgcaatttatgagcgtttctgaacttaacgaaattcgcgatgtatttgatttccagtcacatactcattttttgcatcggatagatggttatcggcggcctatattgctgagccgtagtgagcacaatattctgtttgattttgcacgttcacgccgcgctctggcgcaatttaatccacatgttttgtatctttcttatccatttggcggatttaatgacaaagccgtgaaggcagcaaaagaagccggatttcacctggcggtgacgaccatgaaaggcaaagtaaaaccgggggataatccgttgttactaaaacgactttatatcttaagaacggattcgctggagacgatgtcgcggctggtgagtaaccagccgcagggataa

SEQ ID NO: 490 - protein, 409 aa, Escherichia coli
MYKQAVILLLMLFTASVSAALPARYMQTIENAAVWAQIGDKMVTVGNIRAGQIIAVEPTAASYYVFNFGFGKGFIDKGHLEPVQGRQKVEDGLGDLNKPLSNQNLITRKDTPVYNAPSVGSAPFGVLADNLRYPILHKLKDRLNQTWYQIRIGDRLAYISALDAQPDNGLPVLTYHHILRDEENTRFRHTSTTTSVRAFNNQMAWLRDRGYATLSMAQLEGYVKNKINLPARAVVITFDDGLKSVSRYAYPVLKQYGMKATAFIVTSRIKRHPQKWNPKSLQFMSVSELNEIRDVFDFQSHTHFLHRIDGYRRPILLSRSEHNILFDFARSRRALAQFNPHVLYLSYPFGGFNDKAVKAAKEAGFHLAVTTMKGKVKPGDNPLLLKRLYILRTDSLETMSRLVSNQPQG

SEQ ID NO: 491 - DNA, 381 bp, Escherichia coli
atgattcgcacgatgctgcagggcaaactccaccgcgtgaaagtgactcatgcggacctgcactatgaaggttcttgcgccattgatcaggattttcttgacgcagccggtattctcgaaaacgaagccattgatatctggaatgtcaccaacggcaagcgtttctccacctatgccatcgcggcagaacgcggttcgagaattatttctgttaacggtgcggcggcccactgcgccagcgtcggcgatattgtcatcatcgccagcttcgttaccatgccagatgaagaagctcgcacctggcgacccaacgtcgcctattttgaaggcgacaacgaaatgaaacgtaccgcgaaagcgattccggtacaggttgcctga

SEQ ID NO: 492 - protein, 126 aa, Escherichia coli
MIRTMLQGKLHRVKVTHADLHYEGSCAIDQDFLDAAGILENEAIDIWNVTNGKRFSTYAIAAERGSRIISVNGAAAHCASVGDIVIIASFVTMPDEEARTWRPNVAYFEGDNEMKRTAKAIPVQVA

SEQ ID NO: 493 - DNA, 885 bp, Escherichia coli
atggatgcaccgagtaccacaccgcatgatgcggtgtttaaacaatttttaatgcatgcggaaacggctcgcgactttctggatatccatttgccagcggagctacgcgaactgtgtgacctcgacacgctgcatcttgagtcggggagttttattgaagaaagcctgaaagggcacagcactgacgtgctctattccgtacagatgcagggtagtacgggttatctgcatgttgtgattgaacaccaaagcaagccagataagaaaatggcctttcgcatgatgcgttattctattgctgccatgcaccggcatctggaggctgatcacgataagctgccgctggtggtgccaattctgttttatcagggcgaggccacaccttatccgctatcaatgtgctggtttgatatgttttactcaccggaactggcgcgacgcgtctataacagtcctttcccgctggtggatatcactatcacaccggatgacgaaatcatgcaacatcggcggattgcgattctcgaactgctgcaaaaacatattcgccagcgcgacttaatgttattgctggagcaactggtcacgctgattgacgaagggtacactagcggaagtcagttagttgccatgcaaaactatatgctgcaacgcggtcatactgaacaagcggatttgttttatggtgtggtgagagacagggaaacgggaggggagtctatgatgacgctggcgcagtggtttgaagagaaggggattcagcagggaagacaggaagtaagtcaggaattcgccctgcgtcttctgagtaaaggaatgtctcgggaagacgttgcagagatggcaaatttacctcttgctgagattgataaaatgattaactaa

SEQ ID NO: 494 - protein, 294 aa, Escherichia coli
MDAPSTTPHDAVFKQFLMHAETARDFLDIHLPAELRELCDLDTLHLESGSFIEESLKGHSTDVLYSVQMQGSTGYLHVVIEHQSKPDKKMAFRMMRYSIAAMHRHLEADHDKLPLVVPILFYQGEATPYPLSMCWFDMFYSPELARRVYNSPFPLVDITITPDDEIMQHRRIAILELLQKHIRQRDLMLLLEQLVTLIDEGYTSGSQLVAMQNYMLQRGHTEQADLFYGVVRDRETGGESMMTLAQWFEEKGIQQGRQEVSQEFALRLLSKGMSREDVAEMANLPLAEIDKMIN

SEQ ID NO: 495 - DNA, 852 bp, Escherichia coli
gtgttaattatcgaaaccctgccgctgctgcgtcagcaaatccgccgcctgcgtatggaaggtaagcgcgtggcgctggtgcccaccatgggtaacctgcacgacggccatatgaagctggtcgacgaagccaaagcccgcgccgatgtggtcgtcgtcagtattttcgttaacccaatgcagtttgaccgcccggaagatctggcacgttatccacggaccttgcaagaggactgcgaaaagctgaacaaacgtaaagtggatttagttttcgcgccttcggtaaaagagatctacccgaacggtactgaaacccacacctatgttgatgttcccggtctttccaccatgctggaaggtgccagccgtccgggacattttcgcggcgtgtcgactatcgtcagcaagctgttcaacctggtccagccagatatcgcttgcttcggtgaaaaagattttcagcaactggcgctgatccgcaaaatggttgctgatatgggcttcgatattgagattgtcggcgtaccgattatgcgtgcgaaagacggtctggcgctgagttcccgtaacggttatctgacggcggaacaacgcaaaattgcgcccggtctgtacaaggttttaagttcaattgccgacaaattgcaggctggcgaacgggatctcgatgaaattattgctattgccgggcaagaactgaatgaaaaaggtttccgttccgatgatattcagattcgtgatgccgacacattgctggaagtctctgaaaacagcaaacgcgcagtgattctggtagccgcctggcttggcgatgctcgcctgatcgacaacaaactggtcgaactggcgtaa

SEQ ID NO: 496 - protein, 283 aa, Escherichia coli
MLIIETLPLLRQQIRRLRMEGKRVALVPTMGNLHDGHMKLVDEAKARADVVVVSIFVNPMQFDRPEDLARYPRTLQEDCEKLNKRKVDLVFAPSVKEIYPNGTETHTYVDVPGLSTMLEGASRPGHFRGVSTIVSKLFNLVQPDIACFGEKDFQQLALIRKMVADMGFDIEIVGVPIMRAKDGLALSSRNGYLTAEQRKIAPGLYKVLSSIADKLQAGERDLDEIIAIAGQELNEKGFRSDDIQIRDADTLLEVSENSKRAVILVAAWLGDARLIDNKLVELA

SEQ ID NO: 497 - DNA, 795 bp, Escherichia coli
atgaaaccaaccacgattgcttcattgcagaaatgcaagcaggacaaaaaacgtttcgcaaccatcaccgcttacgactacagcttcgcaaaactgtttgccgaagaaggacttaacgtcatgctggtcggcgattcactgggcatgacggttcaggggcatgactccacgctaccggttaccgttgccgatatcgcctatcacaccgccgctgtgcgtcgcggcgcgccaaactgccttctgctggctgacctgccatttatggcgtatgccacgccggaacaagcctttgaaaacgccgcgactgtcatgcgtgctggggccaacatggtcaaaattgaaggcggcgagtggctggtagaaaccgtacaaatgctgaccgaacgtgccgttccagtttgtggtcatttaggcctaaccccacagtcagtgaatattttcggtggctacaaagtccaggggcgcggcgatgaagcgggcgatcgactgctcagcgatgcattagccttagaagctgctggggcacaactgctggtactggagtgcgtgccggttgaactggcaaaacgcattaccgaagcactggcgatcccggttatcggtattggcgcaggcaacgttaccgatggacagatcctcgtgatgcacgatgcgttcggcattactggcggtcatatccctaaatttgccaaaaatttcctcgccgaaacgggcgacatccgcgcggctgtgcggcagtatatggctgaagtggagtccggcgtttacccgggcgaagaacacagtttccattaa

SEQ ID NO: 498 - protein, 264 aa, Escherichia coli
MKPTTIASLQKCKQDKKRFATITAYDYSFAKLFAEEGLNVMLVGDSLGMTVQGHDSTLPVTVADIAYHTAAVRRGAPNCLLLADLPFMAYATPEQAFENAATVMRAGANMVKIEGGEWLVETVQMLTERAVPVCGHLGLTPQSVNIFGGYKVQGRGDEAGDRLLSDALALEAAGAQLLVLECVPVELAKRITEALAIPVIGIGAGNVTDGQILVMHDAFGITGGHIPKFAKNFLAETGDIRAAVRQYMAEVESGVYPGEEHSFH

SEQ ID NO: 499 - DNA, 1266 bp, Escherichia coli
atgaagatattcttcagatactttctttttttagcactgtgctcttgttgttatatagcaagtgccggtaccgatgatcacgtcggctatgttgttgggaataattacggtgttggtccatcaggccaaaaatggcgagagacaggtcctaatggagatgttaccgtcaaattccggtatggctcagtcaccaataatttagttttttataaaccaacccaacttggcccaaccggggtgtcattaaaatgggcgcagttagattccgcttcaggtggaggtttcctttactgtaacaggagtggtagcacaagcggcgggccaatgcatattgaaaataaaatggttgattccggtaaaagttatggcggacataaactctttaagacatctgttccaggcctgtattacacgttagcaatatcaaacatttggtcaacatatacatatactgatatcaacccatcaggcatgtatattggcgattctacgagccaatcttttaactggcgtggcgaaagcgagcaaacactatattggtcttgcaacaatgcgaatacaaaaaataaatattgggccgttggcggcgttatgcaaacgctcacgattgaattttataccgataccgactttaacccgacaacgaatcaacgggtaacattatccagaacagataattacctctactcattcaaagcatatggtgctggcattggtatcaatgactacagctattttcttaaaatagactttgacctgacagatatcgtattaacaaaccctacctgttttactgcggcgcttagtggctcatcggtaagtggttcaacggttaaaatgggtgattataccccagcgcaaataaaaaatggcgcaacagcggttccttttgatatcacgctacagaactgtattcgtgttcgcaatatagaaacaaaactcaagtcaaacaaggtgggtagtgtaagcaaagaacttctggctaacacactcacaggaaatgacgcagcaaaaggcgttggtgtactgattgaaggtttaaaaaacactaaaagtgcacaaatggtactgaaaccaaatgatgcaacgtctatttataaagattatgaaacagaagatgacactaccggaggaatttacccggataaaggaaacggtacctcacaacctcttcatttccaggctacattaaaacaagacggtaatattgctatagaaccgggggattttaaagccaccagcacttttcaggttacctacccctga

SEQ ID NO: 500 - protein, 421 aa, Escherichia coli
MKIFFRYFLFLALCSCCYIASAGTDDHVGYVVGNNYGVGPSGQKWRETGPNGDVTVKFRYGSVTNNLVFYKPTQLGPTGVSLKWAQLDSASGGGFLYCNRSGSTSGGPMHIENKMVDSGKSYGGHKLFKTSVPGLYYTLAISNIWSTYTYTDINPSGMYIGDSTSQSFNWRGESEQTLYWSCNNANTKNKYWAVGGVMQTLTIEFYTDTDFNPTTNQRVTLSRTDNYLYSFKAYGAGIGINDYSYFLKIDFDLTDIVLTNPTCFTAALSGSSVSGSTVKMGDYTPAQIKNGATAVPFDITLQNCIRVRNIETKLKSNKVGSVSKELLANTLTGNDAAKGVGVLIEGLKNTKSAQMVLKPNDATSIYKDYETEDDTTGGIYPDKGNGTSQPLHFQATLKQDGNIAIEPGDFKATSTFQVTYP

SEQ ID NO: 501 - DNA, 597 bp, Escherichia coli
atgcgtcccactcaacgtaatctgatgaaaaaatcaattctgcttctgtcgttgctattcagcgccacttcccctgtggttgcaggacaggatgttgacattgttgcaaatataaaaaataacacctgccaaagtggaatcagcaacaacggaaatattgatttaggtgtcgttggcgtgggcgattttaccggaaacatttcagccgaaaattatcaccccggtggaaaagagttcactattacagtacaggactgcacacttcagggcacagggaatgtgttaaatcagttacatattaattttcgcgcactcagtggcgtaatggcgacaggttccagtcaaatattcgctaatgaagacaacgccggggctaaaaatgttggggtagttatattttctattcaggacccggcaaataccttcaacgttcttagtgccactggtagctcacgttccgtttatccggtcatgtcatcagcactaaataattcatcctggaaatttagcacccgaatgcaaaaaatcgatccagcgctgaatgtcacctctggcccactgataagccatgtgttagtggatatttactacgaataa

SEQ ID NO: 502 - protein, 198 aa, Escherichia coli
MRPTQRNLMKKSILLLSLLFSATSPVVAGQDVDIVANIKNNTCQSGISNNGNIDLGVVGVGDFTGNISAENYHPGGKEFTITVQDCTLQGTGNVLNQLHINFRALSGVMATGSSQIFANEDNAGAKNVGVVIFSIQDPANTFNVLSATGSSRSVYPVMSSALNNSSWKFSTRMQKIDPALNVTSGPLISHVLVDIYYE

SEQ ID NO: 503 - DNA, 483 bp, Escherichia coli
atgggtacctgtacatcaacgttgactgatgacggtacaactaaaatttccaccatcaatttcggtgatgtatatatttctgaaattaatgccgaaactaaaattaaaaccttcaaattacagttcaaagactgtgcggggattcccgggaaaaaggccaaaataaaattgactacacgagcattatgtgaaggtaattctaataatggtcctggatttgctaacgcatcaacggcaacagcaaaagcagcggcggtcgccgttgaggtctggagcacatccacaccaggtaagaacggcgctaaacaattcagttgtgtcacccccgcaacagaagaagtcagtattgctaatgcgacgggcagcaatgttgtcgattacccaatgagtgcggtgttggtggtcgcaaaagataaaactgtcacaaatgtcactgcgggtgatttcactgccccggcaacattcaccgtgacttataactaa

SEQ ID NO: 504 - protein, 160 aa, Escherichia coli
MGTCTSTLTDDGTTKISTINFGDVYISEINAETKIKTFKLQFKDCAGIPGKKAKIKLTTRALCEGNSNNGPGFANASTATAKAAAVAVEVWSTSTPGKNGAKQFSCVTPATEEVSIANATGSNVVDYPMSAVLVVAKDKTVTNVTAGDFTAPATFTVTYN

SEQ ID NO: 505 - DNA, 105 bp, Escherichia coli
gtgttccaggcaagtttcgcgcactggcaacttttaacttcagctatcaataacaaggatgacaatgatgatattaaaaaaattatgttatggattatcgggtag

SEQ ID NO: 506 - protein, 34 aa, Escherichia coli
MFQASFAHWQLLTSAINNKDDNDDIKKIMLWIIG

SEQ ID NO: 507 - DNA, 2589 bp, Escherichia coli
gtgactattaaatctactaatcaccttacccacatcgccacgttttgcgctctgctgtatagcaatagtgctttatgcgctgaactcgtcgaatatgaccatacatttctgatgggaaaggatgcttcaaatatcgaccttagtcggtatacagaaggcaatcccacactacctggcatttacgatgtcagtgtgtatgttaacgatcaacccatcatgagccaaagcattgcttttgctgttattgaaggtaaaaagaacgctcaggcctgcattacgcagaaaaatttattgcaatttcatatcagttcaccagacaagaatagcgaaaaagccattttgcttaagcgagacgacgatcttggtgattgcctcaatctggctgaaatgatccctcaatcatccattcgttacgatgttaacgatcaacgcctggatatcgatgtcccccaggcatggattatgaagaattatcaaaactatgttgatccctctttgtgggaaaatggcattaatgcagccatgctttcctacaacctcaatggatatcacagtgaaagtccaggcagaacaaatgacagtatctacgcggcattcaacggtgggataaacttaggcgcgtggcggttacgtgcctcaggtaactacaactggatgaccaatgtccatagcgattacgattttcagaatcgctatttacaacgcgatcttgcgtcactacgttcacaactggttattggtgaatcttacacgaccggcgagaccttcgattcagtcagaattcgcggtattcgcttatacagtgacagtcgaatgctgcctccggtattagccagttttgcgccaatcattcatggcgtagcgaataccaatgccaaagtaaccgttatgcaaaatggttataagatctatgaaacgacggtgccgccaggggcttttgccattgacgatcttagcccgtcaggttatggcagcgatctcattgtgactatcgaagaagctgatggcacaaaacggacgttctcccagccattttcatctgttgtgcaaatgctgcgccctggcgttggtcgctgggatattagcgccggtcaggttttaaaagacagtatccaggatgagcctaatttatttcaagccagctactactatggtttgaataactacctgacaggatataccggtattcagctaaccgataataactataccgccggattgctggggcttggtatgaatacccccgtgggggctttttctgtcgatgttactcactcaaatgtcagcattccggacgataaaacctatcaaggacaaagctaccgtatttcctggaacaagttatttgaaaataccagtacatcattaaatatcgcggcctatcgctactccacccagcattatctgggcctcaatgatgcgctgacgctgattgatgaagtagaacatcctgagcaagatcttgagcctaaatccatgcgcaattactcgcgcatgaaaaatcaggtcacggtcagtatcaaccaaccgctgaaatttgagaaaaaggattacggttcattttatctctctggaagctggtcagattactgggcctccgggcaaaacagtactaattactctattggttatagcaatagtgcgtcctggggcagttacagtatcagtgctcaacgttcgttgaatgaagatggtcaaaccgacgatagcatttatctcagcttcacaattccaatagaaaatttactgggtacggaacaccgcagctccggcttccagagtattgatacacaattaaacagcgactttaagggtaataaccaactcaatatcagcagtagtggttacagcgataccaatcgcatcagctacagcgtaaacacgggttatatgatgaataaatccagtgatgatttgagttatatcggcggttatgccagttatgaatcgccgtggggaacgctgtcaggttcagcctcagcaagcagtgataatagtcgccaattctcactcaatactgatggtggatttgtgttacatagcggcgggctgacgttcagtaatgacagttttagtgattccgacactctggctgtcattcaggcgccaggagcaaaaggcgctcgtattaactacggaaacagcaccgtagaccgctggggttatggtgtgaccagcgccctttcgccataccatgaaaatcgtatcgcactggacattaacgatctggaaaacgatgttgaattgaaaagcaccagtactgtcgccgtcccgcgccagggagccgtcgtctttgctgattttgaaacagttcagggacaatcggcaattatgaacatcgtgcgaagcgatggtaaaaatattccatttgcagcggatatttatgatgaacaaaacaatatcatcggcaacgtaggtcagggtggtcaggcctttgttcgcggtatcgggcaggaaggaaatatacgaattacctggattgaagagggcaaaccggtcagttgttttgctcattatcaacaaaacacgacatcagaaaaaatagcacaatctattattctgaacggacttcgttgtcagatacagtaa

SEQ ID NO: 508 - protein, 862 aa, Escherichia coli
MTIKSTNHLTHIATFCALLYSNSALCAELVEYDHTFLMGKDASNIDLSRYTEGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVRIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIILNGLRCQIQ

SEQ ID NO: 509 - DNA, 741 bp, Escherichia coli
atgttttttaatactaaacataccgcagcattgtgcttagcgagctgtatggcttttagctcatcagctattgcagacatcgtaatttcaggtacacgcgtagtttataaaagcgaacaaaaaagcgtcaatgtacgtctggaaaataaaggcaataacccattgctggttcagagttggttagatactggagatgataacgctgaaccaggcagtattactgtcccctttaccgctacgccaccagtatcacgtattgatgctaaacgtggccaaacaatcaaactgatgtacaccgccagtagtgctctgccaaaagacagagaaagtgtgttctggtttaacgtactggaagttccaccaaaacccgatgcagcaaaagcagcaaatcaaagcctgctacaactggcatttcgcacacgtataaaactgttctatcgcccggaaggattgagtggaatttcatctgatgcaccattggctctgaagtggtcctgggcaacatctgaaggcaaagcagcattacgcgttgataaccctacgccctactatgtctcttttagcagtggtgatttagaagccaacggcaaacgctatcccctggatatgacaatgattgcgccgttcagtaacgacgtcatcaaggtaaatgggatgagtggcagaacaagctctgcaaaagtgcattttttcgccattaatgattttggtggatctattgaaggcaacgccaacctttaa

SEQ ID NO: 510 - protein, 246 aa, Escherichia coli
MFFNTKHTAALCLASCMAFSSSAIADIVISGTRVVYKSEQKSVNVRLENKGNNPLLVQSWLDTGDDNAEPGSITVPFTATPPVSRIDAKRGQTIKLMYTASSALPKDRESVFWFNVLEVPPKPDAAKAANQSLLQLAFRTRIKLFYRPEGLSGISSDAPLALKWSWATSEGKAALRVDNPTPYYVSFSSGDLEANGKRYPLDMTMIAPFSNDVIKVNGMSGRTSSAKVHFFAINDFGGSIEGNANL

SEQ ID NO: 511 - DNA, 615 bp, Escherichia coli
atggaatattactcaaggatttttatgtctaaaaaattaggttttgcgctgtccggtattatgttggcaatggctgctggtactgcatttgctgctaacgatatggacggcggtcaattaaatattagcggtctggtcgttgataacacttgtgaagctcgtgttgatggcggtaacaaagacggtctgatcctgctgcaaaccgctactgttgctgaaattactgatggtgtactggataccactgtaggtgctaaagctaaaccattcagcattactattgactgcagcaaagctaacccggctccgggtactactgcaaaaatgaccttcggttctgttttctttggtaacagcaaaggaacactgaacaacgacatgtctattaacaccccgtctgacggcgtaaatatcgctctgcacaatattgaaggttctactattaaacaggttcaggtcaataatccgggtgatgtttacagcaaaactctggattcaacgtctaaatctgcaacctacgattttaaagcatcctatgttcgtgcggatgcaagcaaagcagctactgccggttatgtaaaaaccaactcagcatataccattacttaccagtaa

SEQ ID NO: 512 - protein, 204 aa, Escherichia coli
MEYYSRIFMSKKLGFALSGIMLAMAAGTAFAANDMDGGQLNISGLVVDNTCEARVDGGNKDGLILLQTATVAEITDGVLDTTVGAKAKPFSITIDCSKANPAPGTTAKMTFGSVFFGNSKGTLNNDMSINTPSDGVNIALHNIEGSTIKQVQVNNPGDVYSKTLDSTSKSATYDFKASYVRADASKAATAGYVKTNSAYTITYQ

SEQ ID NO: 513 - DNA, 480 bp, Escherichia coli
atgacagtggcgtatattgccataggcagcaatctggcctctccgctggagcaggtcaatgctgccctgaaagcattaggcgatattccagaaagccgcattcttgctgtttcttcgttttaccgcaccccaccgctggggccgcaagatcaacccgattacttaaatgccgccgtcgcgctgaaaaccactcttgcccctgaagggctactcaatcacacacagcgtatcgaattgcagcaaggtcgcgtccgtaaagctgaacgctggggaccgcgcacgctggatctcgacatcatgctgtttggtaatgaagtaataaataccgaacgtctgaccgttccgcactacgatatgaaaaatcgcggctttatgctgtggccactgtttgaaattgcgccggaattggtatttcctgatggcttatcattagttgaagctctacaggcaaaaggctttaatgaattagataagtggtaa

SEQ ID NO: 514 - protein, 159 aa, Escherichia coli
MTVAYIAIGSNLASPLEQVNAALKALGDIPESRILAVSSFYRTPPLGPQDQPDYLNAAVALKTTLAPEGLLNHTQRIELQQGRVRKAERWGPRTLDLDIMLFGNEVINTERLTVPHYDMKNRGFMLWPLFEIAPELVFPDGLSLVEALQAKGFNELDKW

SEQ ID NO: 515 - DNA, 729 bp, Escherichia coli
  n 9, 10, 11, 12, 13: n is any nucleotide
atggaatgnnnnncagaaccgatccctcgcctcgctaccctgctgaacgatatcccaccggcacgcctgtttgaagaatcgcttaaactgctacaagcgggctacggttacgaaacctataagctgctgtgtgaatatcatctgttccagccgctgttcccgaccattacccgctacttcacggaaaatggcgacagcccgatggaacgcattattgagcaggtactgaagaataccgatacgcgtatccataacgatatgcgcgtgaacccggcgttcctgtttgccgccatgttctggtacccattgctggagacggcacagaagatcgcccaggaaagcggcctgacctatcacgacgctttcgcactggcgatgaacgacgtgctggacgaagcctgccgttcactggcgatcccgaaacggctgaccacgctaacccgcgatatctggcagttgcagttgcgtatgtcccgtcgtcagggtaaacgcgcatggaaactgctggagcatcctaagttccgtgcggcatacgacctgttggccttacgagccgaagttgagcgtaacgctgaactgcaacgtctggtgaaatggtggggtgagttccaggtttccgcgccaccagaccaaaaagggatgcttaacgaactggatgaagaaccgtcaccgcgtcgtcgtactcgtcgtccacgcaaacgcgcaccgcgtcgtgagggtaccgcatga

SEQ ID NO: 516 - protein, 242 aa, Escherichia coli
  Xaa 3, 4, 5: Xaa is any amino acid
MEXXXEPIPRLATLLNDIPPARLFEESLKLLQAGYGYETYKLLCEYHLFQPLFPTITRYFTENGDSPMERIIEQVLKNTDTRIHNDMRVNPAFLFAAMFWYPLLETAQKIAQESGLTYHDAFALAMNDVLDEACRSLAIPKRLTTLTRDIWQLQLRMSRRQGKRAWKLLEHPKFRAAYDLLALRAEVERNAELQRLVKWWGEFQVSAPPDQKGMLNELDEEPSPRRRTRRPRKRAPRREGTA

SEQ ID NO: 517 - DNA, 657 bp, Escherichia coli
  n 635, 636, 637, 638, 639: n is any nucleotide
ttgacactaccgaggtgtactatttttacccgagtcgctaatttttgccgcaaggtgctaagccgcgaggaaagcgaggctgaacaggcagtcgcccgtccacaggtgacggtgatcccgcgtgagcagcatgctatttcccgcaaagatatcagtgaaaatgccctgaaggtaatgtacaggctcaataaagcgggatacgaagcctggctggttggcggcggcgtgcgcgacctgttacttggcaaaaagccgaaagattttgacgtgaccaccaacgccacgccagagcaggtgcgcaaactgttccgtaattgccgcctggtgggtcgccgtttccgtctggctcatgtgatgtttggcccggagattatcgaagttgcgaccttccgtggacatcacgaaggtaacgtcagcgaccgcacgacctcccaacgcgggcaaaacggtatgttgctgcgcgacaacattttcggctccatcgaagaagacgcccagcgccgcgatttcactatcaacagcctgtattacagcgtggcagattttaccgtccgtgattacgttggcggcatgaaggatctgaaagacggcgttatccgtctgattggtaacccggaaacgcgctaccgtgaagnnnnncattcattcattaattaa

SEQ ID NO: 518 - protein, 218 aa, Escherichia coli
  Xaa 212, 213: Xaa is any amino acid
MTLPRCTIFTRVANFCRKVLSREESEAEQAVARPQVTVIPREQHAISRKDISENALKVMYRLNKAGYEAWLVGGGVRDLLLGKKPKDFDVTTNATPEQVRKLFRNCRLVGRRFRLAHVMFGPEIIEVATFRGHHEGNVSDRTTSQRGQNGMLLRDNIFGSIEEDAQRRDFTINSLYYSVADFTVRDYVGGMKDLKDGVIRLIGNPETRYREXXHSFIN

SEQ ID NO: 519 - DNA, 927 bp, Escherichia coli
atgctcccgccttattttttgttcaaagagatgacagacacacactatattggccgcttcgccccctctccttccggcgagcttcattttggttctctgattgctgcgcttggcagctatttgcaggctcgcgcccggcaaggtcgctggctggtacgcattgaagatatcgacccgcctcgtgaagttcccggtgccgcagaaactatcctgcgccagctggaacattacggcctgcactgggacggcgacgttctctggcaatcgcaacgtcaccacgcctatcgcgaagcactcgcctggttacatgagcaaggactaagttattactgcacctgcacgcgtgcgcgtattcaaagcattggcggtatttacgacggtcattgccgggatttgcatcatggaccagacaacgccgcagtacgtatccgccagcagcatccggtcacccagtttactgatctgctgcgaggcattattcacgccgacgaaaaactggcacgggaagattttattattcatcgccgtgatggtttgtttgcctataacctggcggtggtggtggatgatcacttccagggcgtgagcgaaattgtccgcggggcagatttgatcgaaccgacggtgcggcaaatctcgctgtaccagctttttggctggaaagtgccagattacatccatttaccgctggcgcttaatccacaaggcgctaaactttccaagcagaatcatgcgcctgcgttgccgaaaggcgatccgcgcccggtgttaatcgcggcacttcattttctgggtcagcaggtagaaacacactggcaggatttcagcgtcgagcaaatccttcagtcagccgtcaaaaactggacgctgaccgccgtgcctgagtcggcaattgtaaattcaacattctcaaatgcgtcatgctga

SEQ ID NO: 520 - protein, 308 aa, Escherichia coli
MLPPYFLFKEMTDTHYIGRFAPSPSGELHFGSLIAALGSYLQARARQGRWLVRIEDIDPPREVPGAAETILRQLEHYGLHWDGDVLWQSQRHHAYREALAWLHEQGLSYYCTCTRARIQSIGGIYDGHCRDLHHGPDNAAVRIRQQHPVTQFTDLLRGIIHADEKLAREDFIIHRRDGLFAYNLAVVVDDHFQGVSEIVRGADLIEPTVRQISLYQLFGWKVPDYIHLPLALNPQGAKLSKQNHAPALPKGDPRPVLIAALHFLGQQVETHWQDFSVEQILQSAVKNWTLTAVPESAIVNSTFSNASC

SEQ ID NO: 521 - DNA, 456 bp, Escherichia coli
atgcaagaagggcaaaaccgtaaaacatcgtccctgagtattctcgccatcgctggggtggaaccatatcaggagaagccgggcgaagagtatatgaatgaagcccagctggcgcacttccgtcgtattctggaagcatggcgtaatcaactcagggatgaagtcgatcgcaccgttacacatatgcaggatgaagcagccaacttcccggacccggtagaccgtgcagcccaggaagaagagttcagcctcgaactgcgtaaccgcgatcgcgagcgtaagctgatcaaaaagatcgagaagacgctgaaaaaagtggaagacgaagatttcggctactgcgaatcctgcggtgttgaaattggtattcgccgtctggaagcgcgcccgacagccgatctgtgcatcgactgcaaaacgctggctgaaattcgcgaaaaacagatggctggctaa

SEQ ID NO: 522 - protein, 151 aa, Escherichia coli
MQEGQNRKTSSLSILAIAGVEPYQEKPGEEYMNEAQLAHFRRILEAWRNQLRDEVDRTVTHMQDEAANFPDPVDRAAQEEEFSLELRNRDRERKLIKKIEKTLKKVEDEDFGYCESCGVEIGIRRLEARPTADLCIDCKTLAEIREKQMAG

SEQ ID NO: 523 - DNA, 705 bp, Escherichia coli
atggaattttctccccctctacagcgcgcgacgctaattcagcgttacaaacgttttttagccgatgtgatcacacccgatggtcgcgaattaacgctacactgcccgaatacgggtgcgatgaccggttgtgcaacgcctggcgataccgtctggtattcgacttcagacaacaccaaacggaaatacccacacacctgggaattaactcaaagccagagcggcgcaattatttgcgtcaatacgctttgggctaacaggttgacgaaagaggctatccttaatgaatcaatttcagagctggcaggctatagctcgctgaaaagcgaagtaaaatacggcgccgaacgcagccgtattgactttatgttgcaggcggattcgcgtccagactgctatattgaagtgaaatcggttacgttagcggagaacgaacagggatattttcccgatgcggtcactgaacgaggtcagaaacaccttcgggagttgatgagcgtagcggctgaaggccagcgtgcggttatctttttcgccgtgctgcattcagccattacacggttttcacccgcgcgccacatcgatgagaaatacgcgcaactattgtcagaagctcaacagaggggggtagaaattctggcttacaaagcggaactttctgccgaaggcatggctcttaaaaaatcactaccggttacattgtag

SEQ ID NO: 524 - protein, 234 aa, Escherichia coli
MEFSPPLQRATLIQRYKRFLADVITPDGRELTLHCPNTGAMTGCATPGDTVWYSTSDNTKRKYPHTWELTQSQSGAIICVNTLWANRLTKEAILNESISELAGYSSLKSEVKYGAERSRIDFMLQADSRPDCYIEVKSVTLAENEQGYFPDAVTERGQKHLRELMSVAAEGQRAVIFFAVLHSAITRFSPARHIDEKYAQLLSEAQQRGVEILAYKAELSAEGMALKKSLPVTL

SEQ ID NO: 525 - DNA, 744 bp, Escherichia coli
atgccgggatgcgccagcagttgcagcggcagccaggttgatttcccggccccggtcggcgcacttaataacacctgcgatgcaccatcgagggcagcaagtaactcaggtaagacggcagcaacgggcaacgacgacacaaaacgctccagagggttaacattcttcgcgccacattgtagcatcgcggtaattcataaccgagtgcctcacatgtctgaaccgcaacggctgttctttgctatcgacttacctgcagaaatccgcgaacagattatccgctggcgcgccacacacttcccacctgaggcgggacgtccggtcgccgccgataatttgcatctgactctggcatttttaggcgaagtgagcgcagagaaagagaaggcgctttctcttttagccggacggattcgtcaacctggtttcacactcacgcttgatgacgccggtcaatggctgcgttcgcgtgtggtgtggttagggatgcgacagccgccacgcggcttaatccagctggcgaatatgctccgttcacaggctgcccgcagcggttgttttcaaagcaatcgtccgtttcatccacatattaccttattgcgcgacgccagcgaggcggtgacaatcccgccgccaggttttaactggtcgtatacggtgacggagttcaccctttacgcctcctcgtttgcccgtggacgcacacgctacacgccgctaaaacgctgggcgctaacgcaataa

SEQ ID NO: 526 - protein, 247 aa, Escherichia coli
MPGCASSCSGSQVDFPAPVGALNNTCDAPSRAASNSGKTAATGNDDTKRSRGLTFFAPHCSIAVIHNRVPHMSEPQRLFFAIDLPAEIREQIIRWRATHFPPEAGRPVAADNLHLTLAFLGEVSAEKEKALSLLAGRIRQPGFTLTLDDAGQWLRSRVVWLGMRQPPRGLIQLANMLRSQAARSGCFQSNRPFHPHITLLRDASEAVTIPPPGFNWSYTVTEFTLYASSFARGRTRYTPLKRWALTQ

SEQ ID NO: 527 - DNA, 2430 bp, Escherichia coli
gtgtcgtcgttgcccgttgctgccgtcttacctgagttacttgctgccctcgatggtgcatcgcaggtgttattaagtgcgccgaccggggccgggaaatcaacctggctgccgctgcaactgctggcgcatcccggcattaacgggaaaattatcctgctggagccgcgtcgtctggcggcgcgtaacgttgcgcaacgactggcggagctgcttaacgaaaagccaggcgataccgttggctaccggatgcgtgcgcaaaactgcgtcgggccgaatacccgcctggaagtggttaccgaaggcgtgctgacgcggatgatccagcgtgacccggaactgagcggtgttggattggtgatccttgatgaatttcatgagcgcagcttgcaggcggatttggcgttggcgctgttactcgatgtgcaacaaggtctgcgtgatgaccttaaactgctgattatgtcggctacgctggacaacgaccgcttgcagcaaatgctgccagaagcgcccgtcgtcatctcagaagggcgctcgtttccggttgaacgccgttatttgccgctgcccgctcatcagcgttttgacgaagccgtcgcggttgccaccgccgaaatgctgcgtcaggaaagtggatcattactgttatttttacctggcgtcggagaaattcagcgtgtgcaggaacaactggcttcacgcatcggcagtgatgtgttgctctgcccgctgtatggcgcgttgtcgctgaacgatcagcgaaaagcgatcctcccggcaccgcaagggatgcgtaaagtggtgctggcgaccaatattgctgaaaccagtttaaccatcgaaggtattcgtctggtggtggattgtgcccaggagcgtgtggcgcgttttgatccgcgtacagggcttacgcggctggttactcaacgcgttagtcaggcgtcgatgacgcaacgtgccgggcgtgccgggcgtctggagccgggtatctgcctgcatttaatcgccaaagaacaagcagaacgcgctgccgcacaaagtgaaccggagatcttacaaagcgatctttccggtttgctgatggaattactgcaatggggatgcagcgatccggcgcagatgagctggctggatcaaccgccaacggtgaatctactggccgcgaaacgcctgttacggatgctgggggcgctggacggtgaacggcttagtgcgcaagggcaaaaaatggcaacgctgggtaacgatccgcgtttagcggcaatgctggttagcgcgaagaacgacgacgaagctgctaccgcggcaaaaattgccgccattctcgaagagccgccacggatgggcaatagtgacctgggcgtggcgttttcgcgcaatcaacccgcctggcagcaacgtagtcagcaactgttaaaacgcttaaacgtacgcggcggtgaggcagacagttcgcttatcgcgccgctacttgccagagcgtatgccgatcgcattgctcgtcgccgtgggcaagatgaacgctatcaactggcgaacggcatgggggcgatgctcgatgccgacgatgcgctaagccgccacgaatggttgatcgcaccgttattattgcagggcagcgcctcaccggatgcacggattttactggcgctgccggtcgatattgatgagttagtacaacgctgcccgcagctggtacagcagtctgacactgtggagtgggatgacgcgcaaggtacgctgaaagcctggcgtcggctgcaaattggtcagttgatggttaaagtgcaaccgctggcgaaaccctcggaagacgagttgcatcaggcgatgcttaacggcattcgtgataaaggtttaagcgtgctcaactggacggcggaagcggaacagctacgcttgcgtttgttatgcgccgcaaagtggttgccggaatatgactggccagcggttgatgatgaaagtttgttggcgacgctggaaacgtggctactgccgcatatgacaggcgtacattcgctacgcggcctgaaatcactcgatatttatcaggcactgcgtggattacttgattgggtaatgcagcaacgtctggatagtgaattgcctgcgcattacactgtgccgacgggaagccggatcgccattcgttaccatgaagataacccgcccgcgctggcggtgagaatgcaggagatgtttggtgaggccactaatccgactatcgcccaggggcgcgtaccgttggtgctggagttgctttcccctgcccaaaggccgctgcaaatcacgcgtgatttgagcgccttctggaaaggagcgtaccgtgaggtgcaaaaagagatgaaagggcgttatcccaaacatgtctggccggacgacccggcaaacaccgcaccgacgcgacgaacgaaaaagtattcgtga

SEQ ID NO: 528 - protein, 809 aa, Escherichia coli
MSSLPVAAVLPELLAALDGASQVLLSAPTGAGKSTWLPLQLLAHPGINGKIILLEPRRLAARNVAQRLAELLNEKPGDTVGYRMRAQNCVGPNTRLEVVTEGVLTRMIQRDPELSGVGLVILDEFHERSLQADLALALLLDVQQGLRDDLKLLIMSATLDNDRLQQMLPEAPVVISEGRSFPVERRYLPLPAHQRFDEAVAVATAEMLRQESGSLLLFLPGVGEIQRVQEQLASRIGSDVLLCPLYGALSLNDQRKAILPAPQGMRKVVLATNIAETSLTIEGIRLVVDCAQERVARFDPRTGLTRLVTQRVSQASMTQRAGRAGRLEPGICLHLIAKEQAERAAAQSEPEILQSDLSGLLMELLQWGCSDPAQMSWLDQPPTVNLLAAKRLLRMLGALDGERLSAQGQKMATLGNDPRLAAMLVSAKNDDEAATAAKIAAILEEPPRMGNSDLGVAFSRNQPAWQQRSQQLLKRLNVRGGEADSSLIAPLLARAYADRIARRRGQDERYQLANGMGAMLDADDALSRHEWLIAPLLLQGSASPDARILLALPVDIDELVQRCPQLVQQSDTVEWDDAQGTLKAWRRLQIGQLMVKVQPLAKPSEDELHQAMLNGIRDKGLSVLNWTAEAEQLRLRLLCAAKWLPEYDWPAVDDESLLATLETWLLPHMTGVHSLRGLKSLDIYQALRGLLDWVMQQRLDSELPAHYTVPTGSRIAIRYHEDNPPALAVRMQEMFGEATNPTIAQGRVPLVLELLSPAQRPLQITRDLSAFWKGAYREVQKEMKGRYPKHVWPDDPANTAPTRRTKKYS

SEQ ID NO: 529 - DNA, 678 bp, Escherichia coli
  n 659, 660, 661, 662, 663: n is any nucleotide
atggccgggaatgaccgcgagccaattggacgcaaagggaaaccgacgcgtccggtcaaacaaaaggtaagccgtcgtcgttacgaagatgacgatgattacgacgattatgatgactatgaggatgaagaaccgatgccgcgcaaaggtaagggcaaaggcaaagggcgtaagcctcgtggcaaacgcggctggctatggctgctgctaaaactggctatcgtttttgccgtgctgatcgccatttacggcgtttatctcgatcaaaaaattcgtagccgtattgatggcaaggtctggcaattgcccgcggcagtttatggtcgaatggtcaaccttgagccagacatgaccatcagcaagaacgagatggtgaagctgctggaggcgacccagtatcgccaggtgtcgaaaatgacccgtcctggcgagtttaccgtacaggccaacagcattgagatgatccgccgtccgtttgatttcccggacagcaaagaagggcaggtgcgcgcgtgtctgacctttgatggcgatcatctggcgacgatcgtcaatatggagaacaaccgtcagttcggtttcttccgtcttgatccgcgcctgatcaccatgatttcttcgccaaacggtgagcagcgtctgtttgtgccgcgcagtgnnnnncattccattcattaa

SEQ ID NO: 530 - protein, 225 aa, Escherichia coli
  Xaa 220, 221: Xaa is any amino acid
MAGNDREPIGRKGKPTRPVKQKVSRRRYEDDDDYDDYDDYEDEEPMPRKGKGKGKGRKPRGKRGWLWLLLKLAIVFAVLIAIYGVYLDQKIRSRIDGKVWQLPAAVYGRMVNLEPDMTISKNEMVKLLEATQYRQVSKMTRPGEFTVQANSIEMIRRPFDFPDSKEGQVRACLTFDGDHLATIVNMENNRQFGFFRLDPRLITMISSPNGEQRLFVPRSXXHSIH

SEQ ID NO: 531 - DNA, 1806 bp, Escherichia coli
  n 12, 13, 14, 15, 16: n is any nucleotide
atgaatgaatgnnnnngacgtgcggtgctggcaaacctgactgccggacgcacggtgcagggggcgagtacgctgacgcaacagttggttaaaaacctgttcctctccagcgagcgttcttactggcgtaaagcgaacgaagcctacatggcgctgatcatggacgcgcgttacagcaaagaccgtattcttgagctgtatatgaacgaggtgtatctcggtcagagcggcgacaacgaaatccgcggcttcccgctggcgagcttgtattactttggtcgcccggtagaagaattgagcctcgatcagcaggcgctgttggtgggtatggtgaaaggggcgtccatctacaacccgtggcgtaacccgaaactggcgctggagcgacgtaacctggtactacgtttgctgcaacagcaacaaattattgatcaagaactctacgacatgctgagtgcgcgtccgctgggtgttcagccgcgcggtggggtgatctctcctcagccagcctttatgcagctggtgcgtcaggagctgcaggcgaaattaggcgataaggtaaaagatctctccggcgtgaagatcttcactacctttgactcggtggcccaggacgcggcagaaaaagccgccgtggaaggcattccggcactgaagaaacagcgtaagttgagcgatcttgaaaccgcgattgtggttgttgaccgctttagcggtgaagttcgtgcgatggtcggtggttctgagccgcagtttgcgggctacaaccgtgcgatgcaggcgcgtcgttcgattggttcccttgcaaaaccagcgacttatctaacggccttaagccagccgaaaatctatcgtttgaatacgtggattgccgatgcgccaatcgcgctgcgtcagccgaatggccaggtctggtcaccgcagaacgatgatcgtcgttatagcgaaagtggcagggtgatgctggtagatgcgttgacccgttcgatgaacgtgccgacggtgaatctgggcatggcgttggggctacctgcggttacggagacctggattaaactgggtgtgccgaaagatcaactgaatccagttccagcaatgttgttgggggcgttgaacttaacgccaatcgaagtggcgcaggccttccagactatcgccagcggtggtaatcgtgctccgctttccgcgctacgttcagtcatcgcagaagacggcaaggtgttgtatcagagcttcccgcaggcggaacgcgctgttccggcgcaggcggcgtatctgacactatggaccatgcagcaggttgtacaacgcggtacgggtcgtcagcttggggcgaaatacccgaacctgcatctggcagggaaaacagggactaccaacaataacgtagatacctggtttgcgggcattgatgggagcacggtgaccatcacctgggtcggccgtgataacaaccagccgaccaaactgtatggtgccagcggggcaatgtcgatttatcagcgttatctggctaaccagacgccaacaccgctgaatcttgttccgccggaagatattgcagatatgggcgtggactacgacggcaactttgtttgcagcggtggtatgcgtgtcttgccggtctggaccagcgatccgcaatcgctgtgccagcagagtgagatgcagcagcaaccgtcaggcaatccgtttgatcagtcttctcagccgcagcaacagccgcaacagcaacctgctcagcaagagcagaaagacagcgacggtgtagccggttggattaaagatatgtttgggagtaattaa

SEQ ID NO: 532 - protein, 601 aa, Escherichia coli
  Xaa 4, 5, 6: Xaa is any amino acid
MNEXXXRAVLANLTAGRTVQGASTLTQQLVKNLFLSSERSYWRKANEAYMALIMDARYSKDRILELYMNEVYLGQSGDNEIRGFPLASLYYFGRPVEELSLDQQALLVGMVKGASIYNPWRNPKLALERRNLVLRLLQQQQIIDQELYDMLSARPLGVQPRGGVISPQPAFMQLVRQELQAKLGDKVKDLSGVKIFTTFDSVAQDAAEKAAVEGIPALKKQRKLSDLETAIVVVDRFSGEVRAMVGGSEPQFAGYNRAMQARRSIGSLAKPATYLTALSQPKIYRLNTWIADAPIALRQPNGQVWSPQNDDRRYSESGRVMLVDALTRSMNVPTVNLGMALGLPAVTETWIKLGVPKDQLNPVPAMLLGALNLTPIEVAQAFQTIASGGNRAPLSALRSVIAEDGKVLYQSFPQAERAVPAQAAYLTLWTMQQVVQRGTGRQLGAKYPNLHLAGKTGTTNNNVDTWFAGIDGSTVTITWVGRDNNQPTKLYGASGAMSIYQRYLANQTPTPLNLVPPEDIADMGVDYDGNFVCSGGMRVLPVWTSDPQSLCQQSEMQQQPSGNPFDQSSQPQQQPQQQPAQQEQKDSDGVAGWIKDMFGSN

SEQ ID NO: 533 - DNA, 2370 bp, Escherichia coli
ttgacccttcaggaatgcgcagattgcgtaccgcttgcgaacccgccagcgtttcgaatattatctcatctttataataatcattctcgtttacgttatcattcactttacaccagagaaataccaatggcaccttccaaaactgctcagccaaaacactcactgcgtaaaatcgcagttgtagtagccacagcggttagcggcatgtctgtttatgcacaggcagcggttgaaccgaaagaagacactatcaccgttaccgctgcacctgcgccgcaagaaagcgcatgggggccggctgcaactattgcggcgcgacagtcagctaccggcactaaaaccgatacgccgattcaaaaagtacctcaatctatttctgtcgtcaccgctgaagagatggcgctgcatcagcctaagtcggtgaaagaagcgcttagctatacgccgggtgtctctgttggtacgcgtggcgcatccaacacctatgaccacctgatcattcgcggttttgcggcagaaggccaaagccagaataactatctgaatggcctgaagttgcagggcaacttctataacgatgcggtcatcgacccgtatatgctggaacgtgctgaaattatgcgtggcccggtttccgtgctttacggtaaaagcagtcctggcggtctgttgaatatggtcagcaagcgtccgaccaccgaaccgctgaaagaagttcagtttaaagccggtactgacagcctgttccagaccggttttgacttcagcgatgcgctggatgatgacggcgtttattcttatcgcctgaccggtcttgcgcgttctgccaatgcccagcagaaagggtcagaagagcagcgttatgctattgcaccggcgttcacctggcgtccggatgataaaaccaatttcaccttcctttcttacttccagaacgagccggaaactggttattacggctggttgccgaaagagggaaccgttgagccgctgccgaacggtaagcgtctgccgacagactttaacgaaggggcgaagaacaacacctattctcgtaacgagaagatggtcggctacagcttcgatcacgaatttaacgatacctttactgtgcgtcagaacctgcgctttgctgaaaacaaaacctcgcaaaacagcgtttatggttacggcgtctgctccgatccggcgaatgcttacagcaaacagtgtgcggcattagcgccagcggataaaggccattatctggcacgtaaatacgtcgttgatgatgagaagctgcaaaacttctccgttgatacccagttgcagagcaagtttgccactggcgatatcgaccacactctgctgaccggtgtcgactttatgcgtatgcgtaatgacatcaacgcctggtttggttacgacgactctgtgccactgctcgatctgtacaatccggtgaataccgattttgacttcaatgcgaaagacccggataactccgggccgtaccgcattctgaataagcagaagcaaacgggcgtttatgttcaggatcaggcgcagtgggataaagtgctggtcaccctgggcggtcgttacgactgggcagatcaagaatctcttaaccgcgtagcgggaacgaccgataaacgtgatgacaaacagtttacctggcgtggtggtgttaactacctgtttgataatggtgtaacaccatacttcagctatagcgaatcgtttgaaccttcttcgcaagttgggaaggatggtaatattttcgcaccgtctaaaggtaagcagtatgaagtcggcgtgaaatatgtaccggaagatcgtccgattgtagttactggtgccgtgtataatcttactaaaaccaacaacctgatggcggaccctgagggttccttcttctcggttgaaggtggcgagatccgcgctcgtggcgtagaaatcgaagcgaaagcggcgctgtcggcgagtgttaacgtagtcggttcttatacttacaccgatgcggaatacactaccgatactacctacaaaggcaatacgcctgcacaggtgccaaaacacatggcttcgctgtgggctgactataccttctttgacggtccgctttcaggtctgacgctgggcaccggtggtcgttatactggctccagctatggtgatccggctaactcctttaaagtgggaagttatacggtcgtggatgcgttagtgcgttatgatctggcgcgagtcggcatggcgggctccaacgtggcgctgcatgtcaacaacctgtttgatcgtgaatacgtcgccagctgctttaacacttatggttgcttctggggcgcagaacgtcaggtcgttgcaaccgcaaccttccgtttctaa

SEQ ID NO: 534 - protein, 789 aa, Escherichia coli
MTLQECADCVPLANPPAFRILSHLYNNHSRLRYHSLYTREIPMAPSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPDNSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 535 - DNA, 903 bp, Escherichia coli
ttgcttctggggcgcagaacgtcaggtcgttgcaaccgcaaccttccgtttctaatttctcttttggggcacggatttccgtgcccgtttcacaagttggctgttatgcaggaatacacgaatcattccgataccacttttgcactgcgtaatatctcctttcgtgtgcccgggcgcacgcttttgcatccgttgtcgttaacctttcctgccgggaaagtgactggtctgattggtcacaacggttctggtaaatccactctgctcaaaatgcttggtcgtcaccagccaccgtcggaaggggagattcttcttgatgcccaaccgctggaaagctggagcagcaaagcgtttgcccgcaaagtggcttatttaccgcagcagcttcctccggcagaagggatgaccgtgcgtgaactggtggcgattggtcgttacccgtggcatggcgcactagggcgctttggtgctgcagatcgcgaaaaggtcgaggaagctatctcgctggttggcttaaaaccgctggcgcatcggctggtcgatagcctctctggcggcgaacgtcaacgggcgtggatcgccatgctggtggcgcaggatagccgctgtctgttgctcgacgaaccgacctcggcgctggatatcgcccaccaggttgatgtactggcgctggtgcatcgtttaagtcaggagcgaggcctgacggtcattgccgtgctgcacgatataaatatggcggcgcgctactgtgattatctggtcgccctgcgcggcggtgaaatgattgctcagggaacgcctgcggaaattatgcgcggcgaaaccctcgaaatgatttatggcatcccgatgggtattctgccgcatccggcgggtgctgcacctgtgagttttgtttattga

SEQ ID NO: 536 - protein, 300 aa, Escherichia coli
MLLGRRTSGRCNRNLPFLISLLGHGFPCPFHKLAVMQEYTNHSDTTFALRNISFRVPGRTLLHPLSLTFPAGKVTGLIGHNGSGKSTLLKMLGRHQPPSEGEILLDAQPLESWSSKAFARKVAYLPQQLPPAEGMTVRELVAIGRYPWHGALGRFGAADREKVEEAISLVGLKPLAHRLVDSLSGGERQRAWIAMLVAQDSRCLLLDEPTSALDIAHQVDVLALVHRLSQERGLTVIAVLHDINMAARYCDYLVALRGGEMIAQGTPAEIMRGETLEMIYGIPMGILPHPAGAAPVSFVY

SEQ ID NO: 537 - DNA, 894 bp, Escherichia coli
ttgatgagcggcttacctcttatttcgcgccgccgactgttaacggcgatggcgctttctccgttgttatggcagatgaataccgcccacgcggcagttattgatcccaatcgtattgtggcactggagtggttgccggtggagttactgctggcgctcggcatcgtgccttacggcgtggcggacaccatcaactatcgcctgtgggtcagcgaaccgccattgccggactcagtgattgacgttggtttgcgtacagaacccaaccttgaactgctgaccgaaatgaaaccgtcgtttatggtctggtctgcaggatatggcccttcaccagaaatgctggcacgtattgcgccggggcgcggatttaacttcagcgacggcaaacagccactggcgatggcgcgtaaatcactgacggaaatggcagatttacttaacctgcaaagcgcagcggaaacgcatttagcgcactatgaagactttatccgcagcatgaaaccccgctttgtgaagcgtggtgcacgcccgttattgctgacgacgcttatcgatccgcgccatatgttggtcttcggtccaaacagcttgttccaggaaattctcgatgagtacggcatcccaaatgcctggcaaggggaaaccaacttctggggcagtaccgccgtcagtatcgatcgtctggcagcgtataaagacgttgatgtgctctgttttgatcacgacaacagcaaagacatggatgcgctaatggcaaccccgctgtggcaggccatgccgtttgtccgcgccggacgctttcagcgcgtacctgcagtctggttctatggtgcgacgctttctgcaatgcactttgtgcgtattctggataacgccatcggaggtaaagcgtga

SEQ ID NO: 538 - protein, 297 aa, Escherichia coli
MMSGLPLISRRRLLTAMALSPLLWQMNTAHAAVIDPNRIVALEWLPVELLLALGIVPYGVADTINYRLWVSEPPLPDSVIDVGLRTEPNLELLTEMKPSFMVWSAGYGPSPEMLARIAPGRGFNFSDGKQPLAMARKSLTEMADLLNLQSAAETHLAHYEDFIRSMKPRFVKRGARPLLLTTLIDPRHMLVFGPNSLFQEILDEYGIPNAWQGETNFWGSTAVSIDRLAAYKDVDVLCFDHDNSKDMDALMATPLWQAMPFVRAGRFQRVPAVWFYGATLSAMHFVRILDNAIGGKA

SEQ ID NO: 539 - DNA, 1983 bp, Escherichia coli
gtgagtaaacgaattgcgctttttccggtgttattgctggcgctgctggtggttgctgctgcggcgttgacctggatgaacttctcgcaggcgctgccgcgcagccagtgggcgcaggccgcctggtcgccggatattgacgtcatcgagcagatgatttttcactacagcttgttgccgcgtctggcgatttcgctgctggtgggcgcgggcctggggctggtgggcgtgctgtttcagcaagtgctgcgtaacccgctggcggaaccgacgacattgggtgttgcaacaggcgcgcaactggggattaccgtcaccacgctctgggcaatccccggcgcgatggcgagccagtttgctgcgctggcaggggcttgtgttgttggcttaatcgtctttggcgtcgcgtgggggaaacggctttcgccggtaacgctgatcctcgcggggctggtagtgagcctttattgcggcgcaatcaatcagttactggttatcttccatcatgaccaactgcaaagcatgttcctgtggagcaccggaacgctgacgcaaaccgactggggcggcgttgagcgtttatggccgcagctgctgggcggcgtgatgctgacgttattgctacttcgcccgttaactctgatggggcttgatgatggcgtggcgcgcaatctcgggctggccttgtcgctcgctcgtctggcggcgttgtcgctggcgattgtcatcagtgcgctgctggtgaacgcggtggggattatcggctttatcggtttgttcgcgccactgctggcgaaaatgctgggggcgcggcgtttgttgccacggttgatgctggcatcgctgattggtgcgttaattctgtggctttctgatcaaatcatcctctggctgactcgcgtgtggatggaagtgtccaccggttcggtcactgcgttgatcggtgcgccgctgctactgtggttgctgccgcgtttacgcagcattagcgcgccggatatgaaggtgaacgatcgtgtcgcgactgaacgccaacacgtgctggcgtttgccctcgcgggcggcgtgctgctgttgatggctgtggtggtggcgctgtcgtttggtcgtgatgcgcacggctggacgtgggcgagcggggcgttgctcgaggatttgatgccctggcgctggccgcgaattatggctgcgctgtttgcgggcgtcatgctggcggtggcgggctgtattattcagcggctgaccggaaacccgatggcaagcccggaagtgctggggattagctccggcgcggcgtttggcgtggtgttaatgctgtttctggtgccgggtaatgcctttggctggctgttacccgcaggcagtctcggggcggcggtgacgctgttgatcattatgatcgccgccggacgtggtggattttccccacaccgcatgttactggcggggatggcgttaagtaccgcgttcaccatgcttttgatgatgttgcaggcaagtggtgacccgcgaatggcgcaagttctgacctggatttccggttcgacctacaacgcgaccgatgcgcaggtctggcgtaccggaattgtgatggtgattttgctggcgattaccccgctgtgccgccgctggctgaccattttaccgctgggtggtgataccgcacgagccgtggggatggcgctgacgccgacgcgaattgcgctgctgctgttagcggcttgcctgacggcgaccgcgacaatgaccattggaccgttgagttttgttggtttaatggcaccgcatattgcgcggatgatgggctttcgacggacgatgccacacatcgtaatttcggcgctggtgggtggtttactgctggtgttcgctgactggtgtgggcggatggtgctgtttccattccagatccccgcggggctgctgtcgacctttatcggcgcgccatattttatctatttgttgagaaagcagagccgttaa

SEQ ID NO: 540 - protein, 660 aa, Escherichia coli
MSKRIALFPVLLLALLVVAAAALTWMNFSQALPRSQWAQAAWSPDIDVIEQMIFHYSLLPRLAISLLVGAGLGLVGVLFQQVLRNPLAEPTTLGVATGAQLGITVTTLWAIPGAMASQFAALAGACVVGLIVFGVAWGKRLSPVTLILAGLVVSLYCGAINQLLVIFHHDQLQSMFLWSTGTLTQTDWGGVERLWPQLLGGVMLTLLLLRPLTLMGLDDGVARNLGLALSLARLAALSLAIVISALLVNAVGIIGFIGLFAPLLAKMLGARRLLPRLMLASLIGALILWLSDQIILWLTRVWMEVSTGSVTALIGAPLLLWLLPRLRSISAPDMKVNDRVATERQHVLAFALAGGVLLLMAVVVALSFGRDAHGWTWASGALLEDLMPWRWPRIMAALFAGVMLAVAGCIIQRLTGNPMASPEVLGISSGAAFGVVLMLFLVPGNAFGWLLPAGSLGAAVTLLIIMIAAGRGGFSPHRMLLAGMALSTAFTMLLMMLQASGDPRMAQVLTWISGSTYNATDAQVWRTGIVMVILLAITPLCRRWLTILPLGGDTARAVGMALTPTRIALLLLAACLTATATMTIGPLSFVGLMAPHIARMMGFRRTMPHIVISALVGGLLLVFADWCGRMVLFPFQIPAGLLSTFIGAPYFIYLLRKQSR

SEQ ID NO: 541 - DNA, 1281 bp, Escherichia coli
atgagtaagtctgaaaatctttacagcgcagcgcgcgagctgatccctggcggtgtgaactcccctgttcgcgcctttactggcgtgggcggcactccactgtttatcgaaaaagcggacggcgcttatctgtacgatgttgatggcaaagcctatatcgattatgtcggttcctgggggccgatggtgctgggccataaccatccggcgatccgcaatgccgtgattgaagccgccgagcgtggtttaagctttggtgcaccaaccgaaatggaagtgaaaatggcgcaactggtgaccgaactggtcccgaccatggatatggtgcgcatggtgaactccggcactgaagcgacgatgagcgccatccgcctggcccgtggttttaccggtcgcgacaaaattattaaatttgaaggttgttaccacggtcacgctgactgcctgctggtgaaagccggttctggcgcactcacgttaggccagccaaattcgccgggcgttccggcagatttcgccaaacataccttaacctgtacttataacgatctggcctctgtacgcgccgcgtttgagcaatacccgcaagagattgcctgtattatcgtcgagccggtggcaggcaatatgaactgcgttccaccgctgccagagttcctgccaggtctgcgcgcgctgtgcgacgaatttggcgcgttgctgatcatcgatgaagtgatgaccggtttccgcgtagcgctagctggcgcacaggattattacggtgtggaaccggatctcacctgcctcggcaaaatcatcggcggtggaatgccggtaggcgcattcggtggtcgtcgtgatgtaatggatgcgctggccccgaccggtccggtctatcaggcgggtacgctttccggtaacccgattgcgatggctgctggtttcgcctgtctgaatgaagtcgcacagccgggcgttcacgagacgctggatgagctgacaacacgtctggcagaaggtctgcgggaagcggcagaagaagccggaattccgctggtggtaaaccacgttggcggcatgttcggtattttctttaccgacgccgagtccgtgacgtgctatcaggatgtgatggcctgtgacgtggaacgttttaagcgtttcttccatatgatgctggacgaaggtgtttatctggcaccgtcagcgtttgaagcgggttttatgtctgtggcgcacagcatggaagatatcaataacaccatcgatgctgcacgtcgggtgtttgcgaagttgtga

SEQ ID NO: 542 - protein, 426 aa, Escherichia coli
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKHTLTCTYNDLASVRAAFEQYPQEIACIIVEPVAGNMNCVPPLPEFLPGLRALCDEFGALLIIDEVMTGFRVALAGAQDYYGVEPDLTCLGKIIGGGMPVGAFGGRRDVMDALAPTGPVYQAGTLSGNPIAMAAGFACLNEVAQPGVHETLDELTTRLAEGLREAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 543 - DNA, 1422 bp, Escherichia coli
atgaaaactgatactccctctttagaaacaccgcaggccgcgcgcctgcgacgcagacaactgattcgccaacttcttgagcgcgataaaaccccgttagccattttgtttatggcggcagtcgtcggcacgcttgtcgggctggctgcggttgcttttgacaaaggtgtcgcctggttgcagaaccaacgtatgggggcactggtacatactgctgataattatccgcttctgttaaccgtcgcttttctctgttcggcggtgctggcgatgttcggctactttttggtgcgcaaatacgcgccggaagcaggtggttcggggatcccggaaattgaaggggcgctggaagatcaacgtcccgttcgctggtggcgtgtgttgccggtgaaattctttggcgggctgggaacactcggcggaggcatggtgttggggcgcgaagggccaaccgtgcagataggcggcaatatcgggcggatggtactcgatgttttccgcctgaaaggtgacgaagctcgtcatacgctgttggcaaccggtgctgctgcggggctggctgcggcctttaacgcgccgctggcgggtattttgtttattatcgaagagatgcgtccgcagtttcgctatacgttaatttcgattaaagcggtatttattggcgtcattatgtcgaccattatgtaccggatttttaatcatgaagttgcgttgattgacgtcggtaaactttctgatgcgccgcttaatacgctgtggctttatctgatcctcggtattatttttggcattttcggccctatttttaataaatgggtgctggggatgcaggatttgctgcaccgtgtgcacggtggcaatattaccaaatgggtactgatgggcggtgcgattggcggtctgtgtggattgctggggtttgtggcaccagcaacttcgggcggcggttttaacctgattcctatcgctaccgcggggaatttcagcatgggaatgctggtgtttatcttcgtcgcgcgggtcattaccactttactctgcttctcttccggcgcgccgggcggtatttttgccccgatgctggcgctgggtactgtgctgggaaccgctttcggaatggttgccgttgagttgtttccgcaatatcaccttgaggcggggacgtttgctattgccggaatgggggcgttactggcggcatctattcgcgcgccgttaacggggatcattctggttctggaaatgaccgataactaccagctcattttgccaatgattattaccggtcttggcgcaacactattagcacaatttaccggtgggaaaccgctatactcggcgattcttgcgcgcacgctggcaaaacaggaagctgagcaactggcgcgaagcaaggccgcatcagcccgcgagaatacttga

SEQ ID NO: 544 - protein, 473 aa, Escherichia coli
MKTDTPSLETPQAARLRRRQLIRQLLERDKTPLAILFMAAVVGTLVGLAAVAFDKGVAWLQNQRMGALVHTADNYPLLLTVAFLCSAVLAMFGYFLVRKYAPEAGGSGIPEIEGALEDQRPVRWWRVLPVKFFGGLGTLGGGMVLGREGPTVQIGGNIGRMVLDVFRLKGDEARHTLLATGAAAGLAAAFNAPLAGILFIIEEMRPQFRYTLISIKAVFIGVIMSTIMYRIFNHEVALIDVGKLSDAPLNTLWLYLILGIIFGIFGPIFNKWVLGMQDLLHRVHGGNITKWVLMGGAIGGLCGLLGFVAPATSGGGFNLIPIATAGNFSMGMLVFIFVARVITTLLCFSSGAPGGIFAPMLALGTVLGTAFGMVAVELFPQYHLEAGTFAIAGMGALLAASIRAPLTGIILVLEMTDNYQLILPMIITGLGATLLAQFTGGKPLYSAILARTLAKQEAEQLARSKAASARENT

SEQ ID NO: 545 - DNA, 345 bp, Escherichia coli
atgagtgatgacgtagcactgccgctggagtttaccgacgcagcagccaacaaagttaaaagcctgatcgctgacgaagataacccgaatctgaaattacgcgtgtatatcaccggtggcggttgcagcggcttccagtatggtttcacctttgatgatcaggtgaacgaaggcgatatgaccatcgaaaaacagggcgttggcctggtggttgatccgatgagcctgcaatatctggtcggcggttccgttgactataccgaaggtctggaaggttctcgtttcatcgtgaccaacccgaacgcgaaaagtacctgcggttgcggttcttcctttagtatctaa

SEQ ID NO: 546 - protein, 114 aa, Escherichia coli
MSDDVALPLEFTDAAANKVKSLIADEDNPNLKLRVYITGGGCSGFQYGFTFDDQVNEGDMTIEKQGVGLVVDPMSLQYLVGGSVDYTEGLEGSRFIVTNPNAKSTCGCGSSFSI

SEQ ID NO: 547 - DNA, 624 bp, Escherichia coli
atgctcgtctattggctggatatagtcggcacagcggtatttgctatctctggcgttttgttagccggaaaattgcgtatggacccttttggtgttctggtattgggcgtggttaccgcagtaggcggcggaacaattcgcgacatggcgctggatcacggcccggtattttgggtgaaagatcccaccgatctggtcgttgcaatggtcaccagcatgctgaccatcgtgctggtgcgccagccaagacgcttaccaaaatggatgttgccggtgctggacgccgttggtctggcggtgtttgtcggcattggcgtgaataaagcctttaatgcggaagccggtccgttaatcgcggtttgtatgggcgtcattactggcgttggcggcgggatcattcgtgatgtactggcccgcgaaatccccatgattttacgtacagaaatctacgcaactgcctgtattatcggcggtattgtccacgctacggcttattacacattttccgtaccactggaaacagccagtatgatgggcatggtcgtgacgctattgattcggctggcggctattcgttggcatcttaagctaccgacgtttgcgctggatgagaatggtcgttga

SEQ ID NO: 548 - protein, 207 aa, Escherichia coli
MLVYWLDIVGTAVFAISGVLLAGKLRMDPFGVLVLGVVTAVGGGTIRDMALDHGPVFWVKDPTDLVVAMVTSMLTIVLVRQPRRLPKWMLPVLDAVGLAVFVGIGVNKAFNAEAGPLIAVCMGVITGVGGGIIRDVLAREIPMILRTEIYATACIIGGIVHATAYYTFSVPLETASMMGMVVTLLIRLAAIRWHLKLPTFALDENGR

SEQ ID NO: 549 - DNA, 828 bp, Escherichia coli
ttgagtcactggtgcagaaactggcacatggctaagtcactgttcagggcgctggtcgccctgtcttttctcgcgccgctgtggctcaatgccgcgccgcgcgtcatcacgctttctcccgccaacactgaacttgcctttgccgccgggatcacgccggttggggtcagcagctattccgactatcctccacaagcgcaaaagattgggcaggtttccacctggcaggggatgaatctggaacgcattgtcgcgctgaaacccgatctggtgattgcctggcgtggaggtaatgccgagcggcaggttgaccagctggcttcgctgggaataaaagtgatgtgggtcgatgcgacaagcattgaacaaattgccaatgcgttacgtcaactggccccctggagtccgcaaccggataaggccgaacaagccgcgcaatccctgctggatcagtacgcgcaattgaaagcgcaatatgctgataaacctaaaaaacgtgtttttctgcaattcggcattaatccgccatttaccagtggaaaagagtcgattcagaaccaggtactcgaagtttgtggcggagaaaacatctttaaagacagccgggttccctggccgcaagttagccgcgaacaggtgttagcacgctcgccacaggcgattgtcattacaggcggaccggaccaaattcctaaaatcaaacaatactggggtgaacagctcaaaattcccgttattcctctcacgagtgactggtttgaacgtgcaagcccacgtattatcctcgctgcacaacagctctgtaatgcgctttcacaggtagattag

SEQ ID NO: 550 - protein, 275 aa, Escherichia coli
MSHWCRNWHMAKSLFRALVALSFLAPLWLNAAPRVITLSPANTELAFAAGITPVGVSSYSDYPPQAQKIGQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 551 - DNA, 699 bp, Escherichia coli
atgaaaatcggcatcattggtgcaatggaagaagaagttacgctgctgcgtgacaaaatcgaaaaccgtcaaactatcagtctgggcggttgcgaaatctataccggccaactgaatggaaccgaggttgcgcttctgaaatcgggcatcggtaaagtcgctgcggcgctgggtgccactttgctgttggaacactgcaagccagatgtgattattaacaccggttctgccggtggcctggcaccaacgctgaaagtgggcgatatcgttgtctcggacgaagcgcgttatcacgacgcggatgtcacggcatttggttatgaatacggtcagttaccaggctgcccggcaggcttcaaagctgacgataaactgatcgctgccgctgaggcctgcattgccgaactgaatcttaacgctgtacgtggcctgattgttagcggcgacgctttcatcaacggttctgttggtctggcgaaaatccgccacaacttcccacaggccattgctgtagagatggaagcgacggcaatcgcccatgtctgccacaatttcaacgtcccgtttgtcgtagtacgcgccatctccgacgtggccgatcaacagtctcatcttagcttcgatgagttcctggctgttgccgctaaacagtccagcctgatggttgagtcactggtgcagaaactggcacatggctaa

SEQ ID NO: 552 - protein, 232 aa, Escherichia coli
MKIGIIGAMEEEVTLLRDKIENRQTISLGGCEIYTGQLNGTEVALLKSGIGKVAAALGATLLLEHCKPDVIINTGSAGGLAPTLKVGDIVVSDEARYHDADVTAFGYEYGQLPGCPAGFKADDKLIAAAEACIAELNLNAVRGLIVSGDAFINGSVGLAKIRHNFPQAIAVEMEATAIAHVCHNFNVPFVVVRAISDVADQQSHLSFDEFLAVAAKQSSLMVESLVQKLAHG

SEQ ID NO: 553 - DNA, 1518 bp, Escherichia coli
atggcacagattgatttccgaaaaaaaataaactggcatcgtcgttaccgttcaccgcagggcgttaaaaccgaacatgagattctgcggatcttcgagagcgatcgcgggcgtatcatcaactctccggcaattcgtcgtctgcaacaaaagacccaggtttttccactggagcgcaatgccgccgtgcgcacgcgtcttacccactcgatggaagtccagcaggtggggcgctacatcgctaaagaaattttaagccgtttgaaagagcttaaattactggaggcgtatggtctcgatgaactgaccgggccctttgaaagcattgttgagatgtcatgcctgatgcacgatatcggcaatccgccgtttggtcattttggcgaagcggcgataaatgactggtttcgccagcgtttgtacccggaagatgccgaaagccagcctctgactgacgatcgctgcagcgtggcggcactacgtttacgggacggggaagaaccgcttaacgcgctgcggcgcaagattcgtcaggacttatgtcattttgaaggtaacgcacagggtattcgtttggtgcatacattgatgcggatgaatctcacctgggcacaggttggcggtattttaaaatatacccgtccggcgtggtggcgtggcgaaacgcctgagacacatcactatttaatgaaaaagccgggctattatctttccgaagaagcctatattgcccggttgcgtaaagaacttaatttggcgctttacagtcgttttccgttaacgtggattatggaagctgccgacgacatctcctattgtgtggcagaccttgaagatgcggtagagaaaaggatatttaccgttgagcagctttatcatcatttgcacgaggcgtggggccagcatgagaaaggttcgctcttttcgctggtggttgaaaatgcctgggaaaaatcacgctcaaatagtttaagccgcagtacggaagatcagttttttatgtatttacgggtaaacaccctaaataaactggtaccctatgcggcacaacgatttattgataatctgcctgcgattttcgccggaacgtttaatcatgcattattggaagatgccagcgaatgcagcgatcttcttaagctatataaaaatgtcgctgtaaaacatgtgtttagccatccagatgtcgagcagcttgaattgcagggctatcgggtcattagcggattattagagatttatcgtcctttattaaacctgccgttatcagactttactgaactggtagaaaaagaacgggtgaaacgtttccctattgaaacgcgcttattccacaaactctcgacgcgccatcggctggcctatgtcgaggctgtcagtaaattaccgtcagattctcctgagtttccgctatgggaatattattaccgttgccgcctgctgcaggattatatcagcggtatgaccgacctctatgcgtgggatgaataccgacgtctgatggccgtagaacaataa

SEQ ID NO: 554 - protein, 505 aa, Escherichia coli
MAQIDFRKKINWHRRYRSPQGVKTEHEILRIFESDRGRIINSPAIRRLQQKTQVFPLERNAAVRTRLTHSMEVQQVGRYIAKEILSRLKELKLLEAYGLDELTGPFESIVEMSCLMHDIGNPPFGHFGEAAINDWFRQRLYPEDAESQPLTDDRCSVAALRLRDGEEPLNALRRKIRQDLCHFEGNAQGIRLVHTLMRMNLTWAQVGGILKYTRPAWWRGETPETHHYLMKKPGYYLSEEAYIARLRKELNLALYSRFPLTWIMEAADDISYCVADLEDAVEKRIFTVEQLYHHLHEAWGQHEKGSLFSLVVENAWEKSRSNSLSRSTEDQFFMYLRVNTLNKLVPYAAQRFIDNLPAIFAGTFNHALLEDASECSDLLKLYKNVAVKHVFSHPDVEQLELQGYRVISGLLEIYRPLLNLPLSDFTELVEKERVKRFPIETRLFHKLSTRHRLAYVEAVSKLPSDSPEFPLWEYYYRCRLLQDYISGMTDLYAWDEYRRLMAVEQ

SEQ ID NO: 555 - DNA, 1425 bp, Escherichia coli
atgaaaaaaaccacattagcactgagtgcactggctctgagtttaggtttggcgttatctccgctctctgcaacggcggctgagacttcttcagcaacgacagcccagcagatgccaagccttgcaccgatgctcgaaaaggtgatgccttcagtggtcagcattaacgtagaaggtagcacaaccgttaatacgccgcgtatgccgcgtaatttccagcagttcttcggtgatgattctccgttctgccaggagggttctccgttccagagctctccgttctgccaggggggcctgggcggtaatggcggcggccagcaacagaaattcatggcgctgggttccggcgttatcattgatgccgataaaggctatgtcgtcaccaacaaccacgttgttgataacgcgacggtgattaaagtccaactgagcgatggtcgtaagttcgacgcgaagatggttggcaaagatccgcgctctgatatcgcgctgatccagatccagaacccgaaaaacctgaccgcaattaagatggcggattctgatgcgctgcgcgtgggtgattacaccgtagcaattggtaacccgttcggcctgggcgagacagtaacttccgggattgtctctgcgctgggacgtagcggcctgaacgctgaaaactacgaaaacttcatccagactgatgcagcgatcaaccggggtaactcaggtggtgcgttggttaacctgaacggcgaactgattggtatcaacaccgcgattctcgcaccggacggcggaaacatcggtatcggttttgctatcccgagcaacatggtgaaaaacctgacctcgcagatggtggaatacggccaggtgaaacgtggtgagttgggtattatgggcactgagctgaactccgatctggcgaaagcgatgaaagttgacgcccagcgcggtgctttcgtaagccaggttctgccgaattcttccgccgcgaaagcgggcattaaagcgggtgatgtgatcacctcactgaacggtaagccaatcagcagctttgccgcactgcgtgctcaggtgggcactatgccggtaggtagcaaactgaccctaggcttactgcgcgacgggaagcaggttaacgtgaacctggaacttcagcagagcagccagaatcaggttgattccagcaccatcttcaacggcattgaaggcgctgagatgagtaacaaaggcaaagatcagggcgtggtggtgaacaacgtgaaaacgggcactccggctgcgcagatcggcctgaagaaaggtgatgtgattattggcgcgaaccagcaggcagtgaaaaacatcgctgaactgcgtaaagttctcgacagcaaaccgtctgtgctggcactgaacattcagcgcggcgacagcaccatctacctgttaatgcagtaa

SEQ ID NO: 556 - protein, 474 aa, Escherichia coli
MKKTTLALSALALSLGLALSPLSATAAETSSATTAQQMPSLAPMLEKVMPSVVSINVEGSTTVNTPRMPRNFQQFFGDDSPFCQEGSPFQSSPFCQGGLGGNGGGQQQKFMALGSGVIIDADKGYVVTNNHVVDNATVIKVQLSDGRKFDAKMVGKDPRSDIALIQIQNPKNLTAIKMADSDALRVGDYTVAIGNPFGLGETVTSGIVSALGRSGLNAENYENFIQTDAAINRGNSGGALVNLNGELIGINTAILAPDGGNIGIGFAIPSNMVKNLTSQMVEYGQVKRGELGIMGTELNSDLAKAMKVDAQRGAFVSQVLPNSSAAKAGIKAGDVITSLNGKPISSFAALRAQVGTMPVGSKLTLGLLRDGKQVNVNLELQQSSQNQVDSSTIFNGIEGAEMSNKGKDQGVVVNNVKTGTPAAQIGLKKGDVIIGANQQAVKNIAELRKVLDSKPSVLALNIQRGDSTIYLLMQ

SEQ ID NO: 557 - DNA, 1131 bp, Escherichia coli
atggcgcaggatatcgtggcacgtaccatgcgcatcatcgataccaatatcaacgtaatggatgcccgcgggcgaattatcggcagcggcgatcgtgagcgtattggtgaattgcacgaaggagcattgctggtactttcacaaggacgagtcgtcgatatcgatgacgcggtggcacgtcatctgcacggtgtgcggcaggggattaatctaccgttacggctggaaggtgaaattgtcggcgtaattggcctgacaggtgaaccagagaatctgcgtaaatatggcgaactggtctgcatgacggctgaaatgatgctggaacagtcgcggttgatgcacctgttggcgcaggatagccgtttgcgggaagaactggtgatgaacctcattcaggctgaggagaatactcccgcacttactgaatgggcgcaacggctggggatcgatctcaatcaaccgcgagtggtggctattgttgaggtcgacagcggtcagcttggcgtggacagcgcaatggcggagttacagcaactgcaaaatgcgctgactacgcccgagcgtaataatctggtggcgattgtctcgctaaccgaaatggtggtgttgaaaccggcgttgaactcttttgggcgctgggacgcagaagatcatcgtaagcgagttgaacaactgattacccgcatgaaagagtatggccagctgcgttttcgcgtttcgctgggcaactattttaccggtcctggcagtattgcccgatcctatcgtacggcgaaaacgacgatggtggtgggtaaacagcggatgccagaaagtcgctgctatttttatcaggatctgatgttacctgtgttactcgacagtttgcgtggcgactggcaggccaacgaactggcgcgaccgctggcgcggctgaaagcgatggacaataacggcttgctgcggcgaactctggcggcgtggtttcgccacaatgtgcaaccgctggcaacgtcaaaggcgttgtttattcatcgtaatactctggaatatcggcttaatcgtatatcggaactgaccgggcttgatttgggcaattttgatgacaggttgctgctgtatgtggcgttacaactggatgaagagcggtag

SEQ ID NO: 558 - protein, 376 aa, Escherichia coli
MAQDIVARTMRIIDTNINVMDARGRIIGSGDRERIGELHEGALLVLSQGRVVDIDDAVARHLHGVRQGINLPLRLEGEIVGVIGLTGEPENLRKYGELVCMTAEMMLEQSRLMHLLAQDSRLREELVMNLIQAEENTPALTEWAQRLGIDLNQPRVVAIVEVDSGQLGVDSAMAELQQLQNALTTPERNNLVAIVSLTEMVVLKPALNSFGRWDAEDHRKRVEQLITRMKEYGQLRFRVSLGNYFTGPGSIARSYRTAKTTMVVGKQRMPESRCYFYQDLMLPVLLDSLRGDWQANELARPLARLKAMDNNGLLRRTLAAWFRHNVQPLATSKALFIHRNTLEYRLNRISELTGLDLGNFDDRLLLYVALQLDEER

SEQ ID NO: 559 - DNA, 387 bp, Escherichia coli
atgtacgacaatctgaaaagtctgggtattaccaatcctgaagaaattgatcgttacagcctccggcaggaagccaacaacgatattctgaaaatctatttccagaaagacaaaggcgagtttttcgccaagagcgtgaagtttaaatacccgcgtcagcgtaaaacggtcgtcgctgatggtgtgggtcagggttataaagaagtccaggaaattagcccgaatctacggtatatcattgatgagcttgatcaaatctgccagcgtgaccgcagcgaagttgatcttaagcgtaagatcctcgacgacttacgtcacctggagtcagtagtaaccaataagatcagcgagattgaagccgatctggaaaaactgacgcgtaaataa

SEQ ID NO: 560 - protein, 128 aa, Escherichia coli
MYDNLKSLGITNPEEIDRYSLRQEANNDILKIYFQKDKGEFFAKSVKFKYPRQRKTVVADGVGQGYKEVQEISPNLRYIIDELDQICQRDRSEVDLKRKILDDLRHLESVVTNKISEIEADLEKLTRK

SEQ ID NO: 561 - DNA, 825 bp, Escherichia coli
atgcagcagttacagaacattattgaaaccgcttttgaacgccgtgccgagatcacgccagccaatgcagacaccgttacccgcgaagcggtaaatcaggtgatcgccctgctggattccggcgcactgcgtgtagcggaaaaaattgacggtcagtgggtgacgcatcagtggttgaaaaaagcggtgctgctctctttccgtattaatgataatcaggtgatcgaaggggcagaaagccgctacttcgacaaagtgccgatgaaattcgctaactacgatgaagcacgtttccagaaagaaggcttccgcgtcgtgccaccagcggcagtgcgtcagggcgcgttcattgcccgtaacaccgtgctgatgccgtcttacgtcaacatcggcgcatatgttgatgaaggcaccatggttgatacctgggcgaccgtcggttcctgtgcgcagattggtaaaaacgtccacctttccggtggcgtgggtatcggcggcgtgctggagccgctgcaggctaacccgaccattattgaagataactgcttcatcggcgcacgctctgaagtggttgaaggggtgattgtcgaagaaggttccgtcatctctatgggcgtatacattggtcagagcacccgtatttatgaccgtgaaaccggcgaaatccactacggtcgcgttccggcggggtctgtggttgtttcaggtaatctgccgtcgaaagatggcaaatacagcctctactgtgcagttatcgttaagaaagttgacgcgaaaactcgcggtaaagttggtattaacgaactgctgcgtaccatcgactaa

SEQ ID NO: 562 - protein, 274 aa, Escherichia coli
MQQLQNIIETAFERRAEITPANADTVTREAVNQVIALLDSGALRVAEKIDGQWVTHQWLKKAVLLSFRINDNQVIEGAESRYFDKVPMKFANYDEARFQKEGFRVVPPAAVRQGAFIARNTVLMPSYVNIGAYVDEGTMVDTWATVGSCAQIGKNVHLSGGVGIGGVLEPLQANPTIIEDNCFIGARSEVVEGVIVEEGSVISMGVYIGQSTRIYDRETGEIHYGRVPAGSVVVSGNLPSKDGKYSLYCAVIVKKVDAKTRGKVGINELLRTID

SEQ ID NO: 563 - DNA, 2673 bp, Escherichia coli
atgaatacccttccagaacagtacgcaaacaccgctctccccaccctgtccggtcaaccgcaaaatccatgcgcctggccccgtgatgaattaaccgtcggtgggataaaagcccatatcgatactttccagcgttggctgggtgatgcctttgacaatggtatctccgcagaacagttgattgaggcgcgtaccgagtttatcgaccagcttcttcaacgattatggattgaagcgggattcagccagattgccgacctggcattggtcgccgtcggtggctacggtcgtggcgagctgcatccactttctgacatcgatttactgattttaagccgtaaaaagctcccggacgatcaggcgcaaaaagtgggcgagctgttaacactgctctgggatgtaaagctggaagtaggtcatagcgtgcgcacgcttgaagagtgcatgctggaagggttatcggatttaaccgtcgccaccaatttaatcgaatcccgcttattaattggcgatgttgcgctgttcctcgaactgcaaaaacatatttttagcgaaggattctggccttccgacaagttctacgcggcgaaagttgaagaacagaaccagcgccatcagcgttaccacggcaccagctacaaccttgaaccagacatcaaaagtagccccggcggcttgcgcgatatccacactctgcaatgggtggcccgccgtcattttggagcaacatcgctggatgaaatggtagggtttggcttcttaacctctgcggagagagcggaattaaacgaatgcctgcatatattgtggcgcattcgctttgccctgcatctggtcgtcagtcgttacgataatcgcctgttattcgatcgccagcttagcgtcgcccagcgtttgaattacagtggtgaaggtaacgaaccggtcgagcggatgatgaaggattacttccgcgttacacgccgcgtcagtgaactcaaccagatgctgctgcaactgttcgatgaagccatcctcgcccttcccgccgacgaaaaaccacgtccaatcgacgatgagtttcagctacgcggaacgctgatcgacctgcgtgatgaaacactatttatgcgccagccggaagccatcttgcgtatgttctacaccatggtgcgcaacagtgcgatcaccggcatttactccaccacgctacgccagttacgccacgcccgtcgccatctgcaacaacctctgtgtaatattccggaagcgcgaaaactgtttttgagcattctgcgtcaccccggagcggtgcggcgcgggctattgccaatgcatcgccatagcgtgctcggcgcgtatatgccgcaatggtcgcatatcgtcgggcagatgcagtttgacctgttccatgcctacacggtggatgaacatactatccgcgtgatgctgaaactggagagttttgccagtgaagaaacgcgccagcgccatccgttgtgtgtggacgtctggccgcgcctgccgtcaactgagctgattttcatcgccgcgctgtttcacgatatcgccaaaggacgcggcggcgaccactccattctcggtgctcaggatgtagtgcattttgccgaactccacgggctgaactcacgcgaaacacagctggtcgcatggctggttcgccagcacttgctgatgtcggtgaccgctcagcgccgcgatattcaggacccggaagtcatcaagcaatttgccgaagaagttcaaacggaaaatcgtctgcgctatctggtatgcctgacagtggctgacatttgcgccaccaacgaaacactgtggaatagctggaagcaaagtctgttgcgcgaactctattttgccaccgaaaagcagctacgacgcggaatgcaaaacacgccggatatgcgcgaacgggttcgccatcaccaactccaggcgctggcactactgcgcatggataacatcgacgaagaggcgctgcaccaaatttggtcacgctgtcgcgctaactattttgtccgccatagcccaaatcaactggcctggcacgcacgccatttattacagcatgatttaagcaaaccgctggtactgcttagcccgcaggctacgcgtggaggcaccgagatttttatctggagcccggaccgcccctatctgtttgccgccgtctgtgccgaattagaccgccgcaatttaagtgttcacgacgcacaaattttcaccactcgcgacggtatggcgatggatacctttatagtgctggaacccgatggtagcccgctatccgcagatcgtcatgaggttattcggtttggtctggagcaagtactgacacaaagtagctggcagccaccgcagccccgtcgccaacccgccaaattgcgccattttactgttgaaaccgaagtgacgtttttgccgacccataccgaccgcaaatcgttcctcgaactgatcgccctcgaccaacctggactgctggcgcgagtcgggaaaatttttgccgatctgggaatttcgcttcatggcgcccgaattacaaccattggcgagcgagtagaagatttattcataattgccaccgctgaccggcgtgcgcttaataacgagttgcagcaggaagtgcatcagcggttgacagaggccctcaatccaaacgataaagggtga

SEQ ID NO: 564 - protein, 890 aa, Escherichia coli
MNTLPEQYANTALPTLSGQPQNPCAWPRDELTVGGIKAHIDTFQRWLGDAFDNGISAEQLIEARTEFIDQLLQRLWIEAGFSQIADLALVAVGGYGRGELHPLSDIDLLILSRKKLPDDQAQKVGELLTLLWDVKLEVGHSVRTLEECMLEGLSDLTVATNLIESRLLIGDVALFLELQKHIFSEGFWPSDKFYAAKVEEQNQRHQRYHGTSYNLEPDIKSSPGGLRDIHTLQWVARRHFGATSLDEMVGFGFLTSAERAELNECLHILWRIRFALHLVVSRYDNRLLFDRQLSVAQRLNYSGEGNEPVERMMKDYFRVTRRVSELNQMLLQLFDEAILALPADEKPRPIDDEFQLRGTLIDLRDETLFMRQPEAILRMFYTMVRNSAITGIYSTTLRQLRHARRHLQQPLCNIPEARKLFLSILRHPGAVRRGLLPMHRHSVLGAYMPQWSHIVGQMQFDLFHAYTVDEHTIRVMLKLESFASEETRQRHPLCVDVWPRLPSTELIFIAALFHDIAKGRGGDHSILGAQDVVHFAELHGLNSRETQLVAWLVRQHLLMSVTAQRRDIQDPEVIKQFAEEVQTENRLRYLVCLTVADICATNETLWNSWKQSLLRELYFATEKQLRRGMQNTPDMRERVRHHQLQALALLRMDNIDEEALHQIWSRCRANYFVRHSPNQLAWHARHLLQHDLSKPLVLLSPQATRGGTEIFIWSPDRPYLFAAVCAELDRRNLSVHDAQIFTTRDGMAMDTFIVLEPDGSPLSADRHEVIRFGLEQVLTQSSWQPPQPRRQPAKLRHFTVETEVTFLPTHTDRKSFLELIALDQPGLLARVGKIFADLGISLHGARITTIGERVEDLFIIATADRRALNNELQQEVHQRLTEALNPNDKG

SEQ ID NO: 565 - DNA, 795 bp, Escherichia coli
atggctatctcaatcaagaccccagaagatatcgaaaaaatgcgcgtcgctggccgactggctgccgaagtgctggagatgatcgaaccgtatgttaaaccgggcgtcagcaccggcgagctggatcgcatctgtaatgattacattgttaatgaacaacacgcggtttctgcctgcctcggctatcacggctatccgaaatccgtttgcatctctattaatgaagtggtgtgccacggtatcccggacgacgccaagctgctgaaagatggcgatatcgttaacattgatgtcaccgtaatcaaagatggtttccacggcgatacctcgaaaatgtttatcgtcggtaagccgaccatcatgggcgaacgtctgtgccgcatcacgcaagaaagcctgtacctggcgctacgcatggtaaaacctggcattaatctgcgcgaaatcggtgcggcaattcagaaatttgtcgaagcagaaggcttctccgtcgttcgtgaatattgtggacacggtattggtcgcggcttccacgaagaaccgcaggtgctgcactatgactcccgtgaaaccaacgtcgtgctgaaaccggggatgacgttcaccatcgagccaatggtcaacgcgggtaaaaaagagatccgcaccatgaaagatggctggacggtaaaaaccaaagatcgcagcttgtctgcacaatatgagcatactattgtggtgactgataacggctgcgaaattctgacgctacgcaaggatgacaccatcccggcgataatctcgcacgacgaataa

SEQ ID NO: 566 - protein, 264 aa, Escherichia coli
MAISIKTPEDIEKMRVAGRLAAEVLEMIEPYVKPGVSTGELDRICNDYIVNEQHAVSACLGYHGYPKSVCISINEVVCHGIPDDAKLLKDGDIVNIDVTVIKDGFHGDTSKMFIVGKPTIMGERLCRITQESLYLALRMVKPGINLREIGAAIQKFVEAEGFSVVREYCGHGIGRGFHEEPQVLHYDSRETNVVLKPGMTFTIEPMVNAGKKEIRTMKDGWTVKTKDRSLSAQYEHTIVVTDNGCEILTLRKDDTIPAIISHDE

SEQ ID NO: 567 - DNA, 930 bp, Escherichia coli
atgctctttcagcagctgaccaacagttttgcttggttccataacgaacggctgaccggtcagagaaacttcgccggtgaatttcttcatgcggccttcaaccattttctctgcgatttctttcggcttaccagactgcatcgcgatatccagctgtacctggtattctttttctaccacttcagcggatacgtcttctggtttgatgaattctggcttgcttgcagcaacgtgcatagcgatgtgtttaaccagctcttcgtcagcgcctttagcagcaaccagaacaccgatacgcgcaccgtgctgataagaacccagaacgtcgccttccagcgcagcaacgcggcgaatgttgatgttttcaccaattttcgctaccagcgcaacacgttcttcttcgaactgtgctttcagtacttcaacgtcagtgattttgccagcaacagctgcgtccagaactttgtctgcgaacgcctggaaaccagcgtcttttgcaacgaagtcagtctggcagttaacttccagaatgatgccgtagttgccgtcgattttggttttgatcacgccgtcagcagcaacgttgcctgcttttttcgctgctttaatagcaccggacttacgcatgttttcgattgccagctcgatgtcgccgttagcttcagtcagtgcttttttgcaatccatcatgcctgcgccagtacgctcacgcagctcttttaccagggatgcggtaatttcagccattctaaaatcctcggagatgtgatctgcccggcattaaaccgcacagatataaaagtgaaaaagggggccatatgcaggccccctaaccaaacgtgtactacctggtctataagggctcgtacgagcgtgccttattactcagcttctacgaagctttcttccgcctgggaagccagatcctga

SEQ ID NO: 568 - protein, 309 aa, Escherichia coli
MLFQQLTNSFAWFHNERLTGQRNFAGEFLHAAFNHFLCDFFRLTRLHRDIQLYLVFFFYHFSGYVFWFDEFWLACSNVHSDVFNQLFVSAFSSNQNTDTRTVLIRTQNVAFQRSNAANVDVFTNFRYQRNTFFFELCFQYFNVSDFASNSCVQNFVCERLETSVFCNEVSLAVNFQNDAVVAVDFGFDHAVSSNVACFFRCFNSTGLTHVFDCQLDVAVSFSQCFFAIHHACASTLTQLFYQGCGNFSHSKILGDVICPALNRTDIKVKKGAICRPPNQTCTTWSIRARTSVPYYSASTKLSSAWEARS

SEQ ID NO: 569 - DNA, 924 bp, Escherichia coli
ttggtgtccacgacgtatttgtggtataaagcgcgccggacttccgatccatttcgtatacacagactggacggaagcgacaatctcactttgtgtaacaacacacacgtatcggcacatattccggggtgccctttggggtcggtaatatgggatacgtggaggcataaccccaacttttatatagaggttttaatcatggcaactgtttccatgcgcgacatgctcaaggctggtgttcacttcggtcaccagacccgttactggaacccgaaaatgaagccgttcatcttcggtgcgcgtaacaaagttcacatcatcaaccttgagaaaactgtaccgatgttcaacgaagctctggctgaactgaacaagattgcttctcgcaaaggtaaaatccttttcgttggtactaaacgtgctgcaagcgaagcggtgaaagacgctgctctgagctgcgaccagttcttcgtgaaccatcgctggctgggcggtatgctgactaactggaaaaccgttcgtcagtccatcaaacgtctgaaagacctggaaactcagtctcaggacggtactttcgacaagctgaccaagaaagaagcgctgatgcgcactcgtgagctggagaaactggaaaacagcctgggcggtatcaaagacatgggcggtctgccggacgctctgtttgtaatcgatgctgaccacgaacacattgctatcaaagaggcaaacaacctgggtattccggtatttgctatcgttgataccaactctgatccggacggtgttgacttcgttatcccgggtaacgacgacgcaatccgtgctgtgaccctgtacctgggcgctgttgctgcaaccgtacgtgaaggccgttctcaggatctggcttcccaggcggaagaaagcttcgtagaagctgagtaa

SEQ ID NO: 570 - protein, 307 aa, Escherichia coli
MVSTTYLWYKARRTSDPFRIHRLDGSDNLTLCNNTHVSAHIPGCPLGSVIWDTWRHNPNFYIEVLIMATVSMRDMLKAGVHFGHQTRYWNPKMKPFIFGARNKVHIINLEKTVPMFNEALAELNKIASRKGKILFVGTKRAASEAVKDAALSCDQFFVNHRWLGGMLTNWKTVRQSIKRLKDLETQSQDGTFDKLTKKEALMRTRELEKLENSLGGIKDMGGLPDALFVIDADHEHIAIKEANNLGIPVFAIVDTNSDPDGVDFVIPGNDDAIRAVTLYLGAVAATVREGRSQDLASQAEESFVEAE

SEQ ID NO: 571 - DNA, 852 bp, Escherichia coli
atggctgaaattaccgcatccctggtaaaagagctgcgtgagcgtactggcgcaggcatgatggattgcaaaaaagcactgactgaagctaacggcgacatcgagctggcaatcgaaaacatgcgtaagtccggtgctattaaagcagcgaaaaaagcaggcaacgttgctgctgacggcgtgatcaaaaccaaaatcgacggcaactacggcatcattctggaagttaactgccagactgacttcgttgcaaaagacgctggtttccaggcgttcgcagacaaagttctggacgcagctgttgctggcaaaatcactgacgttgaagtactgaaagcacagttcgaagaagaacgtgttgcgctggtagcgaaaattggtgaaaacatcaacattcgccgcgttgctgcgctggaaggcgacgttctgggttcttatcagcacggtgcgcgtatcggtgttctggttgctgctaaaggcgctgacgaagagctggttaaacacatcgctatgcacgttgctgcaagcaagccagaattcatcaaaccagaagacgtatccgctgaagtggtagaaaaagaataccaggtacagctggatatcgcgatgcagtctggtaagccgaaagaaatcgcagagaaaatggttgaaggccgcatgaagaaattcaccggcgaagtttctctgaccggtcagccgttcgttatggaaccaagcaaaactgttggtcagctgctgaaagagcataacgctgaagtgactggcttcatccgcttcgaagtgggtgaaggcatcgagaaagttgagactgactttgcagcagaagttgctgcgatgtccaagcagtcttaa

SEQ ID NO: 572 - protein, 283 aa, Escherichia coli
MAEITASLVKELRERTGAGMMDCKKALTEANGDIELAIENMRKSGAIKAAKKAGNVAADGVIKTKIDGNYGIILEVNCQTDFVAKDAGFQAFADKVLDAAVAGKITDVEVLKAQFEEERVALVAKIGENINIRRVAALEGDVLGSYQHGARIGVLVAAKGADEELVKHIAMHVAASKPEFIKPEDVSAEVVEKEYQVQLDIAMQSGKPKEIAEKMVEGRMKKFTGEVSLTGQPFVMEPSKTVGQLLKEHNAEVTGFIRFEVGEGIEKVETDFAAEVAAMSKQS

SEQ ID NO: 573 - DNA, 726 bp, Escherichia coli
atggctaccaatgcaaaacccgtctataaacgcattctgcttaagttgagtggcgaagctctgcagggcactgaaggcttcggtattgatgcaagcatactggatcgcatggctcaggaaatcaaagaactggttgaactgggtattcaggttggtgtggtgattggtgggggtaacctgttccgtggcgctggtctggcgaaagcgggtatgaaccgcgttgtgggcgaccacatggggatgctggcgaccgtaatgaacggcctggcaatgcgtgatgcactgcaccgcgcctatgtgaacgctcgtctgatgtccgctattccattgaatggcgtgtgcgacagctacagctgggcagaagctatcagcctgttgcgcaacaaccgtgtggtgatcctctccgccggtacaggtaacccgttctttaccaccgactcagcagcttgcctgcgtggtatcgaaattgaagccgatgtggtgctgaaagcaaccaaagttgacggcgtgtttactgctgatccggcgaaagatccaaccgcaaccatgtacgagcaactgacttacagcgaagtgctggaaaaagagctgaaagtcatggacctggcggccttcacgcttgctcgtgaccataaattaccgattcgtgttttcaacatgaacaaaccgggtgcgctgcgccgtgtggtaatgggtgaaaaagaagggactttaatcacggaataa

SEQ ID NO: 574 - protein, 241 aa, Escherichia coli
MATNAKPVYKRILLKLSGEALQGTEGFGIDASILDRMAQEIKELVELGIQVGVVIGGGNLFRGAGLAKAGMNRVVGDHMGMLATVMNGLAMRDALHRAYVNARLMSAIPLNGVCDSYSWAEAISLLRNNRVVILSAGTGNPFFTTDSAACLRGIEIEADVVLKATKVDGVFTADPAKDPTATMYEQLTYSEVLEKELKVMDLAAFTLARDHKLPIRVFNMNKPGALRRVVMGEKEGTLITE

SEQ ID NO: 575 - DNA, 558 bp, Escherichia coli
gtgattagcgatatcagaaaagatgctgaagtacgcatggataaatgcgtagaagcgttcaaaacccaaatcagcaaaatacgcacgggtcgtgcttctcccagcctgctggatggcattgtcgtggaatattacggcacgccgacgccgctgcgtcagctggcaagcgtaacggtagaagattcccgtactctgaaaatcaacgtgtttgatcgttcaatgtctccggccgttgaaaaagcgattatggcgtccgatcttggcctgaacccgaactctgcgggtagcgacatccgtgttccgctgccgccgctgacggaagaacgtcgtaaagatctgaccaaaatcgttcgtggtgaagcagaacaagcgcgtgttgcagtacgtaatgtgcgtcgtgacgcgaacgacaaagtgaaagcactgttgaaagataaagagattagcgaagacgacgatcgccgttctcaggacgatgtacagaaactgactgatgctgcaatcaagaaaattgaagcggcgctggcagacaaagaagcagaactgatgcagttctga

SEQ ID NO: 576 - protein, 185 aa, Escherichia coli [sequence omitted]

SEQ ID NO: 577 - DNA, 1197 bp, Escherichia coli
atgaagcaactcaccattctgggctcgaccggctcgattggttgcagcacgctggacgtggtgcgccataatcccgaacacttccgcgtagttgcgctggtggcaggcaaaaatgtcgctcgcatggtagaacagtgcctggaattctctccccgctatgctgtaatggacgatgaagcgagtgcgaaacttcttaaaacgatgctacagcaacagggtagccgcaccgaagtcttaagtgggcaacaagccgcttgcgatatggcagcgcttgaggatgttgatcaggtgatggcagccattgttggcgctgctgggctgttacctacgcttgctgcgatccgcgcgggtaaaaccattttgctggccaataaagaatcactggttacctgcggacgtctgtttatggacgccgtaaagcagagcaaagcgcaattgttaccggtcgatagcgaacataacgccatttttcagagtttaccgcaacctatccagcataatctgggatacgctgaccttgagcaaaatggcgtggtgtccattttacttaccgggtctggtggccctttccgtgagacgccattgcgcgatttggcaacaatgacgcccgatcaagcctgccgtcatccgaactggtcgatgggacgtaaaatttctgtcgattcggctaccatgatgaacaaaggtctggaatacattgaagcgcgttggctgtttaacgccagcgccagccagatggaagtgctgattcacccgcagtcagtgattcactcaatggtgcgctatcaggacggcagtgttctggcgcagctgggggaaccggatatgcgtacgccaattgcccacaccatggcatggccgaatcgcgtgaactctggcgtgaagccgctcgatttttgcaaactaagtgcgttgacatttgccgcaccggattatgatcgttatccatgcctgaaactggcgatggaggcgttcgaacaaggccaggcagcgacgacagcattgaatgccgcaaacgaaatcaccgtggctgcttttcttgcgcaacaaatccgctttacggatatcgccgcgttgaatttatccgtactggaaaaaatggatatgcgcgaaccacaatgtgtggatgatgtgttatctgttgatgcgaacgcgcgtgaagtcgccagaaaagaggtgatgcgtctcgcaagctga

SEQ ID NO: 578 - protein, 398 aa, Escherichia coli
MKQLTILGSTGSIGCSTLDVVRHNPEHFRVVALVAGKNVARMVEQCLEFSPRYAVMDDEASAKLLKTMLQQQGSRTEVLSGQQAACDMAALEDVDQVMAAIVGAAGLLPTLAAIRAGKTILLANKESLVTCGRLFMDAVKQSKAQLLPVDSEHNAIFQSLPQPIQHNLGYADLEQNGVVSILLTGSGGPFRETPLRDLATMTPDQACRHPNWSMGRKISVDSATMMNKGLEYIEARWLFNASASQMEVLIHPQSVIHSMVRYQDGSVLAQLGEPDMRTPIAHTMAWPNRVNSGVKPLDFCKLSALTFAAPDYDRYPCLKLAMEAFEQGQAATTALNAANEITVAAFLAQQIRFTDIAALNLSVLEKMDMREPQCVDDVLSVDANAREVARKEVMRLAS

SEQ ID NO: 579 - DNA, 762 bp, Escherichia coli
gtgatgttgtctgctactcaaccacttagcgaaaaattgccagcgcatggctgtcgtcatgttgcgatcattatggacggcaatggtcgctgggcaaaaaagcaagggaagattcgtgcctttgggcataaagccggggcaaaatccgtccgccgggctgtctcttttgcggccaacaacggtattgaggcgttaacgctgtatgcctttagtagtgaaaactggaaccgaccagcgcaggaagtcagtgcgttaatggaactgtttgtgtgggcgctagatagcgaagtaaaaagtctgcaccgacataacgtgcgtctgcgtattattggcgataccagtcgctttaactcgcgtttgcaagaacgtattcgtaaatctgaagcgctaacagccgggaataccggtctgacgctgaatattgcggcgaactacggtggacgttgggatatagtccagggagtcaggcaactggctgaaaaggtgcagcaaggaaacctgcaaccagatcagatagatgaagagatgctaaaccagcatgtctgtatgcatgaactggcccctgtagatttagtaattaggactgggggggagcatcgcattagtaactttttgctttggcaaattgcctatgccgaactttactttacagatgttctctggcccgatttcgatgaacaagactttgaaggggcgttaaatgcctttgctaatcgagagcgtcgtttcggcggcaccgagcccggtgatgaaacagcctga

SEQ ID NO: 580 - protein, 253 aa, Escherichia coli
MMLSATQPLSEKLPAHGCRHVAIIMDGNGRWAKKQGKIRAFGHKAGAKSVRRAVSFAANNGIEALTLYAFSSENWNRPAQEVSALMELFVWALDSEVKSLHRHNVRLRIIGDTSRFNSRLQERIRKSEALTAGNTGLTLNIAANYGGRWDIVQGVRQLAEKVQQGNLQPDQIDEEMLNQHVCMHELAPVDLVIRTGGEHRISNFLLWQIAYAELYFTDVLWPDFDEQDFEGALNAFANRERRFGGTEPGDETA

SEQ ID NO: 581 - DNA, 828 bp, Escherichia coli
gtgttaatacccgtcgtcatcgcggcgttgtttctgttgccgccggtggggttcgccattgtaacgctggtggtctgtatgctggcagcgtgggaatggggacagcttagcggttttaccactcgttcgcagcgagtatggttggcggtgttatgcgggttattgttggcgctgatgctttttctgttgccggaatatcaccgaaatattcatcaaccgctggttgaaatctcactttgggcttcgctgggttggtggattgtcgcgctattgctggtgctgttttacccaggttccgcagcaatctggcgtaactctaaaacattgcgcattatttttggcgtgctaaccattgttcccttcttctggggcatgctggcgttacgggcctggcactacgacgagaatcattacagtggcgcaatatggctgctctatgtcatgatcctggtatggggcgctgactctggcgcatatatgtttggcaaattgtttggtaaacataaactagcaccgaaggtttctccgggtaaaacctggcaaggctttatcggtggactagtgaccgcagcggtaatctcatggggttatggcatgtgggtgaatctcgacgtcgctcccgtcaccttactcatttgctctattgtcgcagcgttagcctcagtgctcggcgatctgaccgaaagtatgtttaagcgtgaagcaggaattaaggacagcggtcatttaattccaggacacggtggtattttagatcgtattgatagcctgacggctgcggtaccggtctttgcttgcttgttgttactggtattcaggacgctttaa

SEQ ID NO: 582 - protein, 275 aa, Escherichia coli
MLIPVVIAALFLLPPVGFAIVTLVVCMLAAWEWGQLSGFTTRSQRVWLAVLCGLLLALMLFLLPEYHRNIHQPLVEISLWASLGWWIVALLLVLFYPGSAAIWRNSKTLRIIFGVLTIVPFFWGMLALRAWHYDENHYSGAIWLLYVMILVWGADSGAYMFGKLFGKHKLAPKVSPGKTWQGFIGGLVTAAVISWGYGMWVNLDVAPVTLLICSIVAALASVLGDLTESMFKREAGIKDSGHLIPGHGGILDRIDSLTAAVPVFACLLLLVFRTL

SEQ ID NO: 583 - DNA, 1398 bp, Escherichia coli
ttgcttgttgttactggtattcaggacgctttaacggaaggtaatatgctgagttttctctgggatttggcttcgttcatcgttgcactgggtgtacttatcaccgtgcatgaatttggtcatttctgggttgcccggcgttgtggtgttcgcgttgagcgtttctcaatagggtttggtaaggcgctctggcggcgaactgataagctcggcaccgaatatgttatcgccctgatcccgttgggcggttatgtcaaaatgctggatgagcgcgcagaaccggtcgttccggaactccgccaccatgccttcaataataaatctgtcggccaacgagcggcgattattgccgcaggtccggttgcaaacttcatttttgctatctttgcctactggctggtttttattattggtgtgcctggcgtacgtccggtggttggtgaaatagcagccaattcgatagctgcggaagcacaaattgcaccaggtacggaactaaaagccgtagatggtatcgaaacgcctgattgggatgccgtgcgtttgcagttggtcgataaaattggcgatgaaagcaccaccattacggtagcgccatttggcagcgaccaacggcgggatgtaaagctcgatttacgtcactgggcgtttgagcctgataaagaagatccggtatcttcgttggggattcgtcctcgtgggccgcaaattgaacctgtactggaaaatgtgcagccaaactcggcggcaagcaaggcaggtttgcaagcaggcgacaggatcgttaaagtcgatggtcagcccttaacgcagtgggtgacctttgtgatgcttgtccgggataacccgggtaaatccttagcgttagaaatcgaaaggcaggggagtcccttgtctttgacattaatcccggagagtaaaccgggtaagggtaaagcgattggttttgtcggtattgagccgaaagtcattcctttgccagatgagtataaagttgtacgccagtatgggccgttcaacgctatcgtcgaagccacggacaaaacgtggcagttgatgaagctgacggtcagtatgctgggaaaattgatcaccggtgatgtgaaactgaacaacctcagtgggccgatctctatcgccaagggggctgggatgacagcggaactcggggtagtttattacctgccgtttcttgcgcttattagcgtgaacttagggataattaacctgtttccgttgcccgtacttgacggggggcatctgctgttccttgcgatcgaaaagatcaagggcggaccggtatccgagcgggttcaagacttttgttatcgcattggctcgattctgctggtgctgttaatggggcttgcacttttcaatgatttctctcggttatga

SEQ ID NO: 584 - protein, 465 aa, Escherichia coli
MLVVTGIQDALTEGNMLSFLWDLASFIVALGVLITVHEFGHFWVARRCGVRVERFSIGFGKALWRRTDKLGTEYVIALIPLGGYVKMLDERAEPVVPELRHHAFNNKSVGQRAAIIAAGPVANFIFAIFAYWLVFIIGVPGVRPVVGEIAANSIAAEAQIAPGTELKAVDGIETPDWDAVRLQLVDKIGDESTTITVAPFGSDQRRDVKLDLRHWAFEPDKEDPVSSLGIRPRGPQIEPVLENVQPNSAASKAGLQAGDRIVKVDGQPLTQWVTFVMLVRDNPGKSLALEIERQGSPLSLTLIPESKPGKGKAIGFVGIEPKVIPLPDEYKVVRQYGPFNAIVEATDKTWQLMKLTVSMLGKLITGDVKLNNLSGPISIAKGAGMTAELGVVYYLPFLALISVNLGIINLFPLPVLDGGHLLFLAIEKIKGGPVSERVQDFCYRIGSILLVLLMGLALFNDFSRL

SEQ ID NO: 585 - DNA, 2433 bp, Escherichia coli
atggcgatgaaaaagttgctcatagcgtcgctgctgtttagcagcgccaccgtatacggtgctgaagggttcgtagtgaaagatattcatttcgaaggccttcagcgtgtcgccgttggtgcggccctcctcagtatgccggtgcgcacaggcgacacggttaatgatgaagatatcagtaataccattcgcgctctgtttgctaccggcaactttgaggatgttcgcgtccttcgtgatggtgatacccttctggttcaggtaaaagaacgtccgaccattgccagcattactttctccggtaacaaatcggtgaaagatgacatgctgaagcaaaacctcgaggcttctggtgtgcgtgtgggcgaatccctcgatcgcaccaccattgccgatatcgagaaaggtctggaagacttctactacagcgtcggtaaatatagcgccagcgttaaagctgtcgtgaccccgctgccgcgcaaccgtgttgacctaaaactggtgttccaggaaggtgtgtcagctgaaatccagcaaattaacattgttggtaaccatgctttcaccaccgatgaactgatctctcatttccaactgcgtgacgaagtgccgtggtggaacgtggtaggcgatcgtaaataccagaaacagaaactggcgggcgaccttgaaaccctgcgcagttactatctggatcgcggttatgcccgtttcaacatcgattctacccaggtcagtctgacgccagataaaaaaggtatttacgtcacggtgaacatcaccgaaggcgatcagtacaagctttctggcgttgaagttagcggcaatcttgccgggcactccgctgaaattgagcaactgactaagatcgagccgggcgagctgtataacggcaccaaagtgaccaaaatggaagatgacattaaaaagcttcttggtcgctatggttatgcctatccgcgcgtacagtcgatgcctgaaattaacgatgccgacaaaaccgttaaattacgcgtgaacgttgatgcgggtaaccgtttctatgtgcgtaagatccgttttgaaggtaacgatacctcgaaagatgccgtcctgcgtcgcgaaatgcgtcagatggaaggtgcatggctggggagcgatctggtcgatcagggtaaggagcgtctgaaccgtctgggcttctttgaaactgtcgataccgatacccaacgtgttccggggagcccggatcaggttgatgtagtttacaaggtgaaagaacgtaacactggtagcttcaacttcgggattggttacggtactgaaagtggcgtgagcttccaggctggcgtgcaacaggataactggttaggtacaggttatgctgttggtatcaacgggaccaaaaacgattaccagacctatgctgaactgtcggtaaccaacccgtacttcaccgtagatggtgtaagcctcggtggtcgtctcttctataatgacttccaggcagatgacgccgacctgtccgactataccaacaagagttatggtacagacgtgacgttgggcttcccgatcaacgaatataactcgctgcgtgcaggtctgggttatgtacataactccctgtccaacatgcagcctcaggttgcgatgtggcgttatctgtactctatgggtgaacatccgagcacctctgatcaggataacagcttcaaaacggacgacttcacgttcaactatggttggacctataacaagcttgaccgtggttacttcccgacagatggttcacgtgtcaacctgaccggtaaagtgaccattccgggatcggataacgaatactacaaagtgacgttagacacggcgacttatgtgccgattgatgacgatcacaaatgggttgttctgggtcgtacccgctggggttatggtgatggtttaggcggcaaagagatgccgttctatgagaacttctatgccggtggttccagcaccgtgcgtggcttccagtccaataccattggtccgaaagcagtttacttcccgcatcaggccagtaattatgatccggactatgattacgaatgtgcgactcaggacggcgcgaaagatctgtgtaaatcggatgatgctgtaggcggtaacgccatggcggttgccagcctcgagttcatcaccccgacgccgtttattagcgataagtatgctaactcggttcgtacttccttcttctgggatatgggtaccgtttgggatacaaactgggattccagccaatattctggatatccggactatagtgatccaagcaatatccgtatgtctgcgggtatcgcattacaatggatgtccccattggggccgttggtgttctcctacgcccagccgttcaaaaagtacgatggagacaaggcagaacagttccagtttaacatcggtaaaacctggtaa

SEQ ID NO: 586 - protein, 810 aa, Escherichia coli
MAMKKLLIASLLFSSATVYGAEGFVVKDIHFEGLQRVAVGAALLSMPVRTGDTVNDEDISNTIRALFATGNFEDVRVLRDGDTLLVQVKERPTIASITFSGNKSVKDDMLKQNLEASGVRVGESLDRTTIADIEKGLEDFYYSVGKYSASVKAVVTPLPRNRVDLKLVFQEGVSAEIQQINIVGNHAFTTDELISHFQLRDEVPWWNVVGDRKYQKQKLAGDLETLRSYYLDRGYARFNIDSTQVSLTPDKKGIYVTVNITEGDQYKLSGVEVSGNLAGHSAEIEQLTKIEPGELYNGTKVTKMEDDIKKLLGRYGYAYPRVQSMPEINDADKTVKLRVNVDAGNRFYVRKIRFEGNDTSKDAVLRREMRQMEGAWLGSDLVDQGKERLNRLGFFETVDTDTQRVPGSPDQVDVVYKVKERNTGSFNFGIGYGTESGVSFQAGVQQDNWLGTGYAVGINGTKNDYQTYAELSVTNPYFTVDGVSLGGRLFYNDFQADDADLSDYTNKSYGTDVTLGFPINEYNSLRAGLGYVHNSLSNMQPQVAMWRYLYSMGEHPSTSDQDNSFKTDDFTFNYGWTYNKLDRGYFPTDGSRVNLTGKVTIPGSDNEYYKVTLDTATYVPIDDDHKWVVLGRTRWGYGDGLGGKEMPFYENFYAGGSSTVRGFQSNTIGPKAVYFPHQASNYDPDYDYECATQDGAKDLCKSDDAVGGNAMAVASLEFITPTPFISDKYANSVRTSFFWDMGTVWDTNWDSSQYSGYPDYSDPSNIRMSAGIALQWMSPLGPLVFSYAQPFKKYDGDKAEQFQFNIGKTW

SEQ ID NO: 587 - DNA, 486 bp, Escherichia coli
gtgaaaaagtggttattagctgcaggtctcggtttagcactggcaacttctgctcaggcggctgacaaaattgcaatcgtcaatatgggcagcctgttccagcaggtagcgcagaaaaccggtgtttctaacacgctggaaaacgagttcaaaggccgtgccagcgaactgcagcgtatggaaaccgatctgcaggctaaaatgaaaaagctgcagtccatgaaagcgggcagcgatcgcactaagctggaaaaagacgtgatggctcagcgccagacttttgctcagaaagcgcaggcttttgagcaggatcgcgcacgtcgttccaacgaagaacgcggcaaactggttactcgtatccagactgctgtgaaatccgttgccaacagccaggatatcgatctggttgttgatgcaaatgccgttgcttacaacagcagcgatgtaaaagacatcactgccgacgtactgaaacaggttaaataa

SEQ ID NO: 588 - protein, 161 aa, Escherichia coli
MKKWLLAAGLGLALATSAQAADKIAIVNMGSLFQQVAQKTGVSNTLENEFKGRASELQRMETDLQAKMKKLQSMKAGSDRTKLEKDVMAQRQTFAQKAQAFEQDRARRSNEERGKLVTRIQTAVKSVANSQDIDLVVDANAVAYNSSDVKDITADVLKQVK

SEQ ID NO: 589 - DNA, 1026 bp, Escherichia coli
atgccttcaattcgactggctgatttagcgcagcagttggatgcagaactacacggtgatggcgatatcgtcatcaccggcgttgcgtccatgcaatctgcacaaacaggtcacattacgttcatggttaaccccaaataccgtgagcatttaggcttgtgccaggcgtccgcggttgtcatgacccaggacgatcttcctttcgcgaaaagtgccgcgctggtagtgaagaatccctacctgacttacgcgcgcatggcgcaaattttagataccacgccgaagcccgcgcagaacattgcacccagtgcggtgattgacgagacagcgaagctgggtaacaacgtatcgattggcgctaacgcggtgattgagtctggcgttgaactgggcgataacgtgattatcggtgccggttgcttcgtaggtaaaaacagcaaaatcggtgcaggttcgcgtctctgggcgaacgtaaccatttaccatgagatccagatcggtcagaattgtctgatccagtccggaacagtggtaggcgcagacggctttggttatgccaacgatcgtggtaactgggtgaagatcccacagattggtcgcgtaattattggcgatcgcgtggagatcggtgcctgcactaccattgatcgtggcgcgctggatgacactgttattggcaatggtgtgatcattgataaccagtgccagattgcacataacgtcgtgattggcgacaatacggcagttgccggtggcgtcattatggcgggcagcctgaaaattggtcgttactgcatgatcggcggagccagcgtaatcaacgggcatatggaaatatgcgacaaagtgacggttacgggcatgggtatggtgatgcgtcccatcactgaaccaggcgtctattcctcaggcattccgctgcaacccaacaaagtctggcgcaaaaccgctgcactggtgatgaacattgatgacatgagcaagcgtctgaaatcgcttgagcgcaaggttaatcaacaagactaa

SEQ ID NO: 590 - protein, 341 aa, Escherichia coli
MPSIRLADLAQQLDAELHGDGDIVITGVASMQSAQTGHITFMVNPKYREHLGLCQASAVVMTQDDLPFAKSAALVVKNPYLTYARMAQILDTTPKPAQNIAPSAVIDETAKLGNNVSIGANAVIESGVELGDNVIIGAGCFVGKNSKIGAGSRLWANVTIYHEIQIGQNCLIQSGTVVGADGFGYANDRGNWVKIPQIGRVIIGDRVEIGACTTIDRGALDDTVIGNGVIIDNQCQIAHNVVIGDNTAVAGGVIMAGSLKIGRYCMIGGASVINGHMEICDKVTVTGMGMVMRPITEPGVYSSGIPLQPNKVWRKTAALVMNIDDMSKRLKSLERKVNQQD

SEQ ID NO: 591 - DNA, 549 bp, Escherichia coli
ttgttcgccaaactttacggcctgtctcattcttacgattgcggcaggccgtgttattattgtcgtttcttatattttgacaggaagagtatcttgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgctggtattgacgaagcgcgcttcaagcgcccggtcgtgcctggcgatcaaatgatcatggaagtcactttcgaaaaaacgcgccgcggcctgacccgttttaaaggggttgctctggtcgacggtaaagtagtttgcgaagcaacgatgatgtgtgctcgtagccgggaggcctga

SEQ ID NO: 592 - protein, 182 aa, Escherichia coli
MFAKLYGLSHSYDCGRPCYYCRFLYFDRKSILTTNTHTLQIEEILELLPHRFPFLLVDRVLDFEEGRFLRAVKNVSVNEPFFQGHFPGKPIFPGVLILEAMAQATGILAFKSVGKLEPGELYYFAGIDEARFKRPVVPGDQMIMEVTFEKTRRGLTRFKGVALVDGKVVCEATMMCARSREA

SEQ ID NO: 593 - DNA, 789 bp, Escherichia coli
gtgattgataaatccgcctttgtgcatccaaccgccattgtggaagagggcgcgtcgattggcgcgaacgctcacattggtcctttttgtatcgttggaccccatgtcgaaattggtgagggtaccgtactgaaatctcacgttgtcgtgaatggtcatactaaaattggccgcgataatgagatttatcagttcgcctccatcggcgaagttaaccaggatctgaaatatgctggcgaaccgacccgcgtggaaatcggcgatcgtaaccgcattcgcgaaagcgtcaccattcatcgtggcacagtccagggcggtggattgacgaaggtgggcagcgacaacttactgatgatcaatgcgcacattgcgcacgattgtacggtaggtaaccgctgcatcctcgccaacaacgcaacgctggcgggtcacgtatcggttgacgacttcgcgatcatcggcggcatgaccgcagtccatcagttctgcatcattggtgcgcatgtgatggttggcggctgctccggtgtggcgcaggacgtccctccttatgtcattgcgcagggtaaccacgcaacgccgttcggtgtcaatatcgaagggctgaagcgccgcggattcagccgtgaggcgattaccgctatccgcaatgcgtataagctgatttatcgtagcggtaaaacgctcgatgaagtgaaaccggaaattgctgaactggcggaaacatatccggaagtgaaagcctttaccgatttctttgcacgctcaacgcgcggtctgattcgttaa

SEQ ID NO: 594 - protein, 262 aa, Escherichia coli
MIDKSAFVHPTAIVEEGASIGANAHIGPFCIVGPHVEIGEGTVLKSHVVVNGHTKIGRDNEIYQFASIGEVNQDLKYAGEPTRVEIGDRNRIRESVTIHRGTVQGGGLTKVGSDNLLMINAHIAHDCTVGNRCILANNATLAGHVSVDDFAIIGGMTAVHQFCIIGAHVMVGGCSGVAQDVPPYVIAQGNHATPFGVNIEGLKRRGFSREAITAIRNAYKLIYRSGKTLDEVKPEIAELAETYPEVKAFTDFFARSTRGLIR

SEQ ID NO: 595 - DNA, 1149 bp, Escherichia coli
atgactgaacagcgtccattaacgattgccctggtcgccggagaaacctccggcgatatcctgggggccggtttaatccgcgctctgaaagaacgtgtgcccaacgcccgctttgttggtgttgccgggccacgaatgcaggctgaaggctgcgaagcctggtacgaaatggaagaactggcagtgatgggcattgttgaagtgctcggtcgtctgcgtcgcttactacatattcgtgccgatctgacaaagcgttttggcgaactgaagccagatgtttttgttggtattgatgcgcctgacttcaatattactcttgaaggtaacctcaaaaagcagggtatcaaaaccattcattacgtcagtccgtccgtctgggcgtggcgacagaaacgcgttttcaaaataggcagagccaccgatctggtgctcgcatttctgcctttcgaaaaagcgttttatgacaaatacaacgtaccgtgccgctttatcggtcataccatggctgatgccatgccattagatccagataaaaatggtgcccgtgatgtgctggggatcccttacgatgcccactgtctggcattgttgccgggcagccgtggtgcagaagtcgaaatgcttagtgccgatttcctgaaaacggcccagcttttgcgccagacatatccggatctcgaaatcgtggtgccgctggtgaatgccaaacgccgcgagcagtttgaacgcatcaaagctgcagtcgcgccagacctgtcggttcatttgctggatggaatgggccgtgaggcgatggtcgccagtgatgcggcgctactggcgtcgggtacggcagcactggagtgtatgctggctaaatgcccgatggtagtgggatatcgcatgaagcctttcaccttctggctggcgaagcgactggtgaaaactgattatgtctcgctgccaaatctgctggcgggcagagagttagtcaaagagttattgcaggaagagtgtgagccgcaaaaattggctgcggcgctgttaccgctgttggcgaacgggaaaaccagccatgcgatgcacgacaccttccgcgagctgcatcagcagatccgctgcaatgccgatgagcaggcggcacaagccgttctggagttagcacaatga

SEQ ID NO: 596 - protein, 382 aa, Escherichia coli
MTEQRPLTIALVAGETSGDILGAGLIRALKERVPNARFVGVAGPRMQAEGCEAWYEMEELAVMGIVEVLGRLRRLLHIRADLTKRFGELKPDVFVGIDAPDFNITLEGNLKKQGIKTIHYVSPSVWAWRQKRVFKIGRATDLVLAFLPFEKAFYDKYNVPCRFIGHTMADAMPLDPDKNGARDVLGIPYDAHCLALLPGSRGAEVEMLSADFLKTAQLLRQTYPDLEIVVPLVNAKRREQFERIKAAVAPDLSVHLLDGMGREAMVASDAALLASGTAALECMLAKCPMVVGYRMKPFTFWLAKRLVKTDYVSLPNLLAGRELVKELLQEECEPQKLAAALLPLLANGKTSHAMHDTFRELHQQIRCNADEQAAQAVLELAQ

SEQ ID NO: 597 - DNA, 597 bp, Escherichia coli
atgatcgaatttgtctatccgcacacgcagctggttgcgggtgtggatgaagtcggacgcgggccgttagttggcgcggtcgtcaccgctgcggtgatccttgacccggcgcgcccaattgccgggctgaatgattccaaaaagctgagcgaaaaacgccgtctggtgctctgtgaagagatcaaagagaaagcgttgagctggagtctgggccgcgcggaacctcacgaaatcgacgaactgaatattttacatgcgaccatgctggcgatgcagcgtgccgtcgctggactgcatattgcgccggaatatgtgttgattgatggtaaccgctgcccgaaattaccgatgccttcgatggctgtggtgaaaggcgatagccgcgtaccggaaatcagtgccgcgtctatcctggcgaaagtgacgcgtgacgccgaaatggcagcgctggatattgttttcccgcaatatggttttgcccaacacaaagggtatccaaccgcttttcatctggaaaaactggctgaacacggcgcgaccgaacaccatcggcgcagctttgggcctgtcaaacgcgcactgggacttgcgtcctga

SEQ ID NO: 598 - protein, 198 aa, Escherichia coli
MIEFVYPHTQLVAGVDEVGRGPLVGAVVTAAVILDPARPIAGLNDSKKLSEKRRLVLCEEIKEKALSWSLGRAEPHEIDELNILHATMLAMQRAVAGLHIAPEYVLIDGNRCPKLPMPSMAVVKGDSRVPEISAASILAKVTRDAEMAALDIVFPQYGFAQHKGYPTAFHLEKLAEHGATEHHRRSFGPVKRALGLAS

SEQ ID NO: 599 - DNA, 3384 bp, Escherichia coli
ttgggtatgccagcactggcgatcaccgatttcaccaacctttgcggtctggtgaagttctacggagcgggacatggcgcagggattaagcccatcgtcggggcggattttaacgtccagtgcgacctgctgggtgatgagttaactcacctgacggtgctggcggcgaacaataccggctatcagaatctgacgttgctgatctcaaaagcgtatcagcgcgggtacggtaccgccgggccgatcatcgatcgcgactggcttatcgaattaaatgaagggttgatccttctttccggcgggcgcatgggcgacgttggacgcagtcttttgcgtggtaacagcgcgctggtagatgagtgtgtcgcgttttatgaagaacacttcccggatcgctattttctcgagctgatccgcaccggcaggccggacgaagaaagctatctgcacgctgcggtggaactggcggaagcacgcggtttgcccgttgtggcgaccaacgacgtgcgctttatcgacagcagcgactttgacgcacacgaaatccgcgtcgcgattcacgacggctttaccctagacgatcctaaacgcccgcgtaactattcgccgcagcaatatatgcgtagcgaagaggagatgtgcgagctttttgccgacattcccgaagcccttgccaacaccgttgagatagccaaacgttgtaacgtaactgtgcgtctgggtgaatacttcttgccgcaattcccgaccggggacatgagtaccgaagattatctggtcaagcgtgcaaaagaaggcctggaagagcgtctggcatttttattccctgacgaggaagaacgtcttaagcgtcgtccggagtatgacgaacgtctggatactgaacttcaggttatcaaccagatgggcttcccgggttacttcctcatcgttatggaatttatccagtggtcgaaagataacggtgtaccggtagggccaggccgtggttctggtgcagggtcactggtggcctacgcgttaaaaatcaccgatctcgatccgctggaatttgacctgctgttcgaacgtttccttaacccggaacgtgtctccatgcctgacttcgacgttgacttctgtatggagaaacgtgaccaggttatcgaacatgtggcggacatgtacggtcgcgatgcggtatcgcagattatcaccttcggtacgatggcggcgaaagcggtgatccgcgacgtaggccgtgtattggggcatccgtacggatttgtcgatcgtatctcgaaactgatcccgcccgatccgggtatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattactgattttgcgccgctttattgcgatgaagagggcaaacatccggtcacccagtttgataaaagcgacgttgaatacgccgggctggtgaagttcgacttcctcggtttgcgtacgctcaccatcatcaactgggcgctggagatgatcaacaagcggcgggcgaagaatggcgagccgccgctggatatcgccgcgatcccgctggatgacaagaaaagcttcgacatgctgcaacgctcggaaaccacggcggtattccagcttgaatcgcgcggcatgaaggacctgatcaagcgtctgcaacctgactgcttcgaagatatgatcgcactggtggcactgttccgccccggtccgttgcaatcagggatggtggataactttatcgaccgtaaacatggtcgcgaagagatctcctatccggacgtgcagtggcagcatgaaagcctgaaaccggtactggagccaacctacggcatcatcctgtatcaggaacaggtcatgcagattgcccaggtgctttctggttataccctcggtggcgcggatatgctgcgtcgtgcgatgggtaagaaaaagccggaagagatggctaagcagcgttctgtatttgctgaaggtgcagaaaagaacggaatcaacgccgaactggcgatgaaaatcttcgacctggtggagaaattcgctggttacggatttaacaaatcgcactctgcggcctatgctttggtgtcatatcaaactttatggctgaaagcgcactatccggcggagtttatggcggcggtaatgaccgccgatatggacaacaccgagaaggtggtgggcctggtggatgagtgctggcggatggggctgaaaatcctgccaccagatataaactccggtctttaccatttccacgtcaacgacgacggcgaaatcgtgtatggtattggcgcgatcaaaggggtaggtgaaggcccgattgaggccatcatcgaagcccgtaataaaggcggctacttccgcgaactgtttgatctctgcgcccgtaccgacaccaaaaagttaaaccggcgagtgctggaaaaactgatcatgtctggggcgtttgaccgtcttgggccacaccgcgcggcgctgatgaactcgctgggtgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggtctgtacctgacgggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcgattgcgttttggcgcgacgtggcgtgtctctccgagcgatcgtttattaaacgatctccgtggcctcattggttcggagcaggtggaactggagtttgactaa

SEQ ID NO: 600 - protein, 1127 aa, Escherichia coli
MGMPALAITDFTNLCGLVKFYGAGHGAGIKPIVGADFNVQCDLLGDELTHLTVLAANNTGYQNLTLLISKAYQRGYGTAGPIIDRDWLIELNEGLILLSGGRMGDVGRSLLRGNSALVDECVAFYEEHFPDRYFLELIRTGRPDEESYLHAAVELAEARGLPVVATNDVRFIDSSDFDAHEIRVAIHDGFTLDDPKRPRNYSPQQYMRSEEEMCELFADIPEALANTVEIAKRCNVTVRLGEYFLPQFPTGDMSTEDYLVKRAKEGLEERLAFLFPDEEERLKRRPEYDERLDTELQVINQMGFPGYFLIVMEFIQWSKDNGVPVGPGRGSGAGSLVAYALKITDLDPLEFDLLFERFLNPERVSMPDFDVDFCMEKRDQVIEHVADMYGRDAVSQIITFGTMAAKAVIRDVGRVLGHPYGFVDRISKLIPPDPGMTLAKAFEAEPQLPEIYEADEEVKALIDMARKLEGVTRNAGKHAGGVVIAPTKITDFAPLYCDEEGKHPVTQFDKSDVEYAGLVKFDFLGLRTLTIINWALEMINKRRAKNGEPPLDIAAIPLDDKKSFDMLQRSETTAVFQLESRGMKDLIKRLQPDCFEDMIALVALFRPGPLQSGMVDNFIDRKHGREEISYPDVQWQHESLKPVLEPTYGIILYQEQVMQIAQVLSGYTLGGADMLRRAMGKKKPEEMAKQRSVFAEGAEKNGINAELAMKIFDLVEKFAGYGFNKSHSAAYALVSYQTLWLKAHYPAEFMAAVMTADMDNTEKVVGLVDECWRMGLKILPPDINSGLYHFHVNDDGEIVYGIGAIKGVGEGPIEAIIEARNKGGYFRELFDLCARTDTKKLNRRVLEKLIMSGAFDRLGPHRAALMNSLGDALKAADQHAKAEAIGQADMFGVLAEEPEQIEQSYASCQPWPEQVVLDGERETLGLYLTGHPINQYLKEIERYVGGVRLKDMHPTERGKVITAAGLVVAARVMVTKRGNRIGICTLDDRSGRLEVMLFTDALDKYQQLLEKDRILIVSGQVSFDDFSGGLKMTAREVMDIDEAREKYARGLAISLTDRQIDDQLLNRLRQSLEPHRSGTIPVHLYYQRADARARLRFGATWRVSPSDRLLNDLRGLIGSEQVELEFD

SEQ ID NO: 601 - DNA, 960 bp, Escherichia coli
atgagtctgaatttccttgattttgaacagccgattgcagagctggaagcgaaaatcgattctctgaccgcggttagccgtcaggatgagaaactggatattaacatcgatgaagaagtgcatcgtttgcgtgaaaaaagcgtagaactgacgcgtaaaatcttcgccgatctcggtgcatggcagattgcgcaactggcacgccatccacagcgtccttataccctggattacgttcgcctggcatttgatgaatttgacgaactggctggcgaccgcgcgtatgcagacgataaagctatcgtcggtggtatcgcccgtctcgatggtcgtccggtgatgatcattggtcatcaaaaaggtcgtgaaaccaaagaaaaaattcgccgtaactttggtatgccagcgccagaaggttaccgcaaagcactgcgtctgatgcaaatggctgaacgttttaagatgcctatcatcacctttatcgacaccccgggggcttatccgggcgtgggcgcagaagaacgtggtcagtctgaagccattgcacgcaacctgcgtgaaatgtctcgcctcggcgtaccggtagtttgtacggttatcggtgaaggtggttctggtggtgcgctggcgattggcgtgggcgataaagtgaatatgctgcaatacagcacctattccgttatctcgccggaaggttgtgcgtccattctgtggaagagcgctgacaaagcgccgctggcggctgaagcgatgggtatcatcgctccgcgtctgaaagagctgaaactgatcgactccatcatcccggaaccgctgggcggtgctcaccgtaacccggaagcgatggcggcgtctctgaaagcgcagctgctgacggatctggccgatctcgacgtgttaagcactgaagatttaaaaaatcgtcgttatcagcgcctgatgagctacggctacgcgtaa

SEQ ID NO: 602 - protein, 319 aa, Escherichia coli
MSLNFLDFEQPIAELEAKIDSLTAVSRQDEKLDINIDEEVHRLREKSVELTRKIFADLGAWQIAQLARHPQRPYTLDYVRLAFDEFDELAGDRAYADDKAIVGGIARLDGRPVMIIGHQKGRETKEKIRRNFGMPAPEGYRKALRLMQMAERFKMPIITFIDTPGAYPGVGAEERGQSEAIARNLREMSRLGVPVVCTVIGEGGSGGALAIGVGDKVNMLQYSTYSVISPEGCASILWKSADKAPLAAEAMGIIAPRLKELKLIDSIIPEPLGGAHRNPEAMAASLKAQLLTDLADLDVLSTEDLKNRRYQRLMSYGYA

SEQ ID NO: 603 - DNA, 1032 bp, Escherichia coli
atgaacatcattgccattatgggaccgcatggcgtcttttataaagatgagcccatcaaagaactggagtcggcgctggtggcgcaaggctttcagattatctggccacaaaacagcgttgatttgctgaagtttatcgaacataacccacgaatttgcggcgtgatttttgactgggatgagtacagtctcgatttatgtagcgatatcaatcaacttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccaacgaatatcttgataacattacgccgccgttcacgaaagccttgtttacctacgtcaaagagcggaagtacaccttttgtacgccggggcatatgggcggcaccgcatatcaaaaaagcccggttggctgtctgttttatgattttttcggcgggaataccctcaaggcggacgtctctatttcggtcaccgagcttggttcgttgctcgaccacaccgggccacacctggaagcggaagagtacatcgcgcggacgtttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattctgggtgggatcccgcgcggtgaatttactcgcgacagcatcgaagagaaagtcgctgccaccacgcaggcacaatggccggttcatgcggtgatcaccaactccacctatgatggcttgctctacaacaccgactggatcaaacagacgctggatgtcccgtcgattcacttcgattctgcctgggtgccgtacacccattttcatccaatctactag

SEQ ID NO: 604 - protein, 343 aa, Escherichia coli
MNIIAIMGPHGVFYKDEPIKELESALVAQGFQIIWPQNSVDLLKFIEHNPRICGVIFDWDEYSLDLCSDINQLNEYLPLYAFINTHSTMDVSVQDMRMALWFFEYALGQAEDIAIRMRQYTNEYLDNITPPFTKALFTYVKERKYTFCTPGHMGGTAYQKSPVGCLFYDFFGGNTLKADVSISVTELGSLLDHTGPHLEAEEYIARTFGAEQSYIVTNGTSTSNKIVGMYAAPSGSTLLIDRNCHKSLAHLLMMNDVVPVWLKPTRNALGILGGIPRGEFTRDSIEEKVAATTQAQWPVHAVITNSTYDGLLYNTDWIKQTLDVPSIHFDSAWVPYTHFHPIY

SEQ ID NO: 605 - DNA, 1098 bp, Escherichia coli
atgagcggcgagcgtgttgcaggaaaagtgatcttcgaaacgcagtcgacccacaaaatgctggcggcgttatcgcaggcgtcgctgatccacattaaaggtgagtatgacgaagaggcgtttaacgaagcctttatgatgcataccaccacctcgcccagttatcccattgttgcttctgttgagacggcggcggcgatgctgcgtggtaatccgggcaaacggctgattaaccgttcagtagaacgagctctgcattttcgcaaagaggtccagcggctgcgggaagagtctgacggctggtttttcgatatctggcaaccgccgcaggtggatgaagccgaatgctggcccgttgcgcctggcgaacagtggcacggctttagcgatgcggatgccaatcacatgtttctcgatccggttaaagtcactattttgacaccggggatggacgagcatggcaatatgagcgaggaggggatcccggcggcgctggtggcaaaattcctcgacgaacgtgggatcgtagtagagaaaaccggcccttataacctgctgtttctctttagtattggcatcgataaaaccaaagcaatgggattattgcgtgggttgacggaatttaagcgctcttacgatctcaacctgcggatcaaaaatatgctgcccgatctctatgcagaagatcccgatttctaccgcaatatgcgtattcaggatctggcgcaagggatccataagctgattcgtaaacacgatcttcccggtttgatgttgcgggcatttgataccttgccggagatgatcatgacgccacatcaggcatggcagagacagattaaaggcgaagtagaaaccattgcgctggaacaactggtcggtagagtatcggcaaatatgatcctgccttatccacccggcgtaccgctgctgatgccgggagaaatgcttaccgaagagagccgcacggtactcgattttctactgatgctttgttccgtagggcaacattaccccggttttgaaacggatattcacggcgcgaaacaggacgaagacggtgtttaccgcgtacgagtcctaaaaatggcaggataa

SEQ ID NO: 606 - protein, 365 aa, Escherichia coli
MSGERVAGKVIFETQSTHKMLAALSQASLIHIKGEYDEEAFNEAFMMHTTTSPSYPIVASVETAAAMLRGNPGKRLINRSVERALHFRKEVQRLREESDGWFFDIWQPPQVDEAECWPVAPGEQWHGFSDADANHMFLDPVKVTILTPGMDEHGNMSEEGIPAALVAKFLDERGIVVEKTGPYNLLFLFSIGIDKTKAMGLLRGLTEFKRSYDLNLRIKNMLPDLYAEDPDFYRNMRIQDLAQGIHKLIRKHDLPGLMLRAFDTLPEMIMTPHQAWQRQIKGEVETIALEQLVGRVSANMILPYPPGVPLLMPGEMLTEESRTVLDFLLMLCSVGQHYPGFETDIHGAKQDEDGVYRVRVLKMAG

SEQ ID NO: 607 - DNA, 390 bp, Escherichia coli
atgctgggtttaaaacaggttcaccatattgcgattattgcgacggattatgcgatgagcaaagctttctactgcgatattcttggtttcacgctgcaaagcgaagtctatcgcgaagcgcgcgactcgtggaaaggggatttggcgcttaatgggcaatatgtgattgagcttttctcatttccgttcccgccggagcgccccagccgaccggaagcctgcggcctgcgtcatctggcttttagcgttgatgatatcgatgcggcagtggcgcaccttgaaagccataacgtgaagtgtgaagccatccgtgtcgatccctacacgcaaaaacgcttcacgttctttaacgatccggacgggctgccgttggaactgtatgagcagtaa

SEQ ID NO: 608 - protein, 129 aa, Escherichia coli
MLGLKQVHHIAIIATDYAMSKAFYCDILGFTLQSEVYREARDSWKGDLALNGQYVIELFSFPFPPERPSRPEACGLRHLAFSVDDIDAAVAHLESHNVKCEAIRVDPYTQKRFTFFNDPDGLPLELYEQ

SEQ ID NO: 609 - DNA, 1299 bp, Escherichia coli
atgacactcacgctcaatagacaacttctctcctcacgccagattctggtggcctttagcggcggccttgattctactgtcttactgcatcaactggtgcagtggcggacggaaaatccgggcgtcactctgcgcgctatccatgtgcatcacggtttaagcgccaatgctgatgcctgggtgaaacattgtgaaaacatctgccaacagtggcaggtgccgctggtggtcgaacgtgtgcagcttgcgcaagaggggctaggtattgaggctcaggctcggcaggcgcgttatcaggcatttgcccgcaccttgttgcccggtgaagtgctggttacagcgcaacatctcgacgatcaatgtgaaacctttctgctggcgctaaaacgcggtagcggccctgccgggctttcggctatggcggaagtttcggagtttgccggaacacagcttatccgcccgttgcttgcccgcacgcggggggaactggtgcagtgggcgttggcgcatggtttacgctggattgaagacgaaagtaatcaggatgatagctacgatcgtaactttctgcgcctgcgcgtagtgccgttattgcagcagcgttggccgcattttgccgaagcaacagcccgcagcgccgcactttgcgctgaacaagagagcctgttagatgaactgctggcggatgatttagcgcactgtcaaactccgcaggggacgctgcagattgcgccaatgctggcgatgagtgatgcccgtcgcgcggcgattatccgccgctggctggcagggcagaatgcaccgatgccttcccgcgacgcgttggtgaggatctggcaggaagtggcgctggcgcgggaagatgcctccccctgtttacgtttgggtgcgtttgaaatccgccgctatcaatcgcaactgtggtggattaaattcgtcactgggcaaagcgaaaccattgtgccgtggcagacgtggctacaaccgctggaattaccggcggggctgggaagtgtacagcttactgcgggaggcgatattcgccctccgcgtgcagacgaagcggtcagcgtgcgtttcaaagcgccaggactgctgcatattgtcgggcgcaacggcggacgtaagctgaagaaaatctggcaagagttaggcgttccgccgtggctacgtgacaccacgccactgctgttttatggcgaaacgctgattgcggcggcaggggtatttgtgacgcaagaaggtgtggctgtaggtgagaatggcgtcagttttgtctggaagaaaacgcttagttaa

SEQ ID NO: 610 - protein, 432 aa, Escherichia coli
MTLTLNRQLLSSRQILVAFSGGLDSTVLLHQLVQWRTENPGVTLRAIHVHHGLSANADAWVKHCENICQQWQVPLVVERVQLAQEGLGIEAQARQARYQAFARTLLPGEVLVTAQHLDDQCETFLLALKRGSGPAGLSAMAEVSEFAGTQLIRPLLARTRGELVQWALAHGLRWIEDESNQDDSYDRNFLRLRVVPLLQQRWPHFAEATARSAALCAEQESLLDELLADDLAHCQTPQGTLQIAPMLAMSDARRAAIIRRWLAGQNAPMPSRDALVRIWQEVALAREDASPCLRLGAFEIRRYQSQLWWIKFVTGQSETIVPWQTWLQPLELPAGLGSVQLTAGGDIRPPRADEAVSVRFKAPGLLHIVGRNGGRKLKKIWQELGVPPWLRDTTPLLFYGETLIAAAGVFVTQEGVAVGENGVSFVWKKTLS

SEQ ID NO: 611 - DNA, 261 bp, Escherichia coli
atgtcaataaatgatacgtatcaaccaatcaattgtgatgattacgataatcttgagctcgcctgccagcatcatttaatgctgacacttgagctgaaagatggcgaaaaattgcaggcgaaggccagcgatttagtctcccgcaaaaatgtggaatatctggtcgtcgaagccgctggtgcaacccgcgagctgcgtctggataaaattaccagctttagccacccggaaatcggtacggtggtggtgagcgagtcctga

SEQ ID NO: 612 - protein, 86 aa, Escherichia coli
MSINDTYQPINCDDYDNLELACQHHLMLTLELKDGEKLQAKASDLVSRKNVEYLVVEAAGATRELRLDKITSFSHPEIGTVVVSES

SEQ ID NO: 613 - DNA, 201 bp, Escherichia coli
gtggaaaaatattgtgagttaatacgcaagcggtacgcggaaatcgccagcggagacttaggatacgttccggacgcgctgggctgcgttttgaaagtgctgaatgaaatggctgccgacgacgccctttctgaggctgtcagggaaaaagcagcatacgctgcggcaaacttactggtgagcgattatgtcaataaatga

SEQ ID NO: 614 - protein, 66 aa, Escherichia coli
MEKYCELIRKRYAEIASGDLGYVPDALGCVLKVLNEMAADDALSEAVREKAAYAAANLLVSDYVNK

SEQ ID NO: 615 - DNA, 426 bp, Escherichia coli
atgctgcgcctgctggcgtggctaaaatatgccgatgaacgtctgcaatttacccgtggtttgtgtgccgatgatgagccggaagcgtggctgcgtaacgatcatttgggtattgatttgtggattgagctggggctgccggatgagcgacggattaagaaagcctgcacccaggccgcagaagtggcgctgtttgcctataatagtcgggcggcgcaaatctggtggcagcaaaatcagagcaaatgtgcgcagtttgccaatctttccgtctggtatctggacgacgagcagctggcgaaagtgagcgcctttgccgatcgtactatgacgctgcaggcaacgattcaggatggtgttatctggttatcggatgataagaataatctggaagtgaacttaaccgtctggcaacaaccttcatga

SEQ ID NO: 616 - protein, 141 aa, Escherichia coli
MLRLLAWLKYADERLQFTRGLCADDEPEAWLRNDHLGIDLWIELGLPDERRIKKACTQAAEVALFAYNSRAAQIWWQQNQSKCAQFANLSVWYLDDEQLAKVSAFADRTMTLQATIQDGVIWLSDDKNNLEVNLTVWQQPS

SEQ ID NO: 617 - DNA, 423 bp, Escherichia coli
atgattgtgatttcccgacatgttgctatccctgatggcgagtttgagatcaccgccattcgtgcgcagggcgcgggcgggcagcatgttaataagacctcaacggctattcatctgcgttttgacattcgggcgtccagcctgccagagtattacaaagaacgtctgctcgccgccagccatcacttgatcagcagtgatggggtgattgtcattaaggcacaggaataccgcaatcaggagctcaaccgcgaagcggcgctggcccggctggtggcagtgattaaagatttaacaacagaacaaaaagcccgacgacccacgcggcccacccgcgcatcaaaagagcgcaggctggcatcgaaagcacaaaaatcaagcgtgaaggcgatgcgcggcaaagtgcgcagcggtcgggaataa

SEQ ID NO: 618 - protein, 140 aa, Escherichia coli
MIVISRHVAIPDGEFEITAIRAQGAGGQHVNKTSTAIHLRFDIRASSLPEYYKERLLAASHHLISSDGVIVIKAQEYRNQELNREAALARLVAVIKDLTTEQKARRPTRPTRASKERRLASKAQKSSVKAMRGKVRSGRE

SEQ ID NO: 619 - DNA, 711 bp, Escherichia coli
atggtgaaaaaagcgatagtgacagcgatggctgtaatcagcctctttactctgatgggatgtaataatcgggccgaagtcgatacgctttctccggcacaggctgccgaactgaaaccgatgccgcaaagttggcgcggcgtgctgccgtgtgctgattgcgaaggaatcgaaacctctctgttcctcgaaaaagacggaacctgggtgatgaatgagcgttatctgggggctcgtgaagaaccttcctccttcgcttcctacggtacatgggcgcgaaccgctgacaagctggtattaaccgatagcaaaggtgaaaagtcatattatcgcgcgaaaggagatgcgctggagatgctcgatcgtgaaggtaatccgattgaatcgcagttcaactatacgctggaaccggcacaatccagcttacccatgacaccgatgaccctgcggggcatgtatttttatatggctgatgcggcgaccttcactgattgcgcgaccggaaaacgtttcatggtggcgaataacgcagagctggagcgtggctacctggctgcgcgcggtaacagtgaaaaaccggtgttactgtcagtagaaggtcactttacgcttgaggctaatccggataccggtgcgccgaccaaagtattagcgcccgatacggcaggtaaattttacccaaaccaggattgcagtagtttggggctgtaa

SEQ ID NO: 620 - protein, 236 aa, Escherichia coli
MVKKAIVTAMAVISLFTLMGCNNRAEVDTLSPAQAAELKPMPQSWRGVLPCADCEGIETSLFLEKDGTWVMNERYLGAREEPSSFASYGTWARTADKLVLTDSKGEKSYYRAKGDALEMLDREGNPIESQFNYTLEPAQSSLPMTPMTLRGMYFYMADAATFTDCATGKRFMVANNAELERGYLAARGNSEKPVLLSVEGHFTLEANPDTGAPTKVLAPDTAGKFYPNQDCSSLGL

SEQ ID NO: 621 - DNA, 834 bp, Escherichia coli
ttgtataaaatggataaaccaaaggcgtactgccgcctgcttctcccctgctttcttttactttcggcctgtaccgttgatatcagccagccagactcatcagccacagtggtaaatgccgaggcgaaaacatgggctgttaaattccagcatcaaagctctttcaccgaacaatcaataaaagaaataacggaaccagatctcaaacccggcgatttgcttttctcctcaagccttggggtaacctcatttggtatccgcgtattcagcacttcctctgtgagtcacgttgcaatctatttgggagataataacgttgccgaagcgacaggcgctggcgtccagattgtttcccttaaaaaagccataaagcatagtgataagcttttcgtcttacgagtcccggatcttaccccgcaacaagccacagaaatcaccgcgttcgccaacaaaattaaagatagcggttataactatcgcggcattgtcgaatttattccatttatggtgactcgccagatgtgctcactaaatccgttctccgaggattttcgtcaacagtgcgtcagcggcctggcgaaagcgcagttaagcagtgtgggcgaaggagacaaaaagtcgtggttttgttcggaatttgtcactgatgcatttgccaaagccgggcatccgcttacgctggcgcaatcaggctggattagccctgccgatctgatgcatatgcgtagtggtgatgtctctgcatttaaaccagaaacgcagttacagtatattgggcacctgaagccagggatttatattaaagcaagtcgctttgttggactgactcagtga

SEQ ID NO: 622 - protein, 277 aa, Escherichia coli
MYKMDKPKAYCRLLLPCFLLLSACTVDISQPDSSATVVNAEAKTWAVKFQHQSSFTEQSIKEITEPDLKPGDLLFSSSLGVTSFGIRVFSTSSVSHVAIYLGDNNVAEATGAGVQIVSLKKAIKHSDKLFVLRVPDLTPQQATEITAFANKIKDSGYNYRGIVEFIPFMVTRQMCSLNPFSEDFRQQCVSGLAKAQLSSVGEGDKKSWFCSEFVTDAFAKAGHPLTLAQSGWISPADLMHMRSGDVSAFKPETQLQYIGHLKPGIYIKASRFVGLTQ

SEQ ID NO: 623 - DNA, 1644 bp, Escherichia coli
atgctgcgcgccgggatgatccgcaagctggcctccgggttatatacctggctgccgaccggcgtgcgcgttctgaaaaaagtcgaaaacatcgtgcgtgaagagatgaacaacgccggtgcgatcgaggtgttaatgccggtggttcagccatctgaactgtggcaagagagtggtcgttgggaacagtatggcccggaattgctgcgtattgctgaccgtggtgaccgtccgttcgtactcggcccaactcatgaagaagtgattacagacctgattcgtaacgagctgagctcttacaaacagctgccgctgaacttctatcagatccagaccaagttccgcgacgaagtgcgtccgcgtttcggcgtcatgcgttcccgcgaattcctgatgaaagatgcttactctttccatacttctcaggaatccctgcaggaaacctacgatgcaatgtatgcggcctacagcaaaatcttcagccgcatggggctggatttccgcgccgtacaggccgataccggttctatcggcggtagcgcctctcacgaatttcaggtgctggcgcagagcggagaagacgatgtggtcttctccgatacttctgactatgcagcgaacattgaactggcagaagctatcgcgccgaaagaaccgcgcgctgctgctacccaggaaatgacgctggttgatacgccgaacgcgaaaaccatcgcggaactggttgaacagttcaatctgccgattgagaaaacggttaagactctgctggttaaagccgttgaaggcagtagcttcccgctggttgcgctgctggtgcgcggtgaccacgagctgaacgaagttaaagcagaaaaactgccgcaggttgccagcccgctgacttttgcgaccgaagaagaaattcgtgccgtggttaaagccggtccgggttcactgggtccggtaaacatgccgattccggtggtgattgaccgtaccgttgcggcgatgagtgatttcgctgctggtgctaacatcgatggtaaacactacttcggtatcaactgggatcgcgatgtcgctactccggaaattgctgatatccgcaacgtggtggctggcgatccaagcccggatggtcagggtacgctgctgatcaaacgtggtatcgaagtcggtcacatcttccagctgggtaccaagtactccgaagcactgaaagcctccgtacagggtgaagatggccgtaaccaaatcctgacgatgggttgctacggtatcggcgtaacgcgtgtggtagctgcggcgattgagcagaactacgacgaacgcggcatcgtatggcctgacgctatcgcgccgttccaggtggcgattctgccaatgaacatgcacaaatccttccgcgtacaggaacttgctgagaaactgtacagcgaactgcgcgcacaaggtatcgaagtgctgctggatgaccgcaaagagcgcccgggcgtgatgtttgctgatatggaactgatcggtattccgcacactattgtgctgggcgaccgtaacctcgacaacgatgatatcgaatataaatatcgtcgtaacggcgagaaacagttaattaagactggtgacatcgtcgattatctggtgaaacagattaaaggctga

SEQ ID NO: 624 - protein, 547 aa, Escherichia coli
MLRAGMIRKLASGLYTWLPTGVRVLKKVENIVREEMNNAGAIEVLMPVVQPSELWQESGRWEQYGPELLRIADRGDRPFVLGPTHEEVITDLIRNELSSYKQLPLNFYQIQTKFRDEVRPRFGVMRSREFLMKDAYSFHTSQESLQETYDAMYAAYSKIFSRMGLDFRAVQADTGSIGGSASHEFQVLAQSGEDDVVFSDTSDYAANIELAEAIAPKEPRAAATQEMTLVDTPNAKTIAELVEQFNLPIEKTVKTLLVKAVEGSSFPLVALLVRGDHELNEVKAEKLPQVASPLTFATEEEIRAVVKAGPGSLGPVNMPIPVVIDRTVAAMSDFAAGANIDGKHYFGINWDRDVATPEIADIRNVVAGDPSPDGQGTLLIKRGIEVGHIFQLGTKYSEALKASVQGEDGRNQILTMGCYGIGVTRVVAAAIEQNYDERGIVWPDAIAPFQVAILPMNMHKSFRVQELAEKLYSELRAQGIEVLLDDRKERPGVMFADMELIGIPHTIVLGDRNLDNDDIEYKYRRNGEKQLIKTGDIVDYLVKQIKG

SEQ ID NO: 625 - DNA, 708 bp, Escherichia coli
atgagcagtttccagttcgagcaaataggcgttattcgctcgccctataaagaaaaattcgccgttccgcgccagccaggtctggtaaaaagcgccaacggcgaactacatctcattgctccctacaaccaggccgacgccgttcgcggcctggaagcattcagccatttatggatccttttcgtctttcatcaaacgatggaaggcggctggcgtccgactgtgcgtccgcctcgtctcggcggtaatgccagaatgggtgttttcgctacgcgctccacttttcgccctaacccaattggtatgtcgctggtagagctgaaagaggttgtttgccataaagatagcgtgattctgaagctcggcagtctggatctcgtcgatggtacgccggtagtggatatcaaaccgtatctcccctttgctgaatcgcttcccgatgccagtgccagctatgcgcaaagtgcgccagcggcagaaatggcggtgtgttttaccgcagaggtcgaaaagcagcttttgacgctggagaagcgttatccgcagttaacgctgtttatccgcgaagtactggcgcaggacccgcgcccggcctatcgtaaaggtgaggaaacgggcaaaacctatgccgtctggctgcatgattttaacgttcgctggcgcgtcaccgacgcaggttttgaagtctttgcgctggaaccgcgttaa

SEQ ID NO: 626 - protein, 235 aa, Escherichia coli
MSSFQFEQIGVIRSPYKEKFAVPRQPGLVKSANGELHLIAPYNQADAVRGLEAFSHLWILFVFHQTMEGGWRPTVRPPRLGGNARMGVFATRSTFRPNPIGMSLVELKEVVCHKDSVILKLGSLDLVDGTPVVDIKPYLPFAESLPDASASYAQSAPAAEMAVCFTAEVEKQLLTLEKRYPQLTLFIREVLAQDPRPAYRKGEETGKTYAVWLHDFNVRWRVTDAGFEVFALEPR

SEQ ID NO: 627 - DNA, 405 bp, Escherichia coli
atgcgtgctttaccgatctgtttagtagcactcatgctaagcggctgttccatgttaagcagatcccctgtcgaacccgttcaaagcactgcaccccagccgaaagcggagcctgcaaaaccgaaagcgccgcgcgccacgccggtccgaatttataccaatgcagaagaattagtcggcaaaccgttccgcgatctcggtgaagtcagtggcgactcttgccaggcctctaatcaggactctccgccgagcattccaaccgcacgtaagcggatgcaaatcaacgcctcgaaaatgaaagccaatgcggtattactgcatagctgcgaagtcaccagcggtacgccaggttgctatcgtcaggctgtatgtataggttctgcgcttaacatcacggcgaaatga

SEQ ID NO: 628 - protein, 134 aa, Escherichia coli
MRALPICLVALMLSGCSMLSRSPVEPVQSTAPQPKAEPAKPKAPRATPVRIYTNAEELVGKPFRDLGEVSGDSCQASNQDSPPSIPTARKRMQINASKMKANAVLLHSCEVTSGTPGCYRQAVCIGSALNITAK

SEQ ID NO: 629 - DNA, 816 bp, Escherichia coli
atggcgttcaaattcaaaacctttgcggcagtgggagccctgattggatcactggcactggtaggctgcggtcaggatgaaaaagatccaaaccacattaaagtcggcgtgattgttggtgccgaacagcaggttgcagaagtcgcgcagaaagttgcgaaagacaaatatggcctggacgttgagctggtaaccttcaacgactatgttctgccaaacgaagcattgagcaaaggcgatatcgacgccaacgccttccagcataaaccgtaccttgatcagcaactgaaagatcgtggctacaaactggtcgcagtaggcaacacatttgtttatccgattgctggttactccaagaaaatcaaatcactggatgaactgcaggatggttcgcaggttgccgtgccaaacgacccaactaaccttggtcgttcactgctgctgctgcaaaaagtgggcttgatcaaactgaaagatggcgttggcctgctgccgaccgttcttgatgttgttgagaacccaaaaaatctgaaaattgttgaactggaagcaccgcagctgccgcgctctctggacgacgcgcaaatcgctctggcagttatcaataccacctatgccagccagattggcctgactccagcgaaagacggtatctttgtcgaagataaagagtccccgtacgtaaacctgatcgtaacgcgtgaagacaacaaagacgccgaaaacgtgaagaaattcgttcaggcttatcagtctgacgaagtttacgaagcagcaaacaaagtgtttaacggcggcgctgttaaaggctggtaa

SEQ ID NO: 630 - protein, 271 aa, Escherichia coli
MAFKFKTFAAVGALIGSLALVGCGQDEKDPNHIKVGVIVGAEQQVAEVAQKVAKDKYGLDVELVTFNDYVLPNEALSKGDIDANAFQHKPYLDQQLKDRGYKLVAVGNTFVYPIAGYSKKIKSLDELQDGSQVAVPNDPTNLGRSLLLLQKVGLIKLKDGVGLLPTVLDVVENPKNLKIVELEAPQLPRSLDDAQIALAVINTTYASQIGLTPAKDGIFVEDKESPYVNLIVTREDNKDAENVKKFVQAYQSDEVYEAANKVFNGGAVKGW

SEQ ID NO: 631 - DNA, 654 bp, Escherichia coli
atgtctgagccgatgatatggctgctggttcgtggcgtatgggaaacactggcaatgaccttcgtatccggtttttttggctttgtgattggtctgccggttggcgttctgctttatgtcacgcgtccggggcaaattattgctaacgcgaagttgtatcgtaccatttctgcgattgtgaacattttccgttccatcccgttcattatcttgctggtatggatgattccgtttacccgcgttattgtcggtacatcgattggattgcaggcagcgattgttccgttaaccgttggtgcagcaccgtttattgcccgtatggtcgagaacgctctgctggagatcccaaccgggttaattgaagcttcccgcgcaatgggggccacgccaatgcagatcgtccgtaaagtgctgttaccggaagcgttgccgggtctggtgaatgcggcaactatcaccctgattaccctggttggttattccgcgatgggtggtgcagtcggtgccggtggtttaggtcagattggctatcagtatggctacatcggctacaacgcgacggtgatgaatacggtactggtattgctggtcattctggtttatttaattcagttcgcaggcgaccgcatcgtccgggctgtcactcgcaagtaa

SEQ ID NO: 632 - protein, 217 aa, Escherichia coli
MSEPMIWLLVRGVWETLAMTFVSGFFGFVIGLPVGVLLYVTRPGQIIANAKLYRTISAIVNIFRSIPFIILLVWMIPFTRVIVGTSIGLQAAIVPLTVGAAPFIARMVENALLEIPTGLIEASRAMGATPMQIVRKVLLPEALPGLVNAATITLITLVGYSAMGGAVGAGGLGQIGYQYGYIGYNATVMNTVLVLLVILVYLIQFAGDRIVRAVTRK

SEQ ID NO: 633 - DNA, 1032 bp, Escherichia coli
atgataaaactttcgaatatcaccaaagtgttccaccagggcacccgcaccatccaggcgttgaacaacgtcagcctgcatgtgccagctggacaaatttatggcgttatcggtgcctcaggcgcgggtaagagtacgcttatacgttgtgtaaacctgctggagcgcccaaccgagggtagcgtgctggtcgatggccaggaactgaccacgctgtcagaatccgagttgaccaaagctcgtcgccagattggtatgattttccagcattttaacctgctctcttcgcgtactgtttttggcaacgtggctctgccgctggagctggacaacacaccgaaagacgagatcaaacgtcgcgtgacggaattgctgtcattggttggtcttggcgataagcatgatagctacccgtcgaatctttccggtgggcagaaacaacgtgtggcgattgcccgtgcattagccagcaatcccaaagtattgctgtgtgatgaagccaccagcgcgctggacccggcaacgacacgttctattctcgaactgctgaaagacatcaaccgccgtctgggtttgacgattctgttgatcactcacgaaatggacgttgtgaagcgcatttgtgattgcgtggcggtcatcagcaatggcgaactgatcgagcaggacacggtaagtgaagtgttctcgcatccgaaaacgccgctggcgcagaagtttattcagtcgaccctgcatctggatatcccggaagattaccaggaacgtctgcaagcggagccatttactgactgcgtgccgatgctgcgtctggagtttaccggtcaatcggtcgatgccccactgctttctgaaaccgcgcgtcgtttcaacgtcaacaacaacattattagcgcgcagatggattacgccggtggcgttaagttcggcattatgctgactgaaatgcacggcacacaacaagatacgcaagccgccattgcctggcttcaggaacaccatgtaaaagtagaggtactgggttatgtctga

SEQ ID NO: 634 - protein, 343 aa, Escherichia coli
MIKLSNITKVFHQGTRTIQALNNVSLHVPAGQIYGVIGASGAGKSTLIRCVNLLERPTEGSVLVDGQELTTLSESELTKARRQIGMIFQHFNLLSSRTVFGNVALPLELDNTPKDEIKRRVTELLSLVGLGDKHDSYPSNLSGGQKQRVAIARALASNPKVLLCDEATSALDPATTRSILELLKDINRRLGLTILLITHEMDVVKRICDCVAVISNGELIEQDTVSEVFSHPKTPLAQKFIQSTLHLDIPEDYQERLQAEPFTDCVPMLRLEFTGQSVDAPLLSETARRFNVNNNIISAQMDYAGGVKFGIMLTEMHGTQQDTQAAIAWLQEHHVKVEVLGYV

SEQ ID NO: 635 - DNA, 159 bp, Escherichia coli
  n 136, 137, 138, 139, 140: n is any nucleotide
gtggcgaagagcgtacccgcaatttttcttgaccgtgatggcaccattaatgtcgatcacggttatgtccatgagatcgacaactttgaatttatcgacggtgttattgacgccatgcgcgagctaaaaaaaatgnnnnncattccattcattaattaa

SEQ ID NO: 636 - protein, 52 aa, Escherichia coli
  Xaa 46, 47: Xaa is any amino acid
MAKSVPAIFLDRDGTINVDHGYVHEIDNFEFIDGVIDAMRELKKMXXIPFIN

SEQ ID NO: 637 - DNA, 126 bp, Escherichia coli
ttgctcgtggagctgaaatcagtcgaagataccagctggctgcaactgtttattaaaaacacagcactgtgcaaacacgaaagtggacgtatacggtgtgacgcctgcccggtgccggaaggttaa

SEQ ID NO: 638 - protein, 41 aa, Escherichia coli
MLVELKSVEDTSWLQLFIKNTALCKHESGRIRCDACPVPEG

SEQ ID NO: 639 - DNA, 804 bp, Escherichia coli
atggctatccctgcatttggtttaggcactttccgtctgaaagacgacgttgttatttcatctgtgaaaacggcgcttgaacttgattatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccgagtctgaaagagagcctgcaaaaattgcgtaccgattatgttgatctgacgctaatccactggccgtcaccaagcgatgaagtctctgctgaagagtttatgcaggcgctgctggaagccaaaaaacaagggctgacgcgtgagatcggtatttccaacttcacgatcccattgatggaaaaagcgattgctgctgttggcgctgaaaacatcgctactaaccagattgaactctctccttatctgcaaaaccgtaaagtggtcgcttgggctaaacagcacggtatccatattacttcctatatgactctggcgtatggcaatgcactgaaagataaggttattgctcgtattgcagctaaacacaatgcgactccggctcaagtgattctggcgtgggctatgggggaaggttactcagtaattccttcttctactaaacgtgaaaacctggagagtaatcttaaggcacaaaatttacagcttgatgccgaagataaaaaagcgatcgccgcactggattgcaacgaccgcctggttagcccggaaggtctggctcctgaatgggattaa

SEQ ID NO: 640 - protein, 267 aa, Escherichia coli
MAIPAFGLGTFRLKDDVVISSVKTALELDYRAIDTAQIYDNEAAVGQAIAESGVPRHELYITTKIWIENLSKDKLIPSLKESLQKLRTDYVDLTLIHWPSPSDEVSAEEFMQALLEAKKQGLTREIGISNFTIPLMEKAIAAVGAENIATNQIELSPYLQNRKVVAWAKQHGIHITSYMTLAYGNALKDKVIARIAAKHNATPAQVILAWAMGEGYSVIPSSTKRENLESNLKAQNLQLDAEDKKAIAALDCNDRLVSPEGLAPEWD

SEQ ID NO: 641 - DNA, 915 bp, Escherichia coli
atgaaagccacgtcggaagaactcgccatttttgtttcagtcgtcgaaagcggcagctttagccgggcagcggaacaattagggcaagcaaactcagcggtaagccgggcggtgaaaaagctggagatgaaacttggcgttagcctgcttaatcggaccacgcggcaacttagcctgacggaagaaggcgagcgttattttcatcgcgtacagtcaattttgcaggagatggcagcggcagaatcagaaattatggagacgcgtaatacaccgcgtggactgttacggatcgatgccgcaactccagtggtgctgcactttctgatgccgttgattaagccttttcgtgaacgctatccggaagtcactttatcgctagtctcctccgaaacgattattaatttgatcgaaagaaaagtggatgtcgcgatacgcgccggtacgttaacggattccagcttacgtgccaggccgttatttaacagttatcgaaaaattatcgcctcccccgattatatttcctgctacgggaagccagaaacgatcgacgatttaaagcaacatatttgcctgagattcactgaacccgcttccctcaatacctggccgatagcctgtagcgatggacaattacatgaggtgaagtacggtttgtcatccaatagtggggaaacactgaaacagctttgcctgagtggcaacgggattgcgtgtttgtccgactacatgatcgacaaagaaatcgctcgcggagaattggtggagttaatggcagataaagtgttgccagtggaaatgccattcagtgcagtctattacagcgaccgtgcggtaagtacgcgcatccgggcttttatcgatttccttagcggacatgtaaaaacagctcccggaggagctgtcagagaggcttaa

SEQ ID NO: 642 - protein, 304 aa, Escherichia coli
MKATSEELAIFVSVVESGSFSRAAEQLGQANSAVSRAVKKLEMKLGVSLLNRTTRQLSLTEEGERYFHRVQSILQEMAAAESEIMETRNTPRGLLRIDAATPVVLHFLMPLIKPFRERYPEVTLSLVSSETIINLIERKVDVAIRAGTLTDSSLRARPLFNSYRKIIASPDYISCYGKPETIDDLKQHICLRFTEPASLNTWPIACSDGQLHEVKYGLSSNSGETLKQLCLSGNGIACLSDYMIDKEIARGELVELMADKVLPVEMPFSAVYYSDRAVSTRIRAFIDFLSGHVKTAPGGAVREA

SEQ ID NO: 643 - DNA, 825 bp, Escherichia coli
gtgatagaggtttcaaagtcaaaagtgcgaaaaaacacctatgccatgcgctatgttgccggacaacctgcggaaaggatcttaccgccggggtcttttgcgagcatcggccaggcattaccacctggagaaccgttaagtaccgaagagcgtattcggatcctggtgtggaacatatacaaacagcaacgcgctgaatggttgtcggtattaaagaactacggcaaagatgcacatctggtgttattgcaggaagcgcagacaacgccagagttagtacagtttgcgactgctaactatcttgccgccgatcaggtacccgctttcgtgctgccacaacatccttctggcgtaatgaccctttcggcggcacatccagtgtattgctgcccgttacgtgaacgagaacccattttgcgtctggcgaaatcggcactggtgacggtctatcccttacctgacacccgcctgttgatggtggttaatatacacgccgtcaacttcagtctgggcgtggatgtctatagtaagcagttacttcctattggcgatcagatagctcaccacagtggcccggtcattatggcgggagatttcaatgcctggagccgtagaaggatgaacgcgttatatcgctttgcgcgggaaatgtcgctacgccaggtgcgttttaccgatgatcagcgccgtcgggcgtttggtcgcccgctcgattttgttttctaccgtggtctgaacgtcagcgaagcttctgtactggttacgcgcgcttccgatcacaatccgctactcgttgaattcagtcccggcaagcctgataaataa

SEQ ID NO: 644 - protein, 274 aa, Escherichia coli
MIEVSKSKVRKNTYAMRYVAGQPAERILPPGSFASIGQALPPGEPLSTEERIRILVWNIYKQQRAEWLSVLKNYGKDAHLVLLQEAQTTPELVQFATANYLAADQVPAFVLPQHPSGVMTLSAAHPVYCCPLREREPILRLAKSALVTVYPLPDTRLLMVVNIHAVNFSLGVDVYSKQLLPIGDQIAHHSGPVIMAGDFNAWSRRRMNALYRFAREMSLRQVRFTDDQRRRAFGRPLDFVFYRGLNVSEASVLVTRASDHNPLLVEFSPGKPDK

SEQ ID NO: 645 - DNA, 771 bp, Escherichia coli
atgacaacacaatcccaccatgaccacgtagaaaagcagtttagctctcaagccagcgaatatctgaccagtaccgtacatgcatccggacgagatttacagcgcctggcggtgcgtctggctgattatcctgatgcaagtgtacttgatatgggctgcggagcagggcatgccagctttgttgctgcgcaaaacgtgagcgcggtggtagcgtatgacttatctgcccaaatgctggatgtcgtggcacaagctgccgaagcccggcaactgaaaaatatcaccacccgccagggttatgccgaaagtctgccatttgccgataacgcatttgatattgttatcagccgttattctgcccatcactggcatgatgttggtgcagcactgcgtgaagtgaaccggatattgaaacctggcggtaggctgattgtgatggacgtaatgtctccgggccacccagtgcgcgacatctggttacagacggtagaagcattacgcgatacctctcacgtacgaaactacgccagcggtgagtggttgaggttaatcaatgaagccaatctgatagttgataatttaattacagataagttaccgctggaattttcttcatgggtcgcgagaatgcgtacgccagaagcgttagtagacgctattcgcatttaccaacagagcgcatcgacagaggtgaaaacgtattttgccttgcagaatgatggctctttcaccagtgatatcatcatggtagaagcacataaagcagcataa

SEQ ID NO: 646 - protein, 256 aa, Escherichia coli
MTTQSHHDHVEKQFSSQASEYLTSTVHASGRDLQRLAVRLADYPDASVLDMGCGAGHASFVAAQNVSAVVAYDLSAQMLDVVAQAAEARQLKNITTRQGYAESLPFADNAFDIVISRYSAHHWHDVGAALREVNRILKPGGRLIVMDVMSPGHPVRDIWLQTVEALRDTSHVRNYASGEWLRLINEANLIVDNLITDKLPLEFSSWVARMRTPEALVDAIRIYQQSASTEVKTYFALQNDGSFTSDIIMVEAHKAA

SEQ ID NO: 647 - DNA, 1359 bp, Escherichia coli
atgaaggcaaaagcgatattactcgcctctgtcctgctcgtgggttgccagagcaccggcaacgttcaacagcacgcacagagcctttctgcagctggtcaaggggaagcagcaaagtttacaagtcaggcacgatggatggacgatgggacgtctatcgcgccagatggtgacttgtgggctttcattggcgacgagctaaagatgggaattccggaaaacgaccggattcgcgaacagaaacagaaatatttacgcaataagagctatctccacgatgtaactttacgggcagagccgtatatgtactggatagccgggcaagttaaaaaacgtaacatgcctatggaactggtactactacccatagtggagagcgcttttgatcctcacgcaacgtctggcgccaatgccgcgggcatctggcagatcattccgagcacggggcgcaattatggtttgaaacagacacgcaattatgacgcgcgtcgcgatgttgttgcttcaacaactgccgcgctgaacatgatgcagcgtctgaacaagatgtttgacggcgactggcttctgaccgtagcggcttataacagcggcgaaggtcgggtcatgaaggcaattaaaacgaacaaagcgcgtgggaaatccacggacttctggtcgttaccgttgccgcaggaaacgaagcagtacgtgcctaaaatgctggcattgagtgatattctcaaaaacagcaagcgttatggcgtacgtctgccaacgaccgatgaaagccgtgctctggcgcgtgtgcacctgagcagcccggttgaaatggcgaaggttgcagatatggcggggatttccgtcagcaagctgaagacattcaacgctggcgtgaaaggctccacgctgggcgcaagtggtccgcagtacgtgatggtgccaaagaagcatgcagatcaactgcgtgaatctctggcttcgggcgaaattgctgctgtacagtcgacgctggttgccgacaatacgccgcttaacagccgtgtttacaccgtacgctctggcgacacgctttcaagtatcgcttcacgtctcggcgttagcaccaaagatttgcagcagtggaacaaactgcgcggatctaagctgaagccaggccaaagcttgacgattggcgcaggtagtagcgcacagcggttggcaaacaacagcgatagcattacgtatcgtgtgcgcaaaggcgattcgctttcaagcattgctaaacgccacggcgtgaacatcaaagatgtgatgcgctggaacagcgatactgcgaatctgcaaccaggcgataagctgacgttgtttgtgaaaaacaacaacatgccagattcctga

SEQ ID NO: 648 - protein, 452 aa, Escherichia coli
MKAKAILLASVLLVGCQSTGNVQQHAQSLSAAGQGEAAKFTSQARWMDDGTSIAPDGDLWAFIGDELKMGIPENDRIREQKQKYLRNKSYLHDVTLRAEPYMYWIAGQVKKRNMPMELVLLPIVESAFDPHATSGANAAGIWQIIPSTGRNYGLKQTRNYDARRDVVASTTAALNMMQRLNKMFDGDWLLTVAAYNSGEGRVMKAIKTNKARGKSTDFWSLPLPQETKQYVPKMLALSDILKNSKRYGVRLPTTDESRALARVHLSSPVEMAKVADMAGISVSKLKTFNAGVKGSTLGASGPQYVMVPKKHADQLRESLASGEIAAVQSTLVADNTPLNSRVYTVRSGDTLSSIASRLGVSTKDLQQWNKLRGSKLKPGQSLTIGAGSSAQRLANNSDSITYRVRKGDSLSSIAKRHGVNIKDVMRWNSDTANLQPGDKLTLFVKNNNMPDS

SEQ ID NO: 649 - DNA, 756 bp, Escherichia coli
atgaatcttaacagtattcccgcctttgatgacaattacatctgggttttgaatgatgaagcaggtcgctgtctgattgtcgatcccggggacgcagagccagtattaaacgccatttccgccaataactggcaaccggaggccatatttctcacccaccatcaccacgatcacgttggaggcgtaaaagaactggtggaaaagtttccgcaaattgtggtgtatggaccacaagagacacaagataagggaacaacacaggtagtcaaagatggcgaaactgccttcgttttggggcatgaatttagtgtaattgccacaccgggtcacactttaggacatatctgttacttcagtaaaccttatctattttgcggcgacacgctgttttctggtgggtgtggtcggttgtttgaagggacaccatcacaaatgtatcaatcaattaaaaagttaagtgcgttacctgacgatacattggtatgttgtgctcatgaatataccttatcaaatatgaagtttgctttgagtattcttccgcacgatttgtccataaatgattattatcgtaaagttaaggagttacgggcaaaaaatcaaataacactacccgtaattctgaaaaatgagcggcaaattaatgtttttttaagaacggaagatattgatttaattaatgtaattaatgaagaaacattattgcaacaacctgaagaacgttttgcatggttaaggtcaaagaaagataggttctga

SEQ ID NO: 650 - protein, 251 aa, Escherichia coli
MNLNSIPAFDDNYIWVLNDEAGRCLIVDPGDAEPVLNAISANNWQPEAIFLTHHHHDHVGGVKELVEKFPQIVVYGPQETQDKGTTQVVKDGETAFVLGHEFSVIATPGHTLGHICYFSKPYLFCGDTLFSGGCGRLFEGTPSQMYQSIKKLSALPDDTLVCCAHEYTLSNMKFALSILPHDLSINDYYRKVKELRAKNQITLPVILKNERQINVFLRTEDIDLINVINEETLLQQPEERFAWLRSKKDRF

SEQ ID NO: 651 - DNA, 135 bp, Escherichia coli
atgtatgtgccagtagacaaacatcaacggatttatcggcaaaaggaagatgaagtgggtccgcctgcacctggacgggcattccttgcgcagaaacattcacttgatgagaaaccgcgcacgcttcgcaattga

SEQ ID NO: 652 - protein, 44 aa, Escherichia coli
MYVPVDKHQRIYRQKEDEVGPPAPGRAFLAQKHSLDEKPRTLRN

SEQ ID NO: 653 - DNA, 723 bp, Escherichia coli
atgaaaccggcaagagtccctcaaactgtcgtggctcctgattgctggggcgatttgccctggggagagctttatcgcaaggcgctggagcgtcagctcaacccgtggttcactaaaatgtatggttttcatctgcttaagattggcaatttaagcgcagaaatcaattgcgaagcgtgcgcggtttctcatcaagtgaatgtttctgcgcaaggaatgcccgtccaggtgcaggcggacccacttcatcttccttttgccgataaatccgttgatgtttgtctactggcacatacattgccgtggtgcactgatccgcatcgtttattgcgtgaagccgatcgggtactgattgatgatggctggctggtgattagtggcttcaatcccatcagtttaatgggattacgcaaacttgtgccggtattgcgcaaaacatcgccctataacagccggatgttcactctgatgcggcagctggactggctctctttgttgaattttgaagtgctacacgccagccgtttccacgttctcccgtggaacaaacacggaggaaaactattgaatgcgcatattcctgcgcttggttgcttacaacttattgttgcccggaaacggactattcctttaacgctaaatccgatgaaacagagcaagaacaaaccgcgaattcgccaggcggttggtgccacccggcaatgtcgtaaaccacaggcttaa

SEQ ID NO: 654 - protein, 240 aa, Escherichia coli
MKPARVPQTVVAPDCWGDLPWGELYRKALERQLNPWFTKMYGFHLLKIGNLSAEINCEACAVSHQVNVSAQGMPVQVQADPLHLPFADKSVDVCLLAHTLPWCTDPHRLLREADRVLIDDGWLVISGFNPISLMGLRKLVPVLRKTSPYNSRMFTLMRQLDWLSLLNFEVLHASRFHVLPWNKHGGKLLNAHIPALGCLQLIVARKRTIPLTLNPMKQSKNKPRIRQAVGATRQCRKPQA

SEQ ID NO: 655 - DNA, 579 bp, Escherichia coli
gtggtttcggtatcgagaacgatctggcgtgtaattgcagtgctcatagcggtcatttatgtcagacttatcgttttacagttcgattcaattacaggaagtctaccagagatgcttaaacaggtagaaattttcaccgatggttcgtgtctgggtaatcctggacctgggggttacggcgctattttacgctatcgcggacgcgagaaaacctttagcgctggctacacccgcaccaccaacaaccgtatggagttgatggccgctattgtcgcgctggaggcgttaaaagaacattgcgaagtcattttgagtaccgacagccagtatgtccgccagggtatcacccagtggatccataactggaaaaaacgtggttggaaaacagcagacaaaaaaccagtaaaaaatgtcgatctctggcaacgtcttgatgctgctctggggcagcatcaaatcaaatgggaatgggttaaaggccatgccggacacccggaaaacgaacgctgtgatgaactggctcgtgctgcggcaatgaatcccacactggaagatacaggctatcaagtcgaagtttaa

SEQ ID NO: 656 - protein, 192 aa, Escherichia coli
MVSVSRTIWRVIAVLIAVIYVRLIVLQFDSITGSLPEMLKQVEIFTDGSCLGNPGPGGYGAILRYRGREKTFSAGYTRTTNNRMELMAAIVALEALKEHCEVILSTDSQYVRQGITQWIHNWKKRGWKTADKKPVKNVDLWQRLDAALGQHQIKWEWVKGHAGHPENERCDELARAAAMNPTLEDTGYQVEV

SEQ ID NO: 657 - DNA, 741 bp, Escherichia coli
atgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaggtagccgatgagttcatggactatatccgcggcgcggagctggtgatccataacgcagcgttcgatatcggctttatggactacgagttttcgttgcttaagcgcgatattccgaagaccaataccttctgtaaggtcaccgatagccttgcggtggcgaggaaaatgtttcccggtaagcgcaacagcctcgatgcgttatgtgcccgctacgaaatagataacagtaaacgaacgctgcacggggcattactcgatgcccagatccttgcggaagtttatctggcgatgactggtgggcaaacgtcgatggcttttgcgatggaaggagagacacaacagcaacaaggtgaaacaacaattcagcgcattgtgcgtcaggcaagtaagttacgcgttgtttttgcgacagatgaagagcttgcagcacatgaagcccgtctcgatctggtgcagaagaaaggcggaagctgcctctggcgggcataa

SEQ ID NO: 658 - protein, 246 aa, Escherichia coli
MTAMSTAITRQIVLDTETTGMNQIGAHYEGHKIIEIGAVEVVNRRLTGNNFHVYLKPDRLVDPEAFGVHGIADEFLLDKPTFAEVADEFMDYIRGAELVIHNAAFDIGFMDYEFSLLKRDIPKTNTFCKVTDSLAVARKMFPGKRNSLDALCARYEIDNSKRTLHGALLDAQILAEVYLAMTGGQTSMAFAMEGETQQQQGETTIQRIVRQASKLRVVFATDEELAAHEARLDLVQKKGGSCLWRA

SEQ ID NO: 659 - DNA, 786 bp, Escherichia coli
atgaatttaaaaaaggtttgttgtatatgtgtattattctcgctgcttgcaggatgtgcctctgaatctcctattgatgaaaaaaagaaaaaaactcaaaccacacaaatttctattaataaaaacgttccccagcaactaacagacaaagatttatatggtaatgaaaccacactggctgtatccgaggaggatattcaagctgcgcttgaaggagatgagtttcgtgtgcctcttaattctcctgtaatacttgttcagtctggcagtcgcgcaccggaaaccattatgcaggaggagatgagaaaatattatacagttgccacattttctggcattcctgacaggaaaaaaactgtaacctgtaataaagacaaaaacaaagatgaaagcctggatattgtagatgccgaaaatatgaactggatgcaggcattgcgttttgttgcagcaaaaggccatcagaaagcgattattgttttccaggatacgttgcagacaggaaaatatgactctggattgaaatcaatagtttggacagattataaaaatcaaaaattgactgacacgatgtcactgcgttatttggttcgattcacgttggtggatgtggctacaggtgagtgggctacctggtcgcctgtgaattatgaatcgaaagtgatttttccgcagatagggaataaaaattctgacagccttgatgtggcagaacagcagatttcacaacttaagcagaaaacgtatgcagcagtggttaaagacctggtgaatcgatatcagtag

SEQ ID NO: 660 - protein, 261 aa, Escherichia coli
MNLKKVCCICVLFSLLAGCASESPIDEKKKKTQTTQISINKNVPQQLTDKDLYGNETTLAVSEEDIQAALEGDEFRVPLNSPVILVQSGSRAPETIMQEEMRKYYTVATFSGIPDRKKTVTCNKDKNKDESLDIVDAENMNWMQALRFVAAKGHQKAIIVFQDTLQTGKYDSGLKSIVWTDYKNQKLTDTMSLRYLVRFTLVDVATGEWATWSPVNYESKVIFPQIGNKNSDSLDVAEQQISQLKQKTYAAVVKDLVNRYQ

SEQ ID NO: 661 - DNA, 471 bp, Escherichia coli
cccgtctatctgacactgaacggagaacttcaggggctgatttcatccggatgctcgtcaatgccgtccatcggtaacaaagcccagattgcacatcaggatcagatcatggtgacgtcactgtcccatggtctgagccgtgcgcagaatgtcaaccatcaggagttgaccatcacgaaaccggtggacaaatcctcccctctgctgggcaaggccatttcagagaatgaatgtctgacctgtgattttgtattctaccgcaccaaccgctttggaattaatgaaccgtactacaagctgaaactggctaacgcccggctctcaaacatcggccttaccgttccccataccattaacgacagtccagggcaggcggaagagtctgtgtcatttacctatgagagcatcaattgggagcacagcgtcgccggaaccagtgcatacagcctttggagtgaacggattttctaa

SEQ ID NO: 662 - protein, 156 aa, Escherichia coli
PVYLTLNGELQGLISSGCSSMPSIGNKAQIAHQDQIMVTSLSHGLSRAQNVNHQELTITKPVDKSSPLLGKAISENECLTCDFVFYRTNRFGINEPYYKLKLANARLSNIGLTVPHTINDSPGQAEESVSFTYESINWEHSVAGTSAYSLWSERIF

SEQ ID NO: 663 - DNA, 1359 bp, Escherichia coli
atgagcaattacgcactgacacaaactatcgttaccggcagcgatccgcgcgccctgccggagttcagcgccatccgcgaagaaattaacaaagctaaccacccgtcacagccggagctgaactggaaactggtggaatcgctggcgctgtcgatttttaaggccaacggggtggatttgcataccgccacctactatacgctggcacgtacacgtaatcagggactggcagggttctgtgaaggcgcggaactgctggctgcgatgatcatccacgaatgggataaattctggccgcagagtggtccggcgcggactgagatgctggactggttcaacacccgcaccgggaatatcctgcgccagcaggtttccttttccgaaaatgatctttcgttgctctaccgcacggaacgggctttgcagcttatctgcgacaaactccagcaagtggaactgaagcgccagccgcgcgtggaaaatctgctttattttgtgcagaacacacgcaagcggtttgagccgcagcccagaaaccgtactgatacggcggcacagaccatggtcagaacgctggtctatgcgcctgaaggcacggcttccgccacagcggaaaccatgccccccctacccgacctgccggaaatgcgggtgggggtgcgcggtgtggcagataacgccgacaaagcaaaacagggcgacacggtaaaaggttttgttgccggtgccgcctgtactgccgttatcgcatctgcactctggtggtggcaggcgtatccgatgcagcagcagcttacacaggtcagggataccacacagggagccgccaccgtctggttggcatccccggtactgaaagaatatgaacagtacctgcaacagcttctgaatgccccgccactacagccgctggaaaccggaatgcagatgatgcgcaccgcagacaccctctggccggaaagcctgcaacagcaggaagccagcaggatgtggagcaacacgctgagaaaccgggcgcaagccagtccgcagatgaagggctggcaacaagcgcggcagaatttgcgggattttgcagatttgatgatgaagaaggagacggagaaacagggtttcaccctatcgtatatcaaaacggtgacctggcaggccgaacggttactgaatcaagaaacaccactggagtacctgctgacgcagtaccaggagacccgtacacagaagcaggacacacaggcgttggaaaaagagatcaacgaacggctggacgggctgttaagccgctggctgctgctgaaaaataccggacaggatatggcaacggataacagaaccgaacctgtccatccaactcattga

SEQ ID NO: 664 - protein, 452 aa, Escherichia coli
MSNYALTQTIVTGSDPRALPEFSAIREEINKANHPSQPELNWKLVESLALSIFKANGVDLHTATYYTLARTRNQGLAGFCEGAELLAAMIIHEWDKFWPQSGPARTEMLDWFNTRTGNILRQQVSFSENDLSLLYRTERALQLICDKLQQVELKRQPRVENLLYFVQNTRKRFEPQPRNRTDTAAQTMVRTLVYAPEGTASATAETMPPLPDLPEMRVGVRGVADNADKAKQGDTVKGFVAGAACTAVIASALWWWQAYPMQQQLTQVRDTTQGAATVWLASPVLKEYEQYLQQLLNAPPLQPLETGMQMMRTADTLWPESLQQQEASRMWSNTLRNRAQASPQMKGWQQARQNLRDFADLMMKKETEKQGFTLSYIKTVTWQAERLLNQETPLEYLLTQYQETRTQKQDTQALEKEINERLDGLLSRWLLLKNTGQDMATDNRTEPVHPTH

SEQ ID NO: 665 - DNA, 3528 bp, Escherichia coli
gtgttcaaatttcccacatcccgactgttcagcacgttgaaatctgcgctcaggccagcgatgccgcggtttaaagtttccgccacctggctactgacgctggcatggatttttctgctggtgtggatctggtggcagggtccaaaatggacgctctatgagcagcactggctggctccgctggcaaaccgctggctggcgaccgccgtctggggacttatcgctctggtctggctcacctggcgggtgatgaagcgtctgcaaaagctggaaaaacagcagaaacagcagcgggaggaagaaaaagatccgttgaccgtggaactccaccgccagcagcaatatctggatcactggctgctgcgcctgcgccgccatctggataaccgccgttatctgtggcagttgccgtggtatatggtcattggtcctgcgggtagcggcaaaagcacgctgctgcgcgagggctttccgtctgacattgtttacacgccggaaagcatccggggtgtggaataccacccgctgatcacaccgcgagtgggcaaccaggcggtaattttcgatgttgacggcgtactgaccactcccggcggggatgatctgctccgccgccgcctgcgcgaacactggctgggctggctgatgcaaacgcgcgctcgccagccgctcaacggtcttatcctgacgctcgatcttcccgatctgctgacggcggataaatcccgccgtgagacactggtacaaaatttgcgccagcaacttcaggagatccgtcagagcctgcactgccgtctgcccgtttacgtggtgctgacacggctggatctgctgaacggctttgccgcgctgttccattcactggataaaaaagaccgcgatgcgatcctcggcgtcacatttacccgccgcgcccatgaaagtgacggctggcgcagcgaactgggggctttctggcagacgtgggtacaacaggtgaacctggcgctgtcggatctggtgctcgcacaaaccggtgctgctccccgcagcgctgtgttcagcttctcccgtcagatgcagggaacaggagaaatcgtcaccgcactgctcgccgcattgctggacggtgagaacatggatgtaatgctgcgtggcgtctggctcacatcctcgctacagcgtggccaggtggatgatattttcacgcagtccgccgcccgccagtacggactgggtaacagctcgctggcaacctggcctctggtggagacgacgccgtattttactcgccgcctcttcccggaagtcctgctggctgagccgaacctggcgggtgaaaacagcgtctggctgaacagctcccggcgcaggctgaccgccttttccacctgtggcgcggcactggcggcattgatggtcggaagctggcaccattattacaatcagaactggcagtctggcgttaacgtactggcacaagctaaagcctttatggacgtaccaccaccgcagggaacggatgaattcggcaatctgcaattgccattgcttaacccggtacgcgatgccaccctggcctatggtgattatcgcgatcacggttttctggcggatatgggattgtaccagggcgcccgcgtagggccgtatgtggagcaaacctacattcagcttcttgagcagcgttatctcccctcgttaatgaacggcctgatccgggatctaaacattgccccgccagagagcgaagaaaagctcgctgtgctgcgcgtagtgcgcatgatggaagacaaaagtgggcgcaacaacgaggcggtaaaacagtacatggcacggcgctggagcaatgaatttcacggccagcgcgatattcaggcgcaactgatggtgcatctggactatgcgctggagcacaccgactggcacgcgcagcgccaaagcagcgacagcgatgctgtcagccgctggaccccctatgataaaccgatcattaatgcgcagcaggaactgagcaagctgcccatataccagcgtgtctaccagaccctgcgcaccaaagcattaagcgtgttgcccgccgatttgaatttgcgcgaccaggttggtcccaccttcgacaacgtgttcgtcgccggtaatgatgaaaaactggtgatcccgcagttcctcacccgctatggactgcaaagctattttgtcaaacagcgtgagggcctcgttgagctgaccgcgctggattcgtgggtactgaacctgacgcaaagcgtcgcctacagcgaggccgaccgtgaagagatccagcgccatatcaccgaacagtacatcagtgactataccgccacctggcgtgccggaatggataacctcaacgtccgtgactatgaggccatgtcggcgctgaccgacgcgctggagcagattatcagcggcgatcagccattccagcgtgcgctgacggcgctgcgcgataatacccacgcgctgacgctctccggcaaactggatgataaggcgagggaagcggcgataaatgagatggattaccgcctgttatcccggctggggcatgagttcgcaccggaaaacagcgcactggaggagcaaaaggacaaggcgagtacgctacaggccgtgtaccagcaactgaccgagctgcaccgttacctgctggcgatccagaactcgccagtgccggggaaatcggcgctgaaagcagtacagctacggctggatcaaaacagcagcgatccaatcttcgccacccgtcagatggcaaaaaccctgcctgcgcctcttaaccgctgggtaggtaagctcgcggatcaggcctggcatgtggtgatggtggaagccgttcgttacatggaagtggactggcgcgacaatgtagtgaaacccttcaacgagcagcttgccgataactatccgtttaatccgcgcgccacacaggatgcctcactggattcgtttgaacgtttctttaaaccggatggcattctggacaatttctacaagaacaacctgcgcctgttccttgaaaacgatctgacctttggcgacgacggcagagtgttaatccgtgaagatatccggcagcaactggataccgcgcagaaaatccgcgacatcttcttcagccagcagaacgggctgggcgcacagtttgccgtggaaaccgtatcgctttccggcaataagcggcgcagcgtacttaacctggacggccagttagtggactacagccagggacgcaactacaccgcccatctggtctggccgaacaacatgcgtgaaggcaatgaaagcaagctgacgctgattggcaccagcggcagagcaccgcgcagtatcgcgttcagtggaccgtgggcgcagttccgcctgttcggcgcgggccagttgaccaatgtgaccagtgacacctttaacgtgcgctttaacgtggacggcggcgcaatggtttaccaggtgcatgtggataccgaagataacccgttcaccggcggtctgttcagcctgttccgtttaccggatacgttgtattaa

SEQ ID NO: 666 - protein, 1175 aa, Escherichia coli
MFKFPTSRLFSTLKSALRPAMPRFKVSATWLLTLAWIFLLVWIWWQGPKWTLYEQHWLAPLANRWLATAVWGLIALVWLTWRVMKRLQKLEKQQKQQREEEKDPLTVELHRQQQYLDHWLLRLRRHLDNRRYLWQLPWYMVIGPAGSGKSTLLREGFPSDIVYTPESIRGVEYHPLITPRVGNQAVIFDVDGVLTTPGGDDLLRRRLREHWLGWLMQTRARQPLNGLILTLDLPDLLTADKSRRETLVQNLRQQLQEIRQSLHCRLPVYVVLTRLDLLNGFAALFHSLDKKDRDAILGVTFTRRAHESDGWRSELGAFWQTWVQQVNLALSDLVLAQTGAAPRSAVFSFSRQMQGTGEIVTALLAALLDGENMDVMLRGVWLTSSLQRGQVDDIFTQSAARQYGLGNSSLATWPLVETTPYFTRRLFPEVLLAEPNLAGENSVWLNSSRRRLTAFSTCGAALAALMVGSWHHYYNQNWQSGVNVLAQAKAFMDVPPPQGTDEFGNLQLPLLNPVRDATLAYGDYRDHGFLADMGLYQGARVGPYVEQTYIQLLEQRYLPSLMNGLIRDLNIAPPESEEKLAVLRVVRMMEDKSGRNNEAVKQYMARRWSNEFHGQRDIQAQLMVHLDYALEHTDWHAQRQSSDSDAVSRWTPYDKPIINAQQELSKLPIYQRVYQTLRTKALSVLPADLNLRDQVGPTFDNVFVAGNDEKLVIPQFLTRYGLQSYFVKQREGLVELTALDSWVLNLTQSVAYSEADREEIQRHITEQYISDYTATWRAGMDNLNVRDYEAMSALTDALEQIISGDQPFQRALTALRDNTHALTLSGKLDDKAREAAINEMDYRLLSRLGHEFAPENSALEEQKDKASTLQAVYQQLTELHRYLLAIQNSPVPGKSALKAVQLRLDQNSSDPIFATRQMAKTLPAPLNRWVGKLADQAWHVVMVEAVRYMEVDWRDNVVKPFNEQLADNYPFNPRATQDASLDSFERFFKPDGILDNFYKNNLRLFLENDLTFGDDGRVLIREDIRQQLDTAQKIRDIFFSQQNGLGAQFAVETVSLSGNKRRSVLNLDGQLVDYSQGRNYTAHLVWPNNMREGNESKLTLIGTSGRAPRSIAFSGPWAQFRLFGAGQLTNVTSDTFNVRFNVDGGAMVYQVHVDTEDNPFTGGLFSLFRLPDTLY

SEQ ID NO: 667 - DNA, 1443 bp, Escherichia coli
atggcaatggacttacgtaatcccgatgtatggcttgcacacctgctggaaaacctgccagaagataagctgtccgccgcgcttgatgatggcaatgcagactgggagtttgtcgacagcgaaatcgtcaagctcggttcactggcgcacagccagcttgatatcccggaacttcagcgccggggcctgatgcttctggcctcagaaaccaaagattttcgcctgctggcccacttgctgcgtaccctgcaacatgccggtgatattctgctggcctccaggatgctggcacaatatacagagcactactggacatgcgccgcaccgcagaacatggcccacaaaaaacgctttgccgcccaggtgataaaacgctttgagtctgccgttcaggactttgccgggaatgctgcgacaatacagcgcgatgctttgctgggagagctggcaaaactggcacagtgctggcaggcgcacaacgcgtctgagctggcaaaggcgacagacgatttattttccctgtttcagcgcgcgtttcgtgatgtagcgcctgaaatgacatcatctgcacgaagcgccgccattgcgccgcaggccacgaccggatatgtaccggatatgtcaccgcacacggttgccgctcagcctcctgttgcagccactccaatcccgcaggtcaccgttgaaaaccacgacgataaagcatggcgcgacaccctgctaaaggtggccgccattctctgtgagcgccagccggagtcaccgcagggttaccgactgcgccgccatgcgctgtggcaaaccatcaccagtaccccgcaggcagaaagcgatggccggaccccactggcagccttccctgtcgatatgatggatgattacctggcgcggctgaacaatgccgacatggcgctgtggcagcaggtggaaaaaagcctgctgctggccccgtactggctggacggtcattacctctcagcacagaccgcgctgcgcctcggttataaacaggtggcggatgctatccgtgatgaagttaccgattttctggcccgcctgcccgcactgatcaacctgttgtttaacgaccgcactccgtttgtgtccgaacagacgaaacagtggctggcatcatccggctcagtcaaccagaccgtcccggttgtacagaccgatgaagaattacaggcggccaaggcgtgcttcgatgaaaacgggctggaagccgcgctgcggtacctggaaaacctgcccgaaggtgatccccgccaccagtttcaccgccagtttttcggcgcgcagttactggaagaggccggtatggttcagcttgcacaacagcagtaccggatgctcttcagaacaggattacacatgatgctatccgaatgggagccttccctgctgaaagcactggaacaaaaactcacggcagaacagtaa

SEQ ID NO: 668 - protein, 480 aa, Escherichia coli
MAMDLRNPDVWLAHLLENLPEDKLSAALDDGNADWEFVDSEIVKLGSLAHSQLDIPELQRRGLMLLASETKDFRLLAHLLRTLQHAGDILLASRMLAQYTEHYWTCAAPQNMAHKKRFAAQVIKRFESAVQDFAGNAATIQRDALLGELAKLAQCWQAHNASELAKATDDLFSLFQRAFRDVAPEMTSSARSAAIAPQATTGYVPDMSPHTVAAQPPVAATPIPQVTVENHDDKAWRDTLLKVAAILCERQPESPQGYRLRRHALWQTITSTPQAESDGRTPLAAFPVDMMDDYLARLNNADMALWQQVEKSLLLAPYWLDGHYLSAQTALRLGYKQVADAIRDEVTDFLARLPALINLLFNDRTPFVSEQTKQWLASSGSVNQTVPVVQTDEELQAAKACFDENGLEAALRYLENLPEGDPRHQFHRQFFGAQLLEEAGMVQLAQQQYRMLFRTGLHMMLSEWEPSLLKALEQKLTAEQ

SEQ ID NO: 669 - DNA, 99 bp, Escherichia coli
gtgaaactggtggcggggatcaccttcgggcaggttttccaggtaccgcagcgcggcttccagcccgttttcatcgaagcacgccttggccgcctgtaa

SEQ ID NO: 670 - protein, 32 aa, Escherichia coli
MKLVAGITFGQVFQVPQRGFQPVFIEARLGRL

SEQ ID NO: 671 - DNA, 735 bp, Escherichia coli
ttgtgcgttttccggcagacaggatggtttatcgcgggcctgatggcgggcttacccgccagtgccgcgcccacagaaacatcgtcagtggccggtgtggcggtagctgtcgccacagcgacaccgccggatgcgacagccacgttacaggccatgcagtcctgccgccaggagacggcggcgctggagcggcttgactgttatgaccgcattcttgcgccggaacaggctggctttggtggtgccgcactggtgaaagctcgttaccaaggtgaagcctgggcccgcgcgacagaacaggaaaaacgccgccagggcaacaccacggagctgctggtaacgcaagtaccgggtgaacgcccgacggtggtgataaccaccccggctatcggccatgttccgccacgcccggtgctgatgttcagttgcgtggacaatatcacccggatgcaggtggcgctgatgcaccctctggatgtccatgatatcgccgtcaccctgaatgccgacagccgggcattgcgcagccactggtttgtgcgcgagaacggcaccctgctggagtccagccgggggttatccggtatcgatgaaattaagcaactgttcggcgcaaaaacgctgacggtggataccggcacagacaacgccgccggaaagctgacctttaacattgacgggctggcacgggttattgcgccgctacgcgacgcctgccactgggcgggagaataa

SEQ ID NO: 672 - protein, 244 aa, Escherichia coli
MCVFRQTGWFIAGLMAGLPASAAPTETSSVAGVAVAVATATPPDATATLQAMQSCRQETAALERLDCYDRILAPEQAGFGGAALVKARYQGEAWARATEQEKRRQGNTTELLVTQVPGERPTVVITTPAIGHVPPRPVLMFSCVDNITRMQVALMHPLDVHDIAVTLNADSRALRSHWFVRENGTLLESSRGLSGIDEIKQLFGAKTLTVDTGTDNAAGKLTFNIDGLARVIAPLRDACHWAGE

SEQ ID NO: 673 - DNA, 2694 bp, Escherichia coli
atggctgcctcggagtgtatgagccagcaggccagtgagatcaccgttgcccatgtgctgttacagatgctggcaatcccgcgcaacgacgtaagggtgattgccgaacgcacaggcatcagtgcggaggatttacgccaggcgctgaccgtggagagttatcccggtggacgttccgccgaaggctatcccagcttctccccgatgctgatcgaatggctcaaggagtcatggctgctggcctcagcccagatgcagcacagcgaactgcgcagcggcgtcctgctgcttactctgctgcattcaccgctgcgctatattccacccgctgctgcccgtctgctgacggccataaaccgcgaccagttacagcaggatttcgcagcatggacaaaagaatccgccgaatccgtggatctggctggcgggcaaacgccccgcgcaacggaaaccggcgacaccctgcttgcccgctacgccaaaaacatgaccgcagacgcccgtaacggcaggcttgacccggtactgtgccgcaactatgaaatcgacctgatgatcgacattctctgccgccgccgtaaaaacaatccggtggtagtgggcgaagcaggcgtgggtaaaagcgcgctgattgaagggctggcgctgcgcatcgtggcaggccaggtgccggacaagctgaaaaacaccgatatcatgacccttgacctgggcgcattgcaggccggtgcgtcggtgaaaggtgagtttgaaaaacgcttcaaggggctgatggcggaggtcattttctccccggtgccggtcattctgtttatcgacgaagcacataccctgattggcgcgggcaaccagcagggcgggctggatatatccaacctgctcaaaccagcgctggcgcgcggcgagctgaaaaccatcgccgccaccacctggagcgagtacaaaaaatatttcgagaaagatgcagctttgtcgcgccgcttccagttagtgaaggtcagcgaacccaacgctgccgaagccaccattattctgcgcggtttgtcggcggtctatgaacaatctcacggcgtgctgattgatgatgacgccttgcaggccgctgcgacactgagcgagcgttatctctccgggcgtcagttgccggacaaagccattgatgtgctggacaccgcctgcgcccgtgtggccatcaacctgtcatcgccgccaaaacaaatctcggcactgaccaccctgagccaccagcaggaggcagaaattcgccagcttgagcgcgagcttcgcatcgggctgcgtaccgacacctcacgaatgactgaggtgttggagcagtatgatgaaacgctgtcggcgctggacgaactggaagtcgcctggcagcagcagacgctggtacaggaaattatcgcgctgcgccagcagttactgggcgtggcagaagacgacgttgcgtcgttgccggacgcagatgccgtggaggatacgccgccagaggcagaacaggatagtaccgatgccgaatcggctgatgatgcaggcagcgtacagccggaagagaccgctgaaacagtttccccggtacaacggctggcacaactcactgccgaactggacgccctgcataacgaccagttgctggtttccccgcatgtcgataaaaaacagattgcagcggtgattgctgaatggaccggcgtgccgcttaaccgcctgtcacagaatgagatgtcggtcatcaccgacctgccggtatggctcggcggcaccatcaagggccaggacctggcgattgccagcctgcataaacacctgctgaccgcacgcgccgacctgcgccgtccgggacgcccgcttggtgcgttcctgctggctggccccagcggcgtgggtaaaaccgaaaccgtcctgcaactggcggaactgctctatggcggacgtcaatacctgaccaccatcaatatgtctgagttccaggagaaacacaccgtttcgcggctgattggctctcctccgggttatgtcggctacggtgaaggcggcgtactgaccgaagcgattcgccagaaaccgtactcggtggtgctgctcgatgaagtagaaaaagcgcacccggatgtactcaacctgttctaccaggcgtttgacaagggcgagatggcagacggtgaaggccgcctgattgactgtaaaaatatcgttttcttcctgacctccaaccttggctaccaggtgattgtcgaacacgccgatgacccggaaaccatgcaggaagccctctatccggtgctggcggacttctttaaacctgctctgctggcgcgcatggaagtggtgccttacctaccgctgtcgaaagagacgctcgctaccattattgccgggaaactggcccgcctggataacgtgctgcgcagccgctttggcgcggacgtgattattgggccggaagtgacggacgaaatcatgagccgcgtcacccgcgcggaaaacggcgcgaggatgctggaatcggttatcgacggcgacatgctgccgccgctctcgctgctgctgttgcagaaaatggcggccaacacggcgattgcccggattcgcctgtcggcggcagacggtgcgttcacggcagatgtggaagatgcgctgcctgatgatgccgtgacaccgcaaacagaggacgaaacggttttatga

SEQ ID NO: 674 - protein, 897 aa, Escherichia coli
MAASECMSQQASEITVAHVLLQMLAIPRNDVRVIAERTGISAEDLRQALTVESYPGGRSAEGYPSFSPMLIEWLKESWLLASAQMQHSELRSGVLLLTLLHSPLRYIPPAAARLLTAINRDQLQQDFAAWTKESAESVDLAGGQTPRATETGDTLLARYAKNMTADARNGRLDPVLCRNYEIDLMIDILCRRRKNNPVVVGEAGVGKSALIEGLALRIVAGQVPDKLKNTDIMTLDLGALQAGASVKGEFEKRFKGLMAEVIFSPVPVILFIDEAHTLIGAGNQQGGLDISNLLKPALARGELKTIAATTWSEYKKYFEKDAALSRRFQLVKVSEPNAAEATIILRGLSAVYEQSHGVLIDDDALQAAATLSERYLSGRQLPDKAIDVLDTACARVAINLSSPPKQISALTTLSHQQEAEIRQLERELRIGLRTDTSRMTEVLEQYDETLSALDELEVAWQQQTLVQEIIALRQQLLGVAEDDVASLPDADAVEDTPPEAEQDSTDAESADDAGSVQPEETAETVSPVQRLAQLTAELDALHNDQLLVSPHVDKKQIAAVIAEWTGVPLNRLSQNEMSVITDLPVWLGGTIKGQDLAIASLHKHLLTARADLRRPGRPLGAFLLAGPSGVGKTETVLQLAELLYGGRQYLTTINMSEFQEKHTVSRLIGSPPGYVGYGEGGVLTEAIRQKPYSVVLLDEVEKAHPDVLNLFYQAFDKGEMADGEGRLIDCKNIVFFLTSNLGYQVIVEHADDPETMQEALYPVLADFFKPALLARMEVVPYLPLSKETLATIIAGKLARLDNVLRSRFGADVIIGPEVTDEIMSRVTRAENGARMLESVIDGDMLPPLSLLLLQKMAANTAIARIRLSAADGAFTADVEDALPDDAVTPQTEDETVL

SEQ ID NO: 675 - DNA, 765 bp, Escherichia coli
atgagcgatatgagtgaagcgtcggtttttcccgtggagccggagagcggaacaccaggacgccagtaccgtctcgcccttcgcggcaacagcctgaatccaatgattgacgccgccacgccgttgctcggcatggtgatgcgtctgtccactatgaacagtcaggccatgccggaacatctgtttacccaggtagtaaccgatgtccaggccgtagagcaactactccaggaacagggatacgaaccgggcgtcattgtttcgttccgttacattctctgcacgtttattgatgaagcggcgctgggcaacggctggtccaacaaaaacgaatggatcaaacagtcgctgctggttcattttcataacgaagcctggggcggcgagaaagtgtttatcctgctcgaacgcctgatccgggagccggtacgttaccaggatctgctggaatttttatacctctgtttttcgctcggctttcgcgggcgctacaaggttgccattcagcaacaggatgaatttgagcggatctaccagcgcctgcaccatgccctgcacaaactgcgcggtgacgcgccatttccgctacttcatcagaagaacaacatacagggtgggcgttatcagttaatccgacgactgaccatcaagcatgtactgtgcggcggtcttgttgtgctgaccgtattttatctgttttatctgctgcgtctggacagccagacacaggatattctgcatcagctcaataaattactccgataa

SEQ ID NO: 676 - protein, 254 aa, Escherichia coli
MSDMSEASVFPVEPESGTPGRQYRLALRGNSLNPMIDAATPLLGMVMRLSTMNSQAMPEHLFTQVVTDVQAVEQLLQEQGYEPGVIVSFRYILCTFIDEAALGNGWSNKNEWIKQSLLVHFHNEAWGGEKVFILLERLIREPVRYQDLLEFLYLCFSLGFRGRYKVAIQQQDEFERIYQRLHHALHKLRGDAPFPLLHQKNNIQGGRYQLIRRLTIKHVLCGGLVVLTVFYLFYLLRLDSQTQDILHQLNKLLR

SEQ ID NO: 677 - DNA, 1347 bp, Escherichia coli
atggcaacaatgaaaaacaaagtgatctggcaggaagggctgtttgccctgccgcagcattttcagcaacagcagcgtcactgcgagtacctgctgacccgtcgtctggatgcactgggtgattttttctggggttttacggaactctccatcaatacagaactgcttgcccagggcaaaatcatgattgaccgtgcggcgggctgtatgcctgacggcaccgtattcagcattcccgaccaggatctgctgccggaacctttccagccgggaaccctttcatcgaaagagagccacaatatttatctggcgctgccggtgataagcgacgtgatcaatgaaatccaggggttgcacagcgccggtcagggtacggagcgttaccgcctcacccatacccgcgtccgtgattttcacactgacgaaggcgacgaacagccagtcggtctggggcagttgatccccaggatagtcagcggcgcagatgatctcagcgcgatggtgactctccccctgtgccgtatcctcaataaaaatgccaccggcgcgctggtgctggacaacacctttattcccaccattcaggccgtccgtgtcagcgggttgctcggggcattctccggcgaggtgcagggactgcttgccacccgcgccgctgacctggccgggcgcattggttcgcctgaacagagcgggatcgccgatgtggccgaatttatgatgttgcagatgcttaaccgctatcaaatgcagttcacgcatcgttcccaactgcacacgctgcatccggaagccttctaccgggatctggtggggctgctgggagaactgatgacctttaccgaaggtaatcgcctgccctgcaccgtggagccgtataatcaccgggatcttaccgcgaccttcaccagaaccgtgatcccggaactgcggcgcgcgctcaataccgtactggtgccgcgtgcgcagaatctgccgttgttcttttcagaggggacctggatcgccaccatcaacgatcccacattgttgcagtcctgcaagctggtactggcagtgcgcgccaggatgccctacgaccaggtacaacgccagttcatccagcagtcgaaagtggccgctaccgacaaaatccgcagcgtggtcagcgtgcaggtgccgggtattccgctgcacacgcttaccgctgcgccacgtcagttgccataccacgaaggttatgtttacttcgaactggaaaaaggcaccccggcctggcaggacgtgataaaagcgggcgcactggcgctgcatatctccggcagcttccccgatctgaacctccagctctgggctataaggggataa

SEQ ID NO: 678 - protein, 448 aa, Escherichia coli
MATMKNKVIWQEGLFALPQHFQQQQRHCEYLLTRRLDALGDFFWGFTELSINTELLAQGKIMIDRAAGCMPDGTVFSIPDQDLLPEPFQPGTLSSKESHNIYLALPVISDVINEIQGLHSAGQGTERYRLTHTRVRDFHTDEGDEQPVGLGQLIPRIVSGADDLSAMVTLPLCRILNKNATGALVLDNTFIPTIQAVRVSGLLGAFSGEVQGLLATRAADLAGRIGSPEQSGIADVAEFMMLQMLNRYQMQFTHRSQLHTLHPEAFYRDLVGLLGELMTFTEGNRLPCTVEPYNHRDLTATFTRTVIPELRRALNTVLVPRAQNLPLFFSEGTWIATINDPTLLQSCKLVLAVRARMPYDQVQRQFIQQSKVAATDKIRSVVSVQVPGIPLHTLTAAPRQLPYHEGYVYFELEKGTPAWQDVIKAGALALHISGSFPDLNLQLWAIRG

SEQ ID NO: 679 - DNA, 525 bp, Escherichia coli
atgaacggcaaagcgtttctggcctgcgttctgatgagcgtcgtattaactggctgtgaaacagcgaaaaaaatcagccaggtgatccgcaatccggatattcaggtcggaaagctgatggatcagtcaaccgagctgaccgtcacgctgctgaccgagccggacagcaacctgacggcggatggcgaagccgcgccggtggatgtccagttggtttatctgagcgacgactcaaaattccatgccgccgactacgaccaggttgccaccaccgcgctgcccgacgtgctggggaaaaactatatcgatcaccaggacttcaacctgttgccggataccgtaaaaacactgccgccgatcaagttggatgagaaaaccggttatatcggtgtcattgcctatttttcagacgaccaggccacagaatggaaacaaattgagtcggtagaaagtatcggccaccactatcgcctgctggtgcatatccgcgccagtgcgattgagatgaaaaaagaggaaaactga

SEQ ID NO: 680 - protein, 174 aa, Escherichia coli
MNGKAFLACVLMSVVLTGCETAKKISQVIRNPDIQVGKLMDQSTELTVTLLTEPDSNLTADGEAAPVDVQLVYLSDDSKFHAADYDQVATTALPDVLGKNYIDHQDFNLLPDTVKTLPPIKLDEKTGYIGVIAYFSDDQATEWKQIESVESIGHHYRLLVHIRASAIEMKKEEN

SEQ ID NO: 681 - DNA, 1347 bp, Escherichia coli
ttggtcagccgaaagtaccgcccgccatcacaatccgaatcagggaataattctatggaaccacttatggctgaggaaaaacagcaatcccgccaggcctcactgactttacaggtgatgaatggcaacgaactggaaagcggacgcgccgcaaaatgcctgttcagcgaaaacggcggtgatattggccatacgccggaatgtcactggcaggtacaggaccgggcgggaagcattgctgcgcgtgcctgtaccgttatccggcacgacggagcctattgcctgcggtgcctgacgccgggactgatgattaatctggccccggcctcttccgatgcgctcatccgcctgcgccagggggatgagatccagctcggcgcactggcgctgaaagtgtttctgcatgacggtgcagctgttacctatgacgagcggatggcgaccccggaaacgattgtaatgaaccgcgacagtctggcggacaccctgctgaccaccgagggacaaccggcgtatccgggaatgccgttccagcatcagcttgcccccacggtggcgcacggtttttccagcgatccgctccaggcactccagacggaaagcctgatggtggcagatgatccgatcgccccacgcgtttcccggcccgtagcccccgcatccgatctgacaggtgcaaacgggatcaacacgccgtttatggatctgccgcccggcaatgcccgtcatgaggacggcgatgaattttctgccatggcgcagtaccacctggccgtaaccccgctgctgcgcggtatggagtgtccgctgacgctgcacaattctcaggatgcggatgagtttctcgaagaggccggacgggcgttgcaggccgccattaagggattgctgagtctgcaacaacaacagaacagcctgtcggataaacacctgcgtccactagaagacaacccgttgcgccttgatatggactatgccaccgcgctgaacgtcatgttcgccgagggtaaaagcccggtacatctcgcagcacctgcggccatcgccgaaagcctgcgcaacatccggcatcatgaagaggctaaccgggcggcgattgtggaagcgttgcgtgtcatgctggacgccttttcgccgggcaacctgatgcgccgctttgcgcaataccgccgcagccatgaactgcgccagaaaatggacgacgcctgggcatggcagatgtacagcaactattacgatgagctggcctccagccgacagcagggatttgaaatgctgttcaatgaagtttatgcccaggtctatgaccgggtgctgcgcgaaacacagcgggagccggaagcatga

SEQ ID NO: 682 - protein, 448 aa, Escherichia coli
MVSRKYRPPSQSESGNNSMEPLMAEEKQQSRQASLTLQVMNGNELESGRAAKCLFSENGGDIGHTPECHWQVQDRAGSIAARACTVIRHDGAYCLRCLTPGLMINLAPASSDALIRLRQGDEIQLGALALKVFLHDGAAVTYDERMATPETIVMNRDSLADTLLTTEGQPAYPGMPFQHQLAPTVAHGFSSDPLQALQTESLMVADDPIAPRVSRPVAPASDLTGANGINTPFMDLPPGNARHEDGDEFSAMAQYHLAVTPLLRGMECPLTLHNSQDADEFLEEAGRALQAAIKGLLSLQQQQNSLSDKHLRPLEDNPLRLDMDYATALNVMFAEGKSPVHLAAPAAIAESLRNIRHHEEANRAAIVEALRVMLDAFSPGNLMRRFAQYRRSHELRQKMDDAWAWQMYSNYYDELASSRQQGFEMLFNEVYAQVYDRVLRETQREPEA

SEQ ID NO: 683 - DNA, 822 bp, Escherichia coli
gtgtttatccgacaggctgttctgttgttgttgcagactcagcaatcccttaatggcggcctgcaacgcccgtccggcctcttcgagaaactcatccgcatcctgagaattgtgcagcgtcagcggacactccataccgcgcagcagcggggttacggccaggtggtactgcgccatggcagaaaattcatcgccgtcctcatgacgggcattgccgggcggcagatccataaacggcgtgttgatcccgtttgcacctgtcagatcggatgcgggggctacgggccgggaaacgcgtggggcgatcggatcatctgccaccatcaggctttccgtctggagtgcctggagcggatcgctggaaaaaccgtgcgccaccgtgggggcaagctgatgctggaacggcattcccggatacgccggttgtccctcggtggtcagcagggtgtccgccagactgtcgcggttcattacaatcgtttccggggtcgccatccgctcgtcataggtaacagctgcaccgtcatgcagaaacactttcagcgccagtgcgccgagctggatctcatccccctggcgcaggcggatgagcgcatcggaagaggccggggccagattaatcatcagtcccggcgtcaggcaccgcaggcaataggctccgtcgtgccggataacggtacaggcacgcgcagcaatgcttcccgcccggtcctgtacctgccagtgacattccggcgtatggccaatatcaccgccgttttcgctgaacaggcattttgcggcgcgtccgctttccagttcgttgccattcatcacctgtaa

SEQ ID NO: 684 - protein, 273 aa, Escherichia coli
MFIRQAVLLLLQTQQSLNGGLQRPSGLFEKLIRILRIVQRQRTLHTAQQRGYGQVVLRHGRKFIAVLMTGIAGRQIHKRRVDPVCTCQIGCGGYGPGNAWGDRIICHHQAFRLECLERIAGKTVRHRGGKLMLERHSRIRRLSLGGQQGVRQTVAVHYNRFRGRHPLVIGNSCTVMQKHFQRQCAELDLIPLAQADERIGRGRGQINHQSRRQAPQAIGSVVPDNGTGTRSNASRPVLYLPVTFRRMANITAVFAEQAFCGASAFQFVAIHHL

SEQ ID NO: 685 - DNA, 1050 bp, Escherichia coli
atggcaggagaaaatgggccagcacgccctgatatagcgacaaaaccgccgttaccggcggatgtgcgcaactgcaatttctatgtgctgatggaggcgctgtaccgtcggcatggcgcgccgggccaggacatttccctgcgtaccgagcctgcccgggagatcgtgcgtttcagctctgacgccagtatcagttttccgggtacggacctgagtgcgctttcccgtagccagaacggacagtatgtactgcaaacccggttcctgggtttttccggcagccagtcgccgctaccgggctattatctggatcagatggcgcaggagtccgcacagaacgaagacggcctgaaagaatttctcgatctattcagccaccgctggacacagtttgcctatcatgcctggcgcaaataccgctactacatctgctttcgtagcggcggtactgacaccttttcacagcgcatgtacgcactggtcgggctgggtaatcagagcgtgcgtgacaggcttgccattaaccacagcaaaatgctggcctacgccggaattctggcaacaccaggccgcgcgccggaggttatctgtaatctggtgtcgcactgttttgatttgccggatgtcaccattgaacgctggcaactgcgtaaagtcgccattgatccggcacaccagaaccggctgggtgtacgtaatccgaaaggaaaaacggctggacatattccgggacgctccatactcggcgttaattttaccctcggcgcacgggtgccggatcgcagcggaaaattcctgttgcagattggcggcctgtcgcgggagcgttatctctcatttttacccgatggcgaaaatcacctgccgctgaccatgttcctttcctttattctgcgcgaccagtttgcctgggatttacggctgtgcctggcgccacagcaggctaaagggatgcgccttagcgatccggccagctcccgcctcggcagaaccagctttattggtcagccgaaagtaccgcccgccatcacaatccgaatcagggaataa

SEQ ID NO: 686 - protein, 349 aa, Escherichia coli
MAGENGPARPDIATKPPLPADVRNCNFYVLMEALYRRHGAPGQDISLRTEPAREIVRFSSDASISFPGTDLSALSRSQNGQYVLQTRFLGFSGSQSPLPGYYLDQMAQESAQNEDGLKEFLDLFSHRWTQFAYHAWRKYRYYICFRSGGTDTFSQRMYALVGLGNQSVRDRLAINHSKMLAYAGILATPGRAPEVICNLVSHCFDLPDVTIERWQLRKVAIDPAHQNRLGVRNPKGKTAGHIPGRSILGVNFTLGARVPDRSGKFLLQIGGLSRERYLSFLPDGENHLPLTMFLSFILRDQFAWDLRLCLAPQQAKGMRLSDPASSRLGRTSFIGQPKVPPAITIRIRE

SEQ ID NO: 687 - DNA, 1842 bp, Escherichia coli
gtggcttttgaagaacgttactaccgcgaagagctggattatcttcgccagctaggcaaactgctggcgcaggaaaaaccacatctggcccactttctggccgagaaagagggtgatccggacgtggagcgtctgatggaagcctttgcctttatgtccggtagcctgcgccagaaacttgaggacgaattccccgagttcacccatgggctgatccgtatgctgtgggcaaactatttacgcccggttccggccatgacggttattgcctatgaacccaaaaccgatcagttaaaagtccctgttcaggtctgtcgtaatgaactgatcagaagccgctcagaaaagtcctccctgactgctcagaaggtgctgcctgacaatcatgataaaatcgtttcttccgtagcctgccatttcacgctggcgcgcgatatctggctgcaaccactgcgcattctcgatacccgcaacgccagcagcctgaaagaaggcatcatagatatcagttttaccgcagataacaatgtctcccccgccatgcttgacctgaacaaaatcacgttctggctgggtaatgaagacgattatacccgacaccagctttatctgtggttttgcgaatgcctgatggatgcggaactgattgccggagagtaccgcctgccgctgccggatctgtggctggaggcggcgggttttgacaaccgggatgctctgctgccgtggccgaaaaatgtccacagcggctaccgcgtgcttcaggagtatttctgctatcccgaagccttcttctttttccatctgcgcgatgttgcgccgctaccagacgatttcccgatcaatgcgtttacgctgcgcctgcactttaaccgcccgttacctgccgacatcaagctgcgccaggattcgctgcgtctgcactgtacgccagccattaacctgtttacgcattatgcggaacccgtcaggccggatgggcggatggcggaatacccgctgcgcgccagccataagcatccggacgcctatgacatttttcaggtcagcacagtcaccagtaaagtcaaagtttcaggtactgaaatcagcccaggtagccaggcgcgtgtctggcccgaatttgaaagcttccagcaccagatggagtacagccgccagcgagaagtcgtctactggcatcaccggactaaaacgtccctgcttcaccacgggcttgaacactctatcgcctttgtccatgcagacggtagcattccgggcagctcacggtttaacgatgacgtgatcaccacgtcattaatctgtaccaaccgtatgatccctgcccggctgcataccggtgatatctgcgtggccgtcaacaaaaatccggcagtggcctcatttcgtaatgtcacgcgcccgacactgccgctctggccagtcacggacggcgacatgcactggtcgctgatttccgcgatgaacctgaactacctctccctgctggacagggagacactgatccagatcctgcggaccttcgacctgccaggtgctcaccatccgcagcgggccagactgtcacgccagaaactggatgccatagaaaaactcgaaaccaaacctgttgacaggttgtttaaaggcgtaccggttcgcgggctggcgaccacgctgtggatacgtcccgatccgtttatctgcgaaggtgaaatttatcttctgggtaccgtgctctcgcacttctttgccctctacgccagcatcaattcgtaccactgtctgaaaatcattaacacggaaagtcaggagtcctgggaatggcaggagaaaatgggccagcacgccctgatatag

SEQ ID NO: 688 - protein, 613 aa, Escherichia coli
MAFEERYYREELDYLRQLGKLLAQEKPHLAHFLAEKEGDPDVERLMEAFAFMSGSLRQKLEDEFPEFTHGLIRMLWANYLRPVPAMTVIAYEPKTDQLKVPVQVCRNELIRSRSEKSSLTAQKVLPDNHDKIVSSVACHFTLARDIWLQPLRILDTRNASSLKEGIIDISFTADNNVSPAMLDLNKITFWLGNEDDYTRHQLYLWFCECLMDAELIAGEYRLPLPDLWLEAAGFDNRDALLPWPKNVHSGYRVLQEYFCYPEAFFFFHLRDVAPLPDDFPINAFTLRLHFNRPLPADIKLRQDSLRLHCTPAINLFTHYAEPVRPDGRMAEYPLRASHKHPDAYDIFQVSTVTSKVKVSGTEISPGSQARVWPEFESFQHQMEYSRQREVVYWHHRTKTSLLHHGLEHSIAFVHADGSIPGSSRFNDDVITTSLICTNRMIPARLHTGDICVAVNKNPAVASFRNVTRPTLPLWPVTDGDMHWSLISAMNLNYLSLLDRETLIQILRTFDLPGAHHPQRARLSRQKLDAIEKLETKPVDRLFKGVPVRGLATTLWIRPDPFICEGEIYLLGTVLSHFFALYASINSYHCLKIINTESQESWEWQEKMGQHALI

SEQ ID NO: 689 - DNA, 426 bp, Escherichia coli
atgctaagacgggattcaggaccaaccggcagtctttttgaacgtatccgtgaggcggcaaatccgccttcatatcagaatccaaaagaagcactgatacgttccatcagacgtaacctgcgacaggtcctgaatacccgctccggcagttgttatggttcaccggagctggggattactgatttaaatgatgaatcgctggcctccagcgatttcagacgagaaatccgtaagtccattagccagtgcattttacattacgaacctcgtattaccgatgttgttgttacggctgctgcaccggatgaatacgcccctgtggaactgtgttttcatattgtggctacggtcgatgtcagcgaaaccaggggagtgtttgaatttgacattttgctggacaaccatcaacgctattgtgtggagtga

SEQ ID NO: 690 - protein, 141 aa, Escherichia coli
MLRRDSGPTGSLFERIREAANPPSYQNPKEALIRSIRRNLRQVLNTRSGSCYGSPELGITDLNDESLASSDFRREIRKSISQCILHYEPRITDVVVTAAAPDEYAPVELCFHIVATVDVSETRGVFEFDILLDNHQRYCVE

SEQ ID NO: 691 - DNA, 1485 bp, Escherichia coli
atgtcagtaaaggaagaaattgctcccgtcagcgcgtctcaaaccgccgcgcccccatctctgcttgatgaaatcatggcgcaaacccgcgtccagcctaaatcagaaagctacgatatcacccgccagggcgtgagcgcctttattgccgccatgttacagggcgacagtagcgctgaacctatcaatatcctggccgttgacgccatgattgctgatattgatgcccgaaccagcaggcagatggatgccattattcatgccccggagtttcaggaactggaatccctgctgcgctcgctgaagctgctggttgaacgcgcggatacacgggaaaacatcaaagtccatttcctgaatgtcactcaggaagaactgctggatgatttcgaatttgcacctgaaatcacgcagtctgcgtattacaagcatgtatattcaagcggttacggacaatttggcggtgagccagtggcggcggtaatcggcaactttgcctttaagaacaccacgccggatatgaagctgctgaaatatatcagccaggtcagcgcgatggcgcacagcccgttcctgtcgtcagtatcatccgaatttttcggtctggattcatggacagagttaccggggatcaaagaaccgggtgccatctttgaaggcccggcctactcccgctggcgcgccctgcgtgaatcggaagattcccgttacctgggcctgaccgccccccggttcctgctgcgccacccttactcaccggatgaaaaccctgtcaaaaccttccgttaccatgaagatgtcagccagagtcatgagtcttatctgtgggggaatacctcgtttttactggccgccaacctggcggaaagttttgctaagtatcgctggtgcccaaatattattggcccttccagcggcggcgcagtcaaagacctcccggtgcatctgtatgaatccatggggcaaatgcaggcaaaaattccgactgaagtgttgatcactgaccggagagagtatgagctggcggaagagggctttatcacactgaccatgcgtaaagggtctgataatgcgtgctttttctcggccaactcggtgcagaaacccaaaacattccccaaaacccccgaaggcaaggctgcggagaccaactataaactcggcacccagctgccatacttgtttgttatcagcaggttagcgcattacatcaaggtaattcagcgcgaacagcttggctcatggaaagaacgtagtgacctggagcgtgagctgaacacctggattcgccagtatgttgctgaccaggaaaatccgcctgccgaagtccgcagccaccggcctttgcgtcaggctaagatcgaggtactggatgtggatggtgagccgggctggtaccaggtcgcgatttctgtcagaccgcattttaaatacatgggtgccagtttcgacctgagcctggtcggacgactggataaggaataa

SEQ ID NO: 692 - protein, 494 aa, Escherichia coli
MSVKEEIAPVSASQTAAPPSLLDEIMAQTRVQPKSESYDITRQGVSAFIAAMLQGDSSAEPINILAVDAMIADIDARTSRQMDAIIHAPEFQELESLLRSLKLLVERADTRENIKVHFLNVTQEELLDDFEFAPEITQSAYYKHVYSSGYGQFGGEPVAAVIGNFAFKNTTPDMKLLKYISQVSAMAHSPFLSSVSSEFFGLDSWTELPGIKEPGAIFEGPAYSRWRALRESEDSRYLGLTAPRFLLRHPYSPDENPVKTFRYHEDVSQSHESYLWGNTSFLLAANLAESFAKYRWCPNIIGPSSGGAVKDLPVHLYESMGQMQAKIPTEVLITDRREYELAEEGFITLTMRKGSDNACFFSANSVQKPKTFPKTPEGKAAETNYKLGTQLPYLFVISRLAHYIKVIQREQLGSWKERSDLERELNTWIRQYVADQENPPAEVRSHRPLRQAKIEVLDVDGEPGWYQVAISVRPHFKYMGASFDLSLVGRLDKE

SEQ ID NO: 693 - DNA, 555 bp, Escherichia coli
ttgtatgcagtacgaaaatgctgtgctcatggcctgaacgggaacatttttatgagcaaaatgaacaacaatggcggcagtgtcgcgccgaaagaaagaatcagcgttcggtatacaccaaaagttgatggggtggctgctgatatcgaattgccgctgaatttattgatcaccggcaatctgaaagggaaaccagataacacgccgttggatgagcgaactgccattgctatcaaccgctataacctcaacgcagtcatttcagaagctgacattgaacgggagtttgttgttccggctgaactcagtgacgctcccaatgagcaaatgtacgtcaacctgaaagtcaaatctatggatgacctttctcctgaccatattgccagccaggtaccagaaataaaacgtctgctcgaattgcgtgaagccctagtcgcacttaagtctccactaggcaatattccagccttccgcgcacaacttcaggcgctactggaaaacgaagacacccgcgagcagctgatccaggaactgggtatcgccgttcagaaataa

SEQ ID NO: 694 - protein, 184 aa, Escherichia coli
MYAVRKCCAHGLNGNIFMSKMNNNGGSVAPKERISVRYTPKVDGVAADIELPLNLLITGNLKGKPDNTPLDERTAIAINRYNLNAVISEADIEREFVVPAELSDAPNEQMYVNLKVKSMDDLSPDHIASQVPEIKRLLELREALVALKSPLGNIPAFRAQLQALLENEDTREQLIQELGIAVQK

SEQ ID NO: 695 - DNA, 519 bp, Escherichia coli
atgccaaccccatgttacatttcaattacaggtcagacccaggggaacatcactgccggtgctttcaccgcagattctgtcggcaatatctacgtgcagggacacgaagatgaaatgctggtgcaggagtttctgcataacgttactgttccaaccgatccgcagtctggtcagccttccgggcagcgtgctcacaaaccgttcattttcaccgtggcgctgaacaaagccgttccgctgctgtacaacgcgctggcctccggtgaaatgctgccgaaagtggagctgcactggtggcgtacctctgttgaaggcaagcaggagcactacttcaccacacgtcttactgacgcgacgattgtggacatgaacctgcatatgccgcactgccaggaccctgcacagcgtgagtttacgcaattgctcgcagtatcactggcctaccgtaaggttgagtgggagcacatcaaatccggtacttctggtgccgatgactggcgtgcaccgctggaagcataa

SEQ ID NO: 696 - protein, 172 aa, Escherichia coli
MPTPCYISITGQTQGNITAGAFTADSVGNIYVQGHEDEMLVQEFLHNVTVPTDPQSGQPSGQRAHKPFIFTVALNKAVPLLYNALASGEMLPKVELHWWRTSVEGKQEHYFTTRLTDATIVDMNLHMPHCQDPAQREFTQLLAVSLAYRKVEWEHIKSGTSGADDWRAPLEA

SEQ ID NO: 697 - DNA, 1983 bp, Escherichia coli
atgtccttaaaaggtcttcgctttacgctggaggttgacggccaggagccggacacctttgcagtggtgaatttccggttaatccagaaccagtcttatccgtttgtgatgagtgtggatgtcgccagcgattcttttatgcagacggcggagatgctgctggagaagaacgcaacgctgactatctggcagggtgtcatcccgctgcgttatgtcaccggcgtggtggcgggctttggcatgcaggagaacaacggctggcagatgcgttatcacctgcgtattgagccgccgttatggcggtgcgggctgcggcggaacttccgtatcttccagcagcaggatatccggacgatatcggccacattactgaacgagaacggcgtcacagagtggacgccgctgttttatgaggaccatccggcgcgggagttctgtgtgcagtacggggagtcggacctggcgtttctggcgcggctgtgggcggaggaggggattttcttctttgagcggtttgcggcggacagtccggagcagaagctgacgctgtgcgacgatgtggcggggctgtcacaggcgggggagcttccgtttaacccggacacatcggcaggagcggagacggagtgtgtcagtatgttccgttatgaggcgcatgtccgcccgtcatcggtgcagagccaggattacacgtttaaggtgccggactggccggggatgtatgagcagcagggtgagagcctgaacggacagcttgaacagtatgaaatatttgattatccgggaaggtacaaggatgaacagcacggcaaggatttcacgctgtaccggatggagagcctgcgcagtgatgcggaaaaggccacagggcagagtaattcgccgaagctgtggccggggacgtggtttacgctgacggggcatccgcagaagatgctgaaccgtgaatggcaggtggtacagagcattctgtcaggagaccagccgcaggcgcttcacggcagccaggggagaggaaccacgctgggaaatcagttagaggtgataccggcggaccggacgtggcgtccacggctgcaaagcaaaccgaaggtggacgggccacagagcgccattgtcaccgggcctgcgggagaggaaatcttctgtgatgaacatggccgggtacgggtgaagtttcactgggacaggtataacccggcaacggaggcgagttcgtgctgggtgagggtgtcacaggcgtgggcggggccggggtttggtaacctggcgataccgcgcgtgggccaggaggtgattgttgacttcctgaacggggacccggaccagccgataatcatggggcggacgtaccatgaggacaaccgttcgccggggagcctgccggggacgaagacgcagatgacgatacggtcgaagacctataaaggaagcggctttaatgaactgcggtttgaagacgccacgggcggtgaacaggtctatatccacgcgcagaagaacatggatacggaggtgctgaataatcggacgacggatgtgaaggctgaccacacggagaccattggtaacgaccagaagataacggtggggttgggccagacggtgaatgtggggagcaaaaaggaaggtggtcatgaccagaaagtgacggtagcgaacgatcagcatctcacgataaaaaatgaccggcacaaggttgtaaataacaaccagacaagcaaggtgacgggaactgataccgaagaagtcgtcaaaaaacagagtattaaaataggtgataattacgaactgaaagttgagcatggtacaaatatcatatctggggacagtattgagctaatttgtgggcagggagagagcgggacttgttccataaaactggagaaaacaggaaagataataatacgggggacggagtttctatttgaggctaccggtcctgtagatattaaaggaaaagatattcatctgaacggatag

SEQ ID NO: 698 - protein, 660 aa, Escherichia coli
MSLKGLRFTLEVDGQEPDTFAVVNFRLIQNQSYPFVMSVDVASDSFMQTAEMLLEKNATLTIWQGVIPLRYVTGVVAGFGMQENNGWQMRYHLRIEPPLWRCGLRRNFRIFQQQDIRTISATLLNENGVTEWTPLFYEDHPAREFCVQYGESDLAFLARLWAEEGIFFFERFAADSPEQKLTLCDDVAGLSQAGELPFNPDTSAGAETECVSMFRYEAHVRPSSVQSQDYTFKVPDWPGMYEQQGESLNGQLEQYEIFDYPGRYKDEQHGKDFTLYRMESLRSDAEKATGQSNSPKLWPGTWFTLTGHPQKMLNREWQVVQSILSGDQPQALHGSQGRGTTLGNQLEVIPADRTWRPRLQSKPKVDGPQSAIVTGPAGEEIFCDEHGRVRVKFHWDRYNPATEASSCWVRVSQAWAGPGFGNLAIPRVGQEVIVDFLNGDPDQPIIMGRTYHEDNRSPGSLPGTKTQMTIRSKTYKGSGFNELRFEDATGGEQVYIHAQKNMDTEVLNNRTTDVKADHTETIGNDQKITVGLGQTVNVGSKKEGGHDQKVTVANDQHLTIKNDRHKVVNNNQTSKVTGTDTEEVVKKQSIKIGDNYELKVEHGTNIISGDSIELICGQGESGTCSIKLEKTGKIIIRGTEFLFEATGPVDIKGKDIHLNG

SEQ ID NO: 699 - DNA, 1047 bp, Escherichia coli
atgatagaaatgaaaaataacacgccatttcctttgttgtcatttgaaaaatatggtcgttatggtcttttgtttgatgttattgctattaaaatgtcattgcgaattaaaaatggattttatgctgatcttgctgagtttcaaaaagaattgtccatgtctgatgaatactatggggagtctgaaacaagtagtctaaaatctgaaacagacttagttctttgtaaaagaaatacagatattcacgtgacaggtagtgctcatgccccttcaggggataagtctcagtggaaggcttgtgtgagggttaatagtttttctaaagaactgagtttatctggtgtccgctacttacaatatgagcgaaatcgttggcagatgagcttaccagataaaattattaatgttcctctacgctatgagcttgcttacggtggtatttggcaaccagatggtatggagaaattggttttttcagcaaaccctgtaggttgtggatattatcctgatatttctcaacttaatacaagttgtcaatataaactcccacaaataaccagctctgctttgtcagaaaacgctaccatttttaatggggaatctgacttttttcaaggtgttggccctgtatctcgatggtggaaaagtcgcctccagtatgcaggaacctacaatgaagtatggcgtgaaaagcgctatccctatttgccggatgattttgatgagcggttctacaatagtgctcatccggatatgatatacacggggtttctctctggcgatgaaaacatctctcttgaaggtttttttaaatttgaacaggttgttaagacaaaattgccaggtatacgacctgtacttatattaaaaaccaagcataatacatcacatatgttcttacctgttgcggatacaatggttatcgatttaagtcgacaggaaatataccttacctggagattaacaatacctgatttttttggaatgaaagaaggagtgctgagttgtattattcctgaatgtatagggaaaaaatattatgggtaa

SEQ ID NO: 700 - protein, 348 aa, Escherichia coli
MIEMKNNTPFPLLSFEKYGRYGLLFDVIAIKMSLRIKNGFYADLAEFQKELSMSDEYYGESETSSLKSETDLVLCKRNTDIHVTGSAHAPSGDKSQWKACVRVNSFSKELSLSGVRYLQYERNRWQMSLPDKIINVPLRYELAYGGIWQPDGMEKLVFSANPVGCGYYPDISQLNTSCQYKLPQITSSALSENATIFNGESDFFQGVGPVSRWWKSRLQYAGTYNEVWREKRYPYLPDDFDERFYNSAHPDMIYTGFLSGDENISLEGFFKFEQVVKTKLPGIRPVLILKTKHNTSHMFLPVADTMVIDLSRQEIYLTWRLTIPDFFGMKEGVLSCIIPECIGKKYYG

SEQ ID NO: 701 - DNA, 1440 bp, Escherichia coli
atgggtaactatcatatcggggatggtgaatgtagatttagagtcgtgtgttcttcaccagatgtatgtgaagtaggaggttacaaggttccttttgacagttaccagactttagatagtgaaagacagtacagttcaacggtatgggcgcgtggatgcagagctttaaatgttggttcagtgattgctggaactcaaagtaatgccggtaaaggtgtcatatccggtacatctcaaggaacgggtgactgtgttattttaacgggaagtccgactgtaacaatagaagggaaacctgttgcttatcatggttcagttgttgggattaataaccacaactgccttggtaaattgtataccaaaataaaatcaccaatgatttctgtcattgatagaacttttaattatgaaaggactgctgaagtaatacacgatttactgcttctgaaggatctcctctctgttggtaatatttttgacggagatatttcacctgaggttaaaaatgatttatttcaaataaaagatcctgaccaatcatggggggagtttttttcaataaagaatatcagagaatctctcaggaatggtattgaaggagataaatctcagatcagagaatggtttggagagaacacacttactcaaatggggaatggagcaatcaccactttacatggtgtggcggatttagccttagttacattcgatgctctgttagatacggcaacggcaacggttgcttgcccgataggcgaagatgggttatgtgaacaggcaaatataaatttaaatgaaaaagaacaggctttatttaatattagtaattcattgataaatgggcaagcatgggatgcacttaaaaaaatgataatggatacaaataatggtgatcagattgctctggagcattttgccagctttttatggggctttatgatacccgcaaaaataccagaagaaaatatctctgggaaagtatttgtagagccagtagttttagaaggtggtgctggtggcaattggacagtatttgatgaggttttagattcaaatgtaataaagcaattgactttaacaggctgtggagcggcctgtggggaaatgttgcttagggataggtatatttttgtcacgcaaaatgtaattggaacagaattaacatctatgacgtcgctggcaaacaagcttaataaatttgatgtcggctgggaagggaatgcagtgagcgaatctagtttatatgccctcagtaatactggttcatggggagcaatgatgtgggattctggaagtaaagtagggcattgggtacttgttaagggtgttgatgatgctgggaatgtgataatatatgatccatatcaagggagtcgatatctgatgactgaacaggaatttaaggaggtatggaatgggcatagtgtttacaaaccataa

SEQ ID NO: 702 - protein, 479 aa, Escherichia coli
MGNYHIGDGECRFRVVCSSPDVCEVGGYKVPFDSYQTLDSERQYSSTVWARGCRALNVGSVIAGTQSNAGKGVISGTSQGTGDCVILTGSPTVTIEGKPVAYHGSVVGINNHNCLGKLYTKIKSPMISVIDRTFNYERTAEVIHDLLLLKDLLSVGNIFDGDISPEVKNDLFQIKDPDQSWGEFFSIKNIRESLRNGIEGDKSQIREWFGENTLTQMGNGAITTLHGVADLALVTFDALLDTATATVACPIGEDGLCEQANINLNEKEQALFNISNSLINGQAWDALKKMIMDTNNGDQIALEHFASFLWGFMIPAKIPEENISGKVFVEPVVLEGGAGGNWTVFDEVLDSNVIKQLTLTGCGAACGEMLLRDRYIFVTQNVIGTELTSMTSLANKLNKFDVGWEGNAVSESSLYALSNTGSWGAMMWDSGSKVGHWVLVKGVDDAGNVIIYDPYQGSRYLMTEQEFKEVWNGHSVYKP

SEQ ID NO: 703 - DNA, 486 bp, Escherichia coli
atgcgtgactgccattcctcagatgataaagatgtcattgcaattgatggaaaaacgcttcggcactcttatgacaagagtcgccgcaagggagcgatttatgtcattaaaatccgtcttcatattatttgcgatgtccctgatgaacttattgatttcacgtttgaatggaaagagctgaagaaattatgcatggcagtctcctttcgttcaataataacagaacaaaagaaagagccagaaatgacggacagatattatagcatttctgctgatttaaccgcagagaagttcgccacagcgaaccgaaatcactggtacgtggagaataagctgcactggcatctggacgtggtaatgaataaagacgactgcaaaataagaagaggaaatgcagcagaattattttcagggatacggaagatcgctattaatattttaacgaaagataagatactcaaggcaggggcaagatgtaagatgtga

SEQ ID NO: 704 - protein, 161 aa, Escherichia coli
MRDCHSSDDKDVIAIDGKTLRHSYDKSRRKGAIYVIKIRLHIICDVPDELIDFTFEWKELKKLCMAVSFRSIITEQKKEPEMTDRYYSISADLTAEKFATANRNHWYVENKLHWHLDVVMNKDDCKIRRGNAAELFSGIRKIAINILTKDKILKAGARCKM

SEQ ID NO: 705 - DNA, 513 bp, Escherichia coli
atgaataaacggattgaatgtgttatgttaaaaatgagtttatacgtaataatattgttattttcccttcagtttagtgcagccattactggcaaggaaagtgaggttgtttcaccattattaatggatgttaatccttcactaacaatggaaaatatttctgaattatccacatcatcggaaccatcgcaacagggggtatttcctgtaatatgtactcgacttcatcctggctccgtaatgaaacgtcagttattaaccggctgggggcctgtttttataattggtgatgatcctttttctctgcgctggatgagtgaacatctggagatccttaaatcgctaaatgcccttggtttggttgttaatgttgaatcagtagaacgaatggaggtattacagcagcgggctgatgggttattgttattgccagttatctgcgataattttgtgcaagctctgcaattaaatgcttatccggtattaatcacagagatggaaatatcacaatga

SEQ ID NO: 706 - protein, 170 aa, Escherichia coli
MNKRIECVMLKMSLYVIILLFSLQFSAAITGKESEVVSPLLMDVNPSLTMENISELSTSSEPSQQGVFPVICTRLHPGSVMKRQLLTGWGPVFIIGDDPFSLRWMSEHLEILKSLNALGLVVNVESVERMEVLQQRADGLLLLPVICDNFVQALQLNAYPVLITEMEISQ

SEQ ID NO: 707 - DNA, 771 bp, Escherichia coli
gtgcctggtttgaagattacgcttttgcagcaaccactggtgtggatggatggtcctgccaacctgcgccattttgatcgtcaactggaaggtattaccgggcgcgatgtgatcgttctaccggagatgtttaccagcggctttgccatggaagcggcagcttcgtcgctagcacaagatgacgtagtgaactggatgaccgctaaagcgcagcagtgcaatgcgctgattgcaggcagtgttgcattacaaacggagtctggttcggttaaccgctttttgctggttgagccgggcggcacggtacatttttatgataagcgtcatctgttccgcatggcagatgagcatctacattataaagcgggcaatgcgcgagtgattgtggaatggcgcggctggcgtattttgccgctggtgtgctacgacttacgttttccggtgtggtcgcgcaatctcaacgattatgacctcgccctgtacgtcgccaactggcctgctccgcgctctctgcactggcaggcattgctgacagcccgcgcgattgagaatcaagcgtatgtggcgggatgcaatcgcgtcggcagcgatggcaacggctgccattatcgcggtgacagccgggtgattaatccgcaaggcgagattatcgctactgccgacgcgcatcaggcaacgcgcattgatgcggagctgtcgatgatggcattgcgggaatatagagaaaagtttccggcatggcgggatgcggatgagtttaggttgtggtga

SEQ ID NO: 708 - protein, 256 aa, Escherichia coli
MPGLKITLLQQPLVWMDGPANLRHFDRQLEGITGRDVIVLPEMFTSGFAMEAAASSLAQDDVVNWMTAKAQQCNALIAGSVALQTESGSVNRFLLVEPGGTVHFYDKRHLFRMADEHLHYKAGNARVIVEWRGWRILPLVCYDLRFPVWSRNLNDYDLALYVANWPAPRSLHWQALLTARAIENQAYVAGCNRVGSDGNGCHYRGDSRVINPQGEIIATADAHQATRIDAELSMMALREYREKFPAWRDADEFRLW

SEQ ID NO: 709 - DNA, 93 bp, Escherichia coli
gtgattaactccctaaagcctggcgataacacgataatttgcaaatcagatatttccaatatcagcatttgttatcaatttattctgcgctaa

SEQ ID NO: 710 - protein, 30 aa, Escherichia coli
MINSLKPGDNTIICKSDISNISICYQFILR

SEQ ID NO: 711 - DNA, 447 bp, Escherichia coli
atgtttaaggcaataacgacagtcgccgctctggtcatcgccaccagtgcaatggcgcaggatgatttaaccattagcagtcttgcaaagggcgaaaccaccaaagcggcgtttaatcagatggtgcaagggcataagctgcctgcctgggtgatgaaaggcggtacttatactcccgcacaaaccgtgactttgggagatgagacgtatcaggtgatgagcgcgtgcaaaccgcatgactgtggctcgcaacgtatcgctgtgatgtggtccgagaaatctaatcagatgacggggctgttctcgactattgatgagaaaacgtcgcaagagaaactcacctggttgaatgtgaacgatgcgctttcgattgatggcaaaacggtgctgttcgcggcgttgaccggcagcctggaaaaccatccggatggctttaattttaaataa

SEQ ID NO: 712 - protein, 148 aa, Escherichia coli
MFKAITTVAALVIATSAMAQDDLTISSLAKGETTKAAFNQMVQGHKLPAWVMKGGTYTPAQTVTLGDETYQVMSACKPHDCGSQRIAVMWSEKSNQMTGLFSTIDEKTSQEKLTWLNVNDALSIDGKTVLFAALTGSLENHPDGFNFK

SEQ ID NO: 713 - DNA, 2445 bp, Escherichia coli
atgatgattttgagtattctcgctacggttgtcctgctcagcgcattgttctatcaccgcgtgagcttatttatcagcagtctgattttgctcgcctggacagccgcactcggcgttgctggtctgtggtcggcgtgggtactggtgcctctggccattatcctcgtgccatttaactttgcgcctatgcgtaagtcgatgatttccgcgccggtatttcgcggtttccgtaaggtaatgccgccgatgtcgcgcactgagaaagaagcgattgatgcgggcaccacctggtgggagggcgacttgttccagggcaagccggactggaaaaagctgcataactatccgcagccgcgcctgaccgcagaagagcaagcgtttctcgacggcccggtagaagaagcctgccggatggcgaatgatttccagattactcatgagctggcggacctgccgccggagttatgggcgtaccttaaagagcatcgtttcttcgcgatgatcatcaaaaaagagtacggcgggctggagttctcggcttatgcccagtctcgcgtgctgcaaaaactctccggcgtgagcgggatcctggcgattaccgtcggcgtgccgaactcattaggcccgggcgagctgctgcaacattacggcactgacgagcagaaaaatcactatctgccgcgtctggcgcgtggtcaggagatcccttgctttgcactgaccagcccggaagcgggttccgatgcgggcgcgattccggataccgggattgtctgcatgggcgaatggcagggccagcaggtgatggggatgcgtctgacctggaacaaacgctacattacgctggcaccgattgcgaccgtgcttggtctggcgtttaaactctccgacccggagaaattactcggcggtgcagaagatttaggtattacctgtgcgctgatcccgaccaccacgccgggcgtggaaattggtcgtcgccacttcccgctgaacgtaccgttccagaacggaccgacgcgcggtaaagatgtgttcgtgccgatcgattacatcatcggcgggccgaaaatggccgggcaaggctggcggatgctggtggagtgcctctcggtaggccgcggcatcaccctgccttccaactcaaccggcggcgtgaaatcggtagcgctggcaacgggcgcgtatgcgtacattcgtcggcagttcaaaatctctatcggtaagatggaagggattgaagagccgctggcgcgtattgccgggaacgcttatgtaatggatgctgcggcatcgctgattacctacggcattatgctcggtgaaaaacctgccgtgctgtcggctatcgttaagtatcactgtacccaccgcgggcagcagtcgattattgatgcgatggatatcaccgggggcaaaggcattatgctcgggcaaagcaacttcctggcccgtgcttaccagggcgcaccgattgccatcaccgttgaaggggctaacattctgacccgcagcatgatgatcttcggacaaggagcaattcgttgccatccgtacgtgctggaagagatggaagcggcgaagaacaatgacgtaaatgcgttcgataaactgctgttcaaacatatcggtcacgtcggtagcaacaaagttcgcagcttctggctgggcctgacgcgcggtttaaccagcagcacaccaaccggcgatgccactaaacgctactatcagcacctgaaccgcctgagcgccaacctcgccctgctttctgatgtctcgatggcggtgctgggcggcagcctgaaacgtcgtgagcgtatctcggcccgtctgggggatattttaagccagctttacctcgcctctgccgttctgaagcgttatgacgacgaaggccgtaatgaagccgatctgccgctggtgcactggggcgtacaggatgcgctgtatcaggcagaacaggcgatggacgatttactgcaaaacttcccgaaccgtgtggttgccgggctgctgaatgtggtgatcttcccgaccggacgtcattacctggcaccgtctgacaagctggatcataaagtggcgaagattttacaagtaccgaacgccactcgttcacgtattggtcgcggtcagtacctgacgccaagcgagcataacccggttggtttactggaagaggcgctggtggatgtgattgccgccgacccgattcatcagcggatctgtaaagagttgggtaaaaacctgccgtttacccgtctggatgaactggcgcacaacgcgctggcgaaggggctgattgataaagatgaagccgctattctggtaaaagctgaagaaagccgtttacgcagtattaacgttgatgactttgatccagaagagctggcgacgaagccggtaaagttgccggagaaagtgcggaaagttgaagccgcgtaa

SEQ ID NO: 714 - protein, 814 aa, Escherichia coli
MMILSILATVVLLSALFYHRVSLFISSLILLAWTAALGVAGLWSAWVLVPLAIILVPFNFAPMRKSMISAPVFRGFRKVMPPMSRTEKEAIDAGTTWWEGDLFQGKPDWKKLHNYPQPRLTAEEQAFLDGPVEEACRMANDFQITHELADLPPELWAYLKEHRFFAMIIKKEYGGLEFSAYAQSRVLQKLSGVSGILAITVGVPNSLGPGELLQHYGTDEQKNHYLPRLARGQEIPCFALTSPEAGSDAGAIPDTGIVCMGEWQGQQVMGMRLTWNKRYITLAPIATVLGLAFKLSDPEKLLGGAEDLGITCALIPTTTPGVEIGRRHFPLNVPFQNGPTRGKDVFVPIDYIIGGPKMAGQGWRMLVECLSVGRGITLPSNSTGGVKSVALATGAYAYIRRQFKISIGKMEGIEEPLARIAGNAYVMDAAASLITYGIMLGEKPAVLSAIVKYHCTHRGQQSIIDAMDITGGKGIMLGQSNFLARAYQGAPIAITVEGANILTRSMMIFGQGAIRCHPYVLEEMEAAKNNDVNAFDKLLFKHIGHVGSNKVRSFWLGLTRGLTSSTPTGDATKRYYQHLNRLSANLALLSDVSMAVLGGSLKRRERISARLGDILSQLYLASAVLKRYDDEGRNEADLPLVHWGVQDALYQAEQAMDDLLQNFPNRVVAGLLNVVIFPTGRHYLAPSDKLDHKVAKILQVPNATRSRIGRGQYLTPSEHNPVGLLEEALVDVIAADPIHQRICKELGKNLPFTRLDELAHNALAKGLIDKDEAAILVKAEESRLRSINVDDFDPEELATKPVKLPEKVRKVEAA

SEQ ID NO: 715 - DNA, 741 bp, Escherichia coli
atgtgtttacaatataattacaacaaagctcacattgttgctgtttttatccgcacttcaggtcaaaaagtcctggtcatagcacctgcccgtacttctcgcttttggtggtatccggtacactgcattttgtctattacttttatgctgaaggatatcctcatgtaccaggatcttattcgtaatgaactgaacgaagcggcggaaacgctggctaactttttaaaagatgacgccaatattcacgccattcagcgcgcggcggtcctgttagcagacagctttaaagccggtggcaaagtgctttcctgtggcaacggcggctcccattgcgacgccatgcactttgccgaagagttgaccggtcgctaccgtgaaaaccgtccgggctacccggcgattgccatttctgacgttagtcatatttcctgcgtcggtaacgattttggtttcaatgatattttctcccgttacgttgaagcggtaggtcgcgaaggcgatgtactgctggggatctccacttccggtaactctgcaaacgtgatcaaagcgatcgcggcggcgcgtgagaaggggatgaaagtgatcaccctgaccggtaaagacggcggcaaaatggctggcacggcggatattgaaattcgcgttccgcactttggttatgccgaccgcattcaggagatccacattaaagtgatccatatcctgatccagttaattgaaaaagagatggttaagtaa

SEQ ID NO: 716 - protein, 246 aa, Escherichia coli
MCLQYNYNKAHIVAVFIRTSGQKVLVIAPARTSRFWWYPVHCILSITFMLKDILMYQDLIRNELNEAAETLANFLKDDANIHAIQRAAVLLADSFKAGGKVLSCGNGGSHCDAMHFAEELTGRYRENRPGYPAIAISDVSHISCVGNDFGFNDIFSRYVEAVGREGDVLLGISTSGNSANVIKAIAAAREKGMKVITLTGKDGGKMAGTADIEIRVPHFGYADRIQEIHIKVIHILIQLIEKEMVK

SEQ ID NO: 717 - DNA, 741 bp, Escherichia coli
atgcgtaaaatcgcattaattcttgcgatgttgttgatcccgtgcgtttcgtttgccggtttgctgggcagcagtagctcgaccacgccagtgagcaaagagtataagcagcagttgatgggatcccctgtctacatccagatcttcaaggaagaacgtacgctcgatctctacgtcaaaatgggcgagcaatatcaactgctcgacagctataaaatctgtaaatattccggcggcttagggccaaaacagcgtcagggcgatttcaaaagcccggaagggttttatagcgtccagcgtaatcagttaaaaccagacagccgttactacaaagcgattaatattggattcccaaacgcctatgaccgtgcgcatggttatgaagggaaatacctgatgattcacggcgattgtgtttccatcggctgctacgcgatgaccaatcagggtattgatgagatcttccagttcgttactggtgcgctggtgtttggtcagccgagcgtgcaagtgagtatttatccgttccgcatgaccgacgccaatatgaagcgccataaatattccaactttaaggacttctgggagcaactgaagccgggctacgactactttgagcaaacccgtaagccaccgaccgtttctgtggtcaatggccgttacgtggtcagcaagccgttaagccacgaagttgtgcagccacaactggcatcaaactacacactccccgaggcaaaataa

SEQ ID NO: 718 - protein, 246 aa, Escherichia coli
MRKIALILAMLLIPCVSFAGLLGSSSSTTPVSKEYKQQLMGSPVYIQIFKEERTLDLYVKMGEQYQLLDSYKICKYSGGLGPKQRQGDFKSPEGFYSVQRNQLKPDSRYYKAINIGFPNAYDRAHGYEGKYLMIHGDCVSIGCYAMTNQGIDEIFQFVTGALVFGQPSVQVSIYPFRMTDANMKRHKYSNFKDFWEQLKPGYDYFEQTRKPPTVSVVNGRYVVSKPLSHEVVQPQLASNYTLPEAK

SEQ ID NO: 719 - DNA, 768 bp, Escherichia coli
atgtgcgaattgctcgggatgagcgccaacgtccctaccgatatctgctttagtttcaccggacttgtacagcgtggtggtggaaccgggccacataaagatggctggggcattaccttttacgaaggtaaaggctgtcgcacatttaaagatccgcaacccagctttaattcccccatcgccaaacttgtccaggactacccgataaaatcctgttcggtgttggctcatattcgccaggctaatcggggcgaggtggcgctggaaaatactcacccgtttacccgcgagttatgggggcgtaactggacttatgcccataatgggcaactgacgggctacaaatcactggaaaccggcaacttccgcccggtcggtgaaaccgatagcgaaaaagccttttgctggctcctgcataaattaacgcagcgttacccgcgcacaccgggcaacatggcggcagtgtttaaatatatcgcctcactggcggatgaactgcggcagaagggcgttttcaacatgctactttcggatgggcgctatgtaatggcgtattgctcgactaatttacactggatcacccgccgcgcgccgtttggcgtggcaacgttgctggatcaggatgtggaaatcgacttcagctcgcagaccacaccgaatgatgtggtcacggtgattgcgacacagccgttgacgggcaatgaaacctggcaaaagattatgccaggtgaatggcgcttattttgcctcggggagtgtgtagtttga

SEQ ID NO: 720 - protein, 255 aa, Escherichia coli
MCELLGMSANVPTDICFSFTGLVQRGGGTGPHKDGWGITFYEGKGCRTFKDPQPSFNSPIAKLVQDYPIKSCSVLAHIRQANRGEVALENTHPFTRELWGRNWTYAHNGQLTGYKSLETGNFRPVGETDSEKAFCWLLHKLTQRYPRTPGNMAAVFKYIASLADELRQKGVFNMLLSDGRYVMAYCSTNLHWITRRAPFGVATLLDQDVEIDFSSQTTPNDVVTVIATQPLTGNETWQKIMPGEWRLFCLGECVV

SEQ ID NO: 721 - DNA, 141 bp, Escherichia coli
gtggtggcgctggcgagtaaagggagcaaaacgcataacgaaaacacgcctggatgcagaaatctgccgtgcaagaacgaagacatgaaggacataaaccagctgaatgaaggtgagaattttaaaagaccggaggagtaa

SEQ ID NO: 722 - protein, 46 aa, Escherichia coli
MVALASKGSKTHNENTPGCRNLPCKNEDMKDINQLNEGENFKRPEE

SEQ ID NO: 723 - DNA, 693 bp, Escherichia coli
ttgctccctttactcgccagcgccaccacatcacatatctcttttagctacgccgcccgccagcggatgcaaaaccgtgcgcgtttattaaaacagtaccaaacccatctgaaaaagcaggccagctatattgtggaaggcaatgccaaaagcagaagggcgctgcgccagcataatcgggagcagataaaacagcatccagaatggtttcctgcgccgctcaaggcgagtgacagacgctggcaggcgttggtggagaataatcatttcttaagcagcgaccatctacataacatcaccgaagtggcgattcaccgcctggagcagcagctaggtaagccttatatctgggggggcacgcggcctgataaaggcttcgactgtagcgggttggttttttatgcctacaacaagatccttgaggctaagctcccgcgcacggccaatgagatgtaccactaccgtcgggcaacgattgtggcgaataacgacctgcgccggggagatttgctgtttttccatatccacagtcgtgagatagccgaccatatgggcgtatatcttggagacggtcagtttatcgagtcaccgcgcaccggggaaaccattcgggtaagtcggttagccgaacctttctggcaggaccattttttaggcgcgcgacggattttgacggaagagacgattttgtag

SEQ ID NO: 724 - protein, 230 aa, Escherichia coli
MLPLLASATTSHISFSYAARQRMQNRARLLKQYQTHLKKQASYIVEGNAKSRRALRQHNREQIKQHPEWFPAPLKASDRRWQALVENNHFLSSDHLHNITEVAIHRLEQQLGKPYIWGGTRPDKGFDCSGLVFYAYNKILEAKLPRTANEMYHYRRATIVANNDLRRGDLLFFHIHSREIADHMGVYLGDGQFIESPRTGETIRVSRLAEPFWQDHFLGARRILTEETIL

SEQ ID NO: 725 - DNA, 498 bp, Escherichia coli
atgtctgaatatcgtcgttattacatcaaggggggaacctggtttttcacggtaaatttacagaatcgtcgaaaccaacttttgaccacccagtttcagacgctccgtaacgttattattaaagttaagcgagacagaccttttgaaattaacgcttgggtagttttgccggagcatatgcattgcatatggacattacctgaaggcgatgatgatttttcctcgcgctggcgggaaattaaaaagcaatttacccatgcttgtggattgaaaaatatctggcaaccacgtttttgggaacatgctatccgcaataccaaagactatcgccatcatgttgattatatttatataaatccagtaaaacatggttgggtaaaacaagtgagtgattggccattctcaacgtttcaccgcgatgttgcgaaagggttatatcccatcgattgggcgggagacgtaacggattttagtgctggggagcgtatcattttatag

SEQ ID NO: 726 - protein, 165 aa, Escherichia coli
MSEYRRYYIKGGTWFFTVNLQNRRNQLLTTQFQTLRNVIIKVKRDRPFEINAWVVLPEHMHCIWTLPEGDDDFSSRWREIKKQFTHACGLKNIWQPRFWEHAIRNTKDYRHHVDYIYINPVKHGWVKQVSDWPFSTFHRDVAKGLYPIDWAGDVTDFSAGERIIL

SEQ ID NO: 727 - DNA, 1740 bp, Escherichia coli
atgctttcacgctcggatttactgacgctgttgacaatcaactttatcgtcgtcaccaagggggccgagcgtatttccgaggtttctgcccgctttaccctggacgcgatgcccggcaaacagatggcgattgacgccgatcttaacgccgggttgatcaaccagacgcaggcgcaaacccggcgtaaagatgttgccagcgaggccgatttctacggcgcaatggacggggcatcaaaatttgtgcgcggggatgccatcgccgggatgatgattctggcgatcaacctgatcggcggcgtctgtatcgggatcttcaaatacaacctgagcgccgacgccgccttccagcaatatgtgctgatgactatcggcgatgggctggtggcgcaaatcccttccctgctgctctccaccgcggcggcgattatcgtcacccgcgtcagcgataacggtgatatcgcccatgacgtgcgtaatcagttgctggcaagcccgtcggttctctacaccgccactggaattatgttcgtgctggcggtggtgccgggaatgccgcatttcccgttcctgatgttcagcgccctgcttggttttaccggctggcggatgagcaagcgcccgcaagcggcggaggcggaagagaaaagcctcgaaacgctaacccgtacgatgacagaaaccagcgagcaacaggtcagttgggaaactattccgctgatcgaacctatcagtttaagcctcggctacaaactggtggcgctggtggataaagcgcagggcaacccgctcacccagcgtattcgcggcgtacgtcaggtgatttccgacggcaacggcgtgctgctgccggagatccgtattcgggaaaacttccgcctcaagcccagccagtacgctattttcatcaacggcattaaggctgatgaagcggatattccggcggataaactgatggccctgccctccagcgaaacctacggcgagatagacggcgtgctggggaacgacccggcgtacgggatgccggtcacctggattcagcccgcgcagaaagcgaaggcgctgaatatggggtatcaggtgatcgacagcgccagcgtaattgccacccatgtgaataagattgtgcgcagctatattcctgatttgtttaactatgacgatattactcagctgcataaccgtttgtcgtcgatggcaccgcgactggcggaagatttgagcgcggcgctcaattacagccagttgctgaaagtgtaccgcacactactgactgaaggcgtttccctgcgcgatatcgtcaccatcgccaccgtgttggtcgccagtagtgcggtgactaaagatcatattctgctggcggccgatgtgcgcctggtgctgcggcgcagcattacccatccgttcgttcgcaagcaggagctgacggtgtatacgctgaataatgagctggaaaatctgctgaccaacgtggtgaatcaggcgcaacaggccggcaaagtgatgctcgatagcgtgccggtggacccgaatatgctcaaccagtttcagatcacgatgccgcaggtgaaggagcagatgaaagcggcggggaaagatccggtgctgctggtgccgccgcagctgcgccctttgctggcgcgctacgcaaggttgtttgcaccagggctgcatgtgctgtcgtataacgaagtgctggatgagctggagttgaagataatgggggcgttgatgtag

SEQ ID NO: 728 - protein, 579 aa, Escherichia coli
MLSRSDLLTLLTINFIVVTKGAERISEVSARFTLDAMPGKQMAIDADLNAGLINQTQAQTRRKDVASEADFYGAMDGASKFVRGDAIAGMMILAINLIGGVCIGIFKYNLSADAAFQQYVLMTIGDGLVAQIPSLLLSTAAAIIVTRVSDNGDIAHDVRNQLLASPSVLYTATGIMFVLAVVPGMPHFPFLMFSALLGFTGWRMSKRPQAAEAEEKSLETLTRTMTETSEQQVSWETIPLIEPISLSLGYKLVALVDKAQGNPLTQRIRGVRQVISDGNGVLLPEIRIRENFRLKPSQYAIFINGIKADEADIPADKLMALPSSETYGEIDGVLGNDPAYGMPVTWIQPAQKAKALNMGYQVIDSASVIATHVNKIVRSYIPDLFNYDDITQLHNRLSSMAPRLAEDLSAALNYSQLLKVYRTLLTEGVSLRDIVTIATVLVASSAVTKDHILLAADVRLVLRRSITHPFVRKQELTVYTLNNELENLLTNVVNQAQQAGKVMLDSVPVDPNMLNQFQITMPQVKEQMKAAGKDPVLLVPPQLRPLLARYARLFAPGLHVLSYNEVLDELELKIMGALM

SEQ ID NO: 729 - DNA, 789 bp, Escherichia coli
ttggtgacgacgataaagttgattgtcaacagcgtcagtaaatccgagcgtgaaagcattatcgccgcgctgcacgggcagtcgatttttaacggtggtgggttgtcgccgttaaataaaatcagcccgtctcatctgccaaaacctgccaccgtggcggtgccggaagagacggagaaaaaagcgcgcgacgtcaacgagaaaacggcgctgttgaagaagaaatccgccaccgagcttggcgagctggcgaccagtatcaataccatcgcccgtgatgcgcatatggaagcgaatctggagatggagattgttccccagggattacgcgtgctgattaaagacgaccagaaccgcaatatgtttgaacgcggcagcgcgaagattatgccgttctttaaaactttgctggtggagcttgcgccagtgttagactcgctcgataacaaaattattattaccgggcataccgatgcgatggcctacaaaaacaatatctacaacaactggaacctttcgggcgatcgcgcgctttcggctcgtcgggtgctggaagaggccggaatgccggaaaataaagtgatgcaggtaagcgcaatggcggaccagatgctgctggatgccaaaaatccgcaaagcgcgggcaaccggcgcattgagattatggtgctgaccaaaagtgcgtccgatacgctgtatcaatactttggtcagcatggggataaagtggtgcagccgctggtgcaaaagctggataagcagcaggtgctttcgcagcgagcgcgttaa

SEQ ID NO: 730 - protein, 262 aa, Escherichia coli
MVTTIKLIVNSVSKSERESIIAALHGQSIFNGGGLSPLNKISPSHLPKPATVAVPEETEKKARDVNEKTALLKKKSATELGELATSINTIARDAHMEANLEMEIVPQGLRVLIKDDQNRNMFERGSAKIMPFFKTLLVELAPVLDSLDNKIIITGHTDAMAYKNNIYNNWNLSGDRALSARRVLEEAGMPENKVMQVSAMADQMLLDAKNPQSAGNRRIEIMVLTKSASDTLYQYFGQHGDKVVQPLVQKLDKQQVLSQRAR

SEQ ID NO: 731 - DNA, 1056 bp, Escherichia coli
atgcgtaaaatcattcatgtggatatggactgctttttcgcagcggtggagatgcgcgacaatcccgccctgcgcgatatccctattgctattggcggcagccgcgaacgacggggggtaatcagcaccgccaattatcccgcgcgtaaatttggcgtacgtagcgctatgccgacagggatggcgctcaaattatgcccgcatctcaccttgcttccagggcgctttgacgcctacaaagaagcctcaaatcatatccgcgaaattttctcgcgctatacctcgcgcattgaaccgttatcactggatgaagcctatctcgatgtcaccgatagcgtccattgccacggttctgcgaccctcatcgcccaggaaatccgccagacgatcttcaacgagctgcaactgacggcgtctgcgggcgttgcgccggtcaagtttctcgccaaaatcgcctccgacatgaataaacccaacggtcagtttgtgattactccggctgaggttccggcatttctgcaaaccttaccgctggcaaaaattcccggcgtcggcaaagtctcagcggctaaactggaagcgatggggctacgaacctgcggtgatgtgcaaaagtgtgatctggtgactctgctcaaacgttttggcaaatttggccgcattttgtgggagcgtagtcagggcattgacgagcgcgacgttaacagcgaaaggttgcgaaaatccgtcggtgtagaacgtacgatggcggaagatattcatcactggtctgaatgtgaagcgatcatcgagcggctttaccctgaactggagcgtcgtttggcaaaggtaaaacctgatttgctgattgcccgccagggggtgaaattaaagttcgacgattttcagcaaaccacccaggaacacgtctggccgcggctgaataaatctgatctaatcgccaccgcgcgtaaaacctgggatgaacgccgcggcgggcgcggtgtgcgactggtggggctgcatgtgacgttgcttgacccgcaaatggaaagacaactggtgctgggattatga

SEQ ID NO: 732 - protein, 351 aa, Escherichia coli
MRKIIHVDMDCFFAAVEMRDNPALRDIPIAIGGSRERRGVISTANYPARKFGVRSAMPTGMALKLCPHLTLLPGRFDAYKEASNHIREIFSRYTSRIEPLSLDEAYLDVTDSVHCHGSATLIAQEIRQTIFNELQLTASAGVAPVKFLAKIASDMNKPNGQFVITPAEVPAFLQTLPLAKIPGVGKVSAAKLEAMGLRTCGDVQKCDLVTLLKRFGKFGRILWERSQGIDERDVNSERLRKSVGVERTMAEDIHHWSECEAIIERLYPELERRLAKVKPDLLIARQGVKLKFDDFQQTTQEHVWPRLNKSDLIATARKTWDERRGGRGVRLVGLHVTLLDPQMERQLVLGL

SEQ ID NO: 733 - DNA, 294 bp, Escherichia coli
atgcatcgaattctcgctgaaaaatcggtcaatatcactgagttacgtaaaaacccagctaaatactttattgatcaacctgttgcggttctttctaataatcgccccgcaggatatctcttaagtgccagcgcatttgaagcattaatggacatgcttgcagaacaagaggagaaaaagcccataaaggcgcgcttccgtccgagtgctgcaagattagaggaaattacacgccgcgctgaacaatatcttaatgatatgacggatgatgatttcaatgactttaaggaataa

SEQ ID NO: 734 - protein, 97 aa, Escherichia coli
MHRILAEKSVNITELRKNPAKYFIDQPVAVLSNNRPAGYLLSASAFEALMDMLAEQEEKKPIKARFRPSAARLEEITRRAEQYLNDMTDDDFNDFKE

SEQ ID NO: 735 - DNA, 399 bp, Escherichia coli
atgcgggtattcaaaacaaaacttattcgcctgcaacttacagcagaggaacttgaagcgttaacggcggattttatttcctataagcgtgacggtgttttgccagatatatttggtcgtgatgcactctacgacgactcgtttacctggccattaatcaaatttgagcgagttgctcatattcatctggcaaatgtgaataatccatttccgccacagttgcgccaattcagcagaacgaatgacgcagcgcatttggtatattgtcagggcgcgtttgatgagcaagcatggttgctcattgccattctgaaacctgaacctcataaactggctcgagataacaaccaaatgcataaaattgggaaaatggcagaagcgtttcgcatgcgtttttga

SEQ ID NO: 736 - protein, 132 aa, Escherichia coli
MRVFKTKLIRLQLTAEELEALTADFISYKRDGVLPDIFGRDALYDDSFTWPLIKFERVAHIHLANVNNPFPPQLRQFSRTNDAAHLVYCQGAFDEQAWLLIAILKPEPHKLARDNNQMHKIGKMAEAFRMRF

SEQ ID NO: 737 - DNA, 453 bp, Escherichia coli
atgaataacatacaaataagaaactatcagcctggtgattttcagcaactatgcgctattttccttcgagctgttacgatgacggcgagtcagcactattctccacagcaaattgccgcctgggcgcagattgacgaatctcgctggaaggagaaactcgcgaaatcacaagtgcgggttgcagttattaatgcacaaccggttggttttattacctgcattggacattatatcgatatgttatttgttgaaccggaatacacccgacgcggggttgccagcgctttgttaaaaccattgattaagtctgaatccgaacttacggtggacgccagcataaccgcaaaacccttttttgaacgttatggttttcagacagttaagcagcagcgcgttgaatgccggggaacgtggtttactaatttttatatgcgatataaaccgcaacattaa

SEQ ID NO: 738 - protein, 150 aa, Escherichia coli
MNNIQIRNYQPGDFQQLCAIFLRAVTMTASQHYSPQQIAAWAQIDESRWKEKLAKSQVRVAVINAQPVGFITCIGHYIDMLFVEPEYTRRGVASALLKPLIKSESELTVDASITAKPFFERYGFQTVKQQRVECRGTWFTNFYMRYKPQH

SEQ ID NO: 739 - DNA, 1152 bp, Escherichia coli
atggaatggtacatgggcaaatatattcgtcccttatccgatgcggtatttaccatcgcatctgatgacctgtggatcgaaagttcagcgatccaacaattacacaccacggcaaatttacccaacatgcagcgcgttgtggggatgccagatttacatcccggacgcggctacccgattggcgcagcgttcttctctgttggtcgtttttacccggcactggtcggcaatgatatcggctgcggcatggcgctatggcaaacagatattctcgctcgcaaatacaacgccgataagtttgaaaagcgattatcagatctggatgacgttgctgaagaaagctggctggaggaaaacctgccgtcagcatttgcacagcatccgtggcgcaactcgcttggctccatcggtggcggtaaccacttcgcagaactgcaacagattgatcaaattatcgacgcggaactgtttgcactggctggtctggatgcgcagcatctgcaactgctggttcatagcggctcgaggggattggggcagtctattttacagcggcatattgcctcgttttcgcatcatggtttgcctgaaggcagtgacgacgcgctacggtatattgcggaacatgacgatgcgctggcgtttgcgcgtattaatcgccagctgatcgctttgcgcataatgcaacaagttaaggccaccggaagtccggttctggatgtggcgcataactttgttagcgcgtgccaaatcggcgatcaacagggctggttgcatcgtaaaggcgccacgccggatgacaacggtctggtgattattcccggttcacgcggcgattactcctggctggttaaacctgttgcgaacgaaaaaacgctccactcgctggcgcatggggcggggcgtaaatgggggcgcaccgagtgtaaagggcgtctggcagcgaaatacacggcgacgcaactctcgcggactgaacttggcagtcgggtaatttgtcgcgataaacaactcatctttgaagaagcgccacaagcctataaatcggctgaaagcgtggtgcaatgtctggtgctggctgggttaattattcctgtcgcgcgactgcgcccggtgctgacgctcaaaaacagtggagggaaaaaaggatga

SEQ ID NO: 740 - protein, 383 aa, Escherichia coli
MEWYMGKYIRPLSDAVFTIASDDLWIESSAIQQLHTTANLPNMQRVVGMPDLHPGRGYPIGAAFFSVGRFYPALVGNDIGCGMALWQTDILARKYNADKFEKRLSDLDDVAEESWLEENLPSAFAQHPWRNSLGSIGGGNHFAELQQIDQIIDAELFALAGLDAQHLQLLVHSGSRGLGQSILQRHIASFSHHGLPEGSDDALRYIAEHDDALAFARINRQLIALRIMQQVKATGSPVLDVAHNFVSACQIGDQQGWLHRKGATPDDNGLVIIPGSRGDYSWLVKPVANEKTLHSLAHGAGRKWGRTECKGRLAAKYTATQLSRTELGSRVICRDKQLIFEEAPQAYKSAESVVQCLVLAGLIIPVARLRPVLTLKNSGGKKG

SEQ ID NO: 741 - DNA, 615 bp, Escherichia coli
atgatcttgctacaactctcctctgctcaggggccggaagaatgttgtctcgcagtgaaaaaagcactggacaggctgattaaagaagctacccgacaggacgtcgcggtaacggtgctggaaacagaaacgggtcgctactctgacacactgcgttcggcgctgatttctctggatggcgataacgcatgggctctaagcgaaagctggtgcggcactatccagtggatttgtccgagtccgtatcggcctcatcatgggcgcaaaaactggtttctgggcattgggcgttttaccgctgatgagcaggaacaatcggatgcaatccgttatgagacgctgcgttcgtcggggccgggcggtcaacatgtcaataaaaccgactcggcggtacgcgccacgcatctggcatccggtattagcgtgaaggttcagtcagagcgcagtcagcatgctaacaaacggctggcgcgattactgattgcctggaagctggaacaacagcaacaggaaaatagcgcggcgctgaaatcgcagcggcgaatgttccatcaccagattgaacgtggcaacccgcgacgaacgtttacagggatggcttttatcgaagggtaa

SEQ ID NO: 742 - protein, 204 aa, Escherichia coli
MILLQLSSAQGPEECCLAVKKALDRLIKEATRQDVAVTVLETETGRYSDTLRSALISLDGDNAWALSESWCGTIQWICPSPYRPHHGRKNWFLGIGRFTADEQEQSDAIRYETLRSSGPGGQHVNKTDSAVRATHLASGISVKVQSERSQHANKRLARLLIAWKLEQQQQENSAALKSQRRMFHHQIERGNPRRTFTGMAFIEG

SEQ ID NO: 743 - DNA, 1458 bp, Escherichia coli
gtgtctgaactgtctcaattatctccacagccgctgtgggatatttttgccaaaatctgttctattcctcacccgtcctatcatgaagagcaactcgctgaatacattgttggttgggcaaaagagaaaggtttccatgtcgaacgcgatcaggtaggtaatatcctgattcgtaaacctgctaccgcaggtatggaaaatcgtaaaccggtcgtcttgcaggcccacctcgatatggtgccgcaaaaaaataacgacaccgtgcatgacttcactaaagatcctatccagccttatattgatggcgaatgggttaaagcacgcggcaccacgctgggtgcggataacggcattggtatggcctctgcactggcggttctggctgacgaaaacgtggttcacggcccgctggaagtgctgctgaccatgaccgaagaagccggtatggacggtgcttttggcttacagagcaactggttgcaggctgatattctgattaacaccgactccgaagaagaaggtgaaatctacatgggttgtgcgggaggtatcgacttcacctccaacctgcatttagatcgtgaagcggttccagctggttttgaaaccttcaagttaaccttaaaaggtctgaaaggcggtcactccggcggtgaaatccacgttggcctgggtaatgccaacaaactgttggtgcgcttcctggcgggtcatgcagaagaactggacctgcgtcttattgatttcaacggcggcacactgcgtaacgccatcccgcgtgaagcctttgcgaccattgctgtcgcagctgataaagtcgacgccctgaaatctctggtggatacctatcaggagatcctgaaaaacgaactggcagagaaagagaaaaatctggcattgctgctggactctgttgcgaacgataaagctgccctgattgcgaaatctcgcgatacctttattcgtctgctgaacgccaccccgaacggtgtgatccgcaactccgacgtggcaaaaggtgtggtcgaaacctccctgaacgtcggtgtggtgaccatgaccgacaataacgtagaaattcactgcctgatccgttctctgatcgacagcggtaaagactacgtagtgagcatgctggattcgctgggtaaactggcaggtgcgaaaaccgaagcaaaaggcgcatatcctggctggcagccggacgctaactctccggtaatgcatctggtacgtgaaacctatcagcgtctgttcaacaaaacgccgaacatccagattatccacgcgggcctcgaatgtggcctgttcaaaaaaccgtatccggaaatggacatggtgtctatcgggccaaccatcaccggtccacactccccggatgagcaagttcatatcgaaagcgttggccattactggacactgctgactgaactgctgaaagaaattccggcgaagtaa

SEQ ID NO: 744 - protein, 485 aa, Escherichia coli
MSELSQLSPQPLWDIFAKICSIPHPSYHEEQLAEYIVGWAKEKGFHVERDQVGNILIRKPATAGMENRKPVVLQAHLDMVPQKNNDTVHDFTKDPIQPYIDGEWVKARGTTLGADNGIGMASALAVLADENVVHGPLEVLLTMTEEAGMDGAFGLQSNWLQADILINTDSEEEGEIYMGCAGGIDFTSNLHLDREAVPAGFETFKLTLKGLKGGHSGGEIHVGLGNANKLLVRFLAGHAEELDLRLIDFNGGTLRNAIPREAFATIAVAADKVDALKSLVDTYQEILKNELAEKEKNLALLLDSVANDKAALIAKSRDTFIRLLNATPNGVIRNSDVAKGVVETSLNVGVVTMTDNNVEIHCLIRSLIDSGKDYVVSMLDSLGKLAGAKTEAKGAYPGWQPDANSPVMHLVRETYQRLFNKTPNIQIIHAGLECGLFKKPYPEMDMVSIGPTITGPHSPDEQVHIESVGHYWTLLTELLKEIPAK

SEQ ID NO: 745 - DNA, 459 bp, Escherichia coli
atgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtagataccggtggtactgcggttgcgattcgtgaaatgtatccaaaagcgcactttatcaccatcttcgcaaaaccggccggtcgtccgctggttgatgattatgttgttgatattccgcaaaatacctggatcgaacagccgtgggatatgggcgtcgtattcgtcccgccaatctccggtcgctaa

SEQ ID NO: 746 - protein, 152 aa, Escherichia coli
MSEKYIVTWDMLQIHARKLASRLMPSEQWKGIIAVSRGGLVPGALLARELGIRHVDTVCISSYDHDNQRELKVLKRAEGDGEGFIVIDDLVDTGGTAVAIREMYPKAHFITIFAKPAGRPLVDDYVVDIPQNTWIEQPWDMGVVFVPPISGR

SEQ ID NO: 747 - DNA, 1245 bp, Escherichia coli
atgacacaggcaaacctgagcgaaaccctgttcaaaccccgctttaaacatcctgaaacctcgacgctagtccgccgctttagtcacggcgcacaaccgcctgtgcagtcggcccttgatggtaaaaccatccctcactggtatcgcatgattaaccgtctgatgtggatctggcgcggcattgacccccgtgaaatcctcgatgtccaagcgcgtattgtgatgagcgatgccgaacgtaccgacgatgatttatacgatacggtgattggctaccgcggcggcaactggatttatgagtgggctacccaggcgatggtgtggcaacaaaaagcctgtgcggaagaagatccgcaactcagcggtcgacactggctgcatgcggctacgttgtacaacattgctgcctatcctcatctgaaaggagatgacctggccgagcaagcgcaggctttgtcaaaccgcgcctatgaagaggccgctcagcgtctgccgggcacgatgcggcagatggagtttaccgtacccggcggtgcgcccatcaccggctttttgcatatgccgaaaggcgatggcccgttcccgacagtattaatgtgtggtggtctggatgcgatgcagacggactattacagcctgtatgaacgttattttgcgccgcgcggcattgctatgctgactattgatatgccgtcggtgggcttttcttcaaaatggaagctcacccaggactccagcctgttgcatcagcacgttttaaaggcgctgcctaacgtaccgtgggtggatcacactcgcgtcgcggcctttggtttccgtttcggcgctaacgttgccgtgcgtctggcataccttgaatcgccacgtctgaaagcggttgcttgtcttggtccggtagttcataccctgttgagtgattttaagtgccagcaacaggtgccggaaatgtatcttgacgttctggccagtcgtttagggatgcatgatgcttccgatgaagcgttgcgcgtggagttgaatcgctattcattaaaagtgcaaggattgctgggacgtcgctgcccaacgccaatgttatcaggctactggaagaacgatccgttcagcccggaagaggactcacgcttaatcacgtcgtcatctgctgacggtaaattattagagatcccatttaacccggtgtatcggaattttgacaaaggccttcaggaaatcacagactggatcgaaaaacgtttgtgttaa

SEQ ID NO: 748 - protein, 414 aa, Escherichia coli
MTQANLSETLFKPRFKHPETSTLVRRFSHGAQPPVQSALDGKTIPHWYRMINRLMWIWRGIDPREILDVQARIVMSDAERTDDDLYDTVIGYRGGNWIYEWATQAMVWQQKACAEEDPQLSGRHWLHAATLYNIAAYPHLKGDDLAEQAQALSNRAYEEAAQRLPGTMRQMEFTVPGGAPITGFLHMPKGDGPFPTVLMCGGLDAMQTDYYSLYERYFAPRGIAMLTIDMPSVGFSSKWKLTQDSSLLHQHVLKALPNVPWVDHTRVAAFGFRFGANVAVRLAYLESPRLKAVACLGPVVHTLLSDFKCQQQVPEMYLDVLASRLGMHDASDEALRVELNRYSLKVQGLLGRRCPTPMLSGYWKNDPFSPEEDSRLITSSSADGKLLEIPFNPVYRNFDKGLQEITDWIEKRLC

SEQ ID NO: 749 - DNA, 402 bp, Escherichia coli
atgacgttaccgagtggacacccgaagagcagattagtcaaaaaatttaccgcactaggcccgtatattcgtgaaggtaagtgcgaagataatcgattctttttcgattgtctggctgtatgcgtcaacgtgaaaccggcaccggaagtgcgtgagttctggggctggtggatggaactggaagcgcaggaatcccgttttacctacagttaccagtttggtctgttcgataaagcaggcgactggacgagtgttcagataaaagatgccgaagtggttgaacgactggagcacaccctgcgtgaatttcacgagaagctgcgtgagctgctggcgacgctgaatctgaagctggaaccggcagatgattttcgtgatgaaccggtgaagttaacggcgtga

SEQ ID NO: 750 - protein, 133 aa, Escherichia coli
MTLPSGHPKSRLVKKFTALGPYIREGKCEDNRFFFDCLAVCVNVKPAPEVREFWGWWMELEAQESRFTYSYQFGLFDKAGDWTSVQIKDAEVVERLEHTLREFHEKLRELLATLNLKLEPADDFRDEPVKLTA

SEQ ID NO: 751 - DNA, 1056 bp, Escherichia coli
atgaaaaagagcactctggcattagtggtgatgggcattgtggcatctgtatccgtacaggccgcagaaatatataacaaagacggtaataaactggatgtctatggcaaagttaaagccatgcattatatgagtgataatgacagtaaagatggcgaccagagttatatccgttttggttttaaaggcgaaacacaaattaacgttcaactgactggttatggtcgttgggaagctgagtttgccggtaataaagcggagagtgatactgcacagcaaaaaacgcgtctcgcttttgccgggttgaaatataaagatttgggttctttcgattatggtcgtaacctgggcgcgttgtatgacgtggaagcctggaccgatatgttcccggaatttggtggcgactcctcggcgcagaccgacaactttatgaccaaacgcgccagcggtctggcgacgtatcggaacaccgacttcttcggcgttatcgatggcctgaacttaaccctgcaatatcaagggaaaaacgaaaaccgcgacgttaaaaagcaaaacggcgatggcttcggcacgtcattgacatatgactttggtggcagcgatttcgccatcagtggagcctataccaactctgatcgcaccaacgagcagaacctgcaaagccgtggcacaggcaagcgtgcagaagcatgggcaacaggtctgaaatacgatgccaataatatttatctggcaactttctattctgaaacacgtaaaatgacgccaatctctggcggttttgccaataagacgcagaactttgaagcggtcgctcaataccagtttgactttggtctgcgtccatcgctgggttatgtcttatcgaaagggaaagatattgagggcatcggtgatgaagatctggtcaattatgtcgatgttggtgctacgtattatttcaacaaaaatatgtcagcgtttgttgattataaaattaatcagctggatagcgataataagctgaatatcaacaatgatgatattgtcgcggttgggatgacgtatcagttttaa

SEQ ID NO: 752 - protein, 351 aa, Escherichia coli
MKKSTLALVVMGIVASVSVQAAEIYNKDGNKLDVYGKVKAMHYMSDNDSKDGDQSYIRFGFKGETQINVQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLDSDNKLNINNDDIVAVGMTYQF

SEQ ID NO: 753 - DNA, 1104 bp, Escherichia coli
atgagtgacagccagacgctggtggtaaaactcggcaccagtgtgctaacaggcggatcgcgccgcctgaaccgtgcccatatcgttgaacttgttcgccagtgcgcgcagttacatgccgccgggcatcggattgttattgtgacgtcaggtgcgattgccgccggacgtgagcacctggggtacccggaattgccagcgactatcgcttcaaaacagctgctggcggcggtagggcagagtcgactgattcaactgtgggaacagctgttttcaatttacggcattcatgtcgggcagatgttgctgacccgtgctgatatggaagatcgtgaacgcttcctgaacgcccgcgataccctgcgtgcgttgctcgataacaatatcgttccggtaattaatgagaacgatgctgtcgctactgcagagattaaggtcggtgataacgataacctttctgcgctggcggcgattctggcgggtgccgataaactgttgctgctgaccgatcaaaaaggtttgtataccgctgacccgcgcagcaatccgcaggcagaactgattaaagatgtgtacggcattgatgacgcactgcgcgcgattgccggtgatagcgtttcaggcctcggaactggcggtatgagcaccaaattgcaggccgctgacgtggcttgccgtgcgggtatcgacaccattattgccgcgggcagcaagccgggcgttattggtgatgtgatggaaggcatttccgtcggtacgctgttccatgcccaggcgactccgcttgaaaaccgtaaacgctggattttcggtgcgccgcctgcgggtgaaatcacggtagatgaaggggcaactgccgccattctggaacgcggcagctccctgttgccgaaaggcattaaaagcgtgactggcaatttctcgcgtggtgaagtcatccgtatttgcaacctcgaaggtcgcgatatcgcccacggcgtcagtcgttacaacagcgatgcattacgccgtattgccggacaccactcgcaagaaattgatgcaatactgggatatgaatacggcccggttgccgttcaccgtgatgacatgattacccgttaa

SEQ ID NO: 754 - protein, 367 aa, Escherichia coli
MSDSQTLVVKLGTSVLTGGSRRLNRAHIVELVRQCAQLHAAGHRIVIVTSGAIAAGREHLGYPELPATIASKQLLAAVGQSRLIQLWEQLFSIYGIHVGQMLLTRADMEDRERFLNARDTLRALLDNNIVPVINENDAVATAEIKVGDNDNLSALAAILAGADKLLLLTDQKGLYTADPRSNPQAELIKDVYGIDDALRAIAGDSVSGLGTGGMSTKLQAADVACRAGIDTIIAAGSKPGVIGDVMEGISVGTLFHAQATPLENRKRWIFGAPPAGEITVDEGATAAILERGSSLLPKGIKSVTGNFSRGEVIRICNLEGRDIAHGVSRYNSDALRRIAGHHSQEIDAILGYEYGPVAVHRDDMITR

SEQ ID NO: 755 - DNA, 1254 bp, Escherichia coli
atgctggaacaaatgggcattgccgcgaagcaagcctcgtataaattagcgcaactctccagccgcgaaaaaaatcgtgtgctggaaaaaatcgccgatgaactggaagcacaaagcgaaagtatcctcaacgctaacgcacaggatgttgcagacgcgcgtgccaatggccttagcgaagcgatgcttgaccgtctggcactgacgcccgcacggctgaaaggcattgccgacgatgtgcgccaggtgtgcaatctcgccgatcctgtggggcaggtaatcgatggcggcgtactggacagcggcctgcgtcttgagcgtcgtcgcgtaccgctgggggtgattggcgtgatttatgaagcgcgcccgaacgtgacggttgatgttgcttccctgtgcctgaaaaccggtaacgcggtgatcctgcgcggcggcaaagaaacctgtcgcactaacgctgcaacggtagcggtgattcaggacgccctgaaatcctgcggcttaccggcgggtgccgtgcaggcaattgataatcctgaccgtgcgctggtcagtgaaatgctgcgtatggataaatacatcgacatgctgatcccgcgcggtggggctggtttgcataaactgtgccgcgagcagtcgacaatcccggtgatcacaggcggtataggcgtatgccatatttacgttgatgaaagtgcagagatcgctgaagccctgaaagtaattgtcaacgcgaaaactcagcgaccgagcacatgtaatacggtagaaacgttgctggtaaataaaaacatcgcagatagcttcctgcccgcattaagcaaacaaatggcggaaagcggcgtgacgttacacgctgatgcagccgcgctggcgcagttgcaggcaggccccgcgaaggtggtggctgttaaagccgaagagtatgacgatgagtttctgtcattagatttgaacgtcaaaatcgttagcgatctggatgacgccattgcccatattcgtgaacacggcacgcaacactccgatgcgatcctgacccgcgatatgcgcaacgcccagcgttttgttaacgaagtggattcctccgctgtttacgttaacgcctctacgcgttttaccgacggcggccagtttggtctgggggcggaagttgcggtaagcacacaaaaactccacgcgcgcggcccaatggggctggaagctctgaccacttacaagtggatcggcattggtgattacaccattcgtgcgtaa

SEQ ID NO: 756 - protein, 417 aa, Escherichia coli
MLEQMGIAAKQASYKLAQLSSREKNRVLEKIADELEAQSESILNANAQDVADARANGLSEAMLDRLALTPARLKGIADDVRQVCNLADPVGQVIDGGVLDSGLRLERRRVPLGVIGVIYEARPNVTVDVASLCLKTGNAVILRGGKETCRTNAATVAVIQDALKSCGLPAGAVQAIDNPDRALVSEMLRMDKYIDMLIPRGGAGLHKLCREQSTIPVITGGIGVCHIYVDESAEIAEALKVIVNAKTQRPSTCNTVETLLVNKNIADSFLPALSKQMAESGVTLHADAAALAQLQAGPAKVVAVKAEEYDDEFLSLDLNVKIVSDLDDAIAHIREHGTQHSDAILTRDMRNAQRFVNEVDSSAVYVNASTRFTDGGQFGLGAEVAVSTQKLHARGPMGLEALTTYKWIGIGDYTIRA

SEQ ID NO: 757 - DNA, 342 bp, Escherichia coli
ataaacacttcaacatttatggtgttagtttcattatatatgtctgatgattattgtcagtccccttctgatatttacaaggagttacaattctccaaaacaaacatcacacacatcatagacaaattagaaaaaaagaatattgccaaaagaattaataataaaaacgatcgtcgaagcaaaagtatttgcttaacccctgacggagttacacttgctcaaaaactaataaacactcaaaatgtaatgctaaagaaaatctggagcgggctatcagatgatgaaatgaaaacatttgaactcgccaacaaaaaattattatcaaaccttaatgttaattga

SEQ ID NO: 758 - protein, 113 aa, Escherichia coli
INTSTFMVLVSLYMSDDYCQSPSDIYKELQFSKTNITHIIDKLEKKNIAKRINNKNDRRSKSICLTPDGVTLAQKLINTQNVMLKKIWSGLSDDEMKTFELANKKLLSNLNVN

SEQ ID NO: 759 - DNA, 4131 bp, Escherichia coli
atgaataaaatatacgctctaaaatattgttatattactaacacagtaaaggttgtctctgaactagcccgaagggtatgtaaagggagtacccgcagaggaaaaagactttcagtacttacctctctggcactatctgcattactcccaaccgttgctggtgcatcaacggttggtggcaacaatccttaccagacataccgcgactttgcagaaaacaaagggcagtttcaggctggcgcaacaaacattcctatttttaataataaaggggaattagtaggacatcttgataaagcgcccatggttgattttagcagtgtgaatgtaagctcaaatcccggcgttgcaacattaattaacccgcaatatatagccagtgtaaaacataataaaggatatcagagcgtcagcttcggtgatggtcagaacagttaccatattgtggatcgtaatgaacacagttcatctgatctccacacaccaagacttgataagctcgtaactgaggttgctccggctaccgtaaccagctcatcaacagctgatatattgaacccttcaaaatactcggcattctacagggctggttcgggaagtcagtatattcaggatagtcagggtaagcgacattgggtaacaggtgggtatggttatctgacaggaggaatactcccgacatcattcttttatcacggctcagacggcattcagctgtatatggggggcaacatacatgatcatagcatcctgccctcttttggagaggccggcgacagtggttctccattatttggctggaatacggccaaagggcagtgggaactggtcggtgtttactcgggagtaggaggggggaccaatttgatatattctcttattcctcagagttttctctcacagatctattcagaggataatgacgctcccgtcttttttaatgcctcatccggcgcccccctgcaatggaaatttgacagcagcaccggcactggctctctgaaacagggttccgatgaatatgccatgcacgggcaaaaaggttctgacctgaacgcaggtaaaaatctgacattcctgggacataatggtcagattgacctggaaaactctgtcacgcagggtgccggttcactgacatttactgatgactacactgtcaccacttcaaacggaagtacctggaccggggccggtattattgtggacaaggatgcctccgtaaactggcaggttaatggtgtgaaaggtgacaacctgcataaaatcggcgaaggaaccctggttgtacagggaaccggtgttaatgagggcggcctgaaagtcggggatgggaccgttgtcctcaatcagcaggctgacagttcaggacacgttcaggcattcagtagcgtgaatattgccagcggccgcccgacagtcgtgctggcagacaaccagcaggttaatccggacaatatatcctggggctaccgggggggggttctggatgttaacgggaatgacctgacatttcataagctgaatgccgccgattatggcgcaactctcggtaacagcagtgataaaacggctaatatcactctggattatcagacgcgtccggcagacgtaaaagttaatgaatggtcatcatcaaacaggggaacagtaggttcattatatatttataataatccctatactcataccgtcgattattttatcctgaaaacaagtagttatggctggttccctaccggtcaggtcagtaacgagcactgggaatatgtcggacatgaccagaacagtgcacaggcgctgcttgcaaacagaattaataataaagggtatctgtatcatggcaagttgctgggaaatattaatttctcaaataaagcaaccccgggtacaaccggcgcattggttatggacggctcagcgaatatgtccggtacatttactcaggaaaacggtcgtctgaccattcagggccacccggttatccatgcttcaacgtctcagagtattgcaaatacagtctcgtctctgggcgacaattccgttctgacacagcccacctcatttacacaggatgactgggagaacaggacgttcagctttggttcgctcgtgttaaaagatacagactttggtctgggccgcaatgccacactgaacacaaccatccaggcagataactccagcgtcacgctgggcgacagtcgggtatttatcgacaaaaaagatggccagggaacagcatttacccttgaagaaggcacatctgttgcaactaaagatgcagataaaagcgtcttcaacggcaccgtcaacctggataatcagtcagtgctgaatatcaatgagatattcaatggcggaatacaggcgaacaacagtaccgtgaatatctcctcagacagtgccgttctggagaactcaacgctgaccagtaccgccctgaatctgaacaagggagcaaatgttctggccagtcagagttttgtttctgacggtccggtgaatatttctgatgccaccctgagtctgaacagccgtcctgatgaggtatctcacacacttttacctgtatacgattatgccggttcatggaacctgaagggagacgatgcccgcctgaacgtggggccgtacagtatgttgtcaggtaatatcaatgttcaggataaagggactgtcaccctcggaggggaaggggaactgagtcctgacctgactcttcagaatcagatgttgtacagcctgtttaacgggtaccgcaatacctggagcgggagcctgaatgcaccggatgccaccgtcagcatgacagacacccagtggtcgatgaacggaaactccacggcaggaaatatgaaacttaaccggacaatagtcggttttaacgggggaacatcatcgttcacgacactgacaacagataatctggacgcggttcagtcagcatttgtcatgcgtacagaccttaacaaggcagacaaactggtgataaacaagtcggcaacaggtcatgacaacagcatctgggttaacttcctgaaaaaaccctctgacaaggacacgcttgatattccactggtcagcgcacctgaagcgacagctgataatctgttcagggcatcaacacgggttgtgggattcagtgatgtcacccccacccttagtgtcagaaaagaggacgggaaaaaagagtgggtcctcgatggttaccaggttgcacgtaacgacggccagggtaaggctgccgccacattcatgcacatcagctataacaacttcatcactgaagttaacaacctgaacaaacgcatgggcgatttgagggatattaacggcgaagccggtacgtgggtgcgtctgctgaacggttccggctctgctgatggcggtttcactgaccactataccctgctgcagatgggggctgaccgtaagcacgaactgggaagtatggacctgtttaccggcgtgatggccacctacactgacacagatgcgtcagcaggcctgtacagcggtaaaacaaaatcatggggtggtggtttctatgccagtggtctgttccggtccggcgcttactttgatttgattgccaaatatattcacaatgaaaacaaatatgacctgaactttgccggagctggtaaacagaacttccgcagccattcactgtatgcaggtgcagaagtcggataccgttatcatctgacagatacgacgtttgttgaacctcaggcggaactggtctggggaagactgcagggccaaacatttaactggaacgacagtggaatggatgtctcaatgcgtcgtaacagcgttaatcctctggtaggcagaaccggcgttgtttccggtaaaaccttcagtggtaaggactggagtctgacaggccgtgccggcctgcattatgagttcgatctgacggacagtgctgacgttcacctgaaggatgcagcgggagaacatcagattaatggcagaaaagacggtcgtatgctttacggtgtggggttaaatgcccggtttggcgacaatacgcgtctggggctggaagttgaacgctctgcattcggtaaatacaacacagatgatgcgataaacgctaatattcgttattcattctga

SEQ ID NO: 760 - protein, 1376 aa, Escherichia coli
MNKIYALKYCYITNTVKVVSELARRVCKGSTRRGKRLSVLTSLALSALLPTVAGASTVGGNNPYQTYRDFAENKGQFQAGATNIPIFNNKGELVGHLDKAPMVDFSSVNVSSNPGVATLINPQYIASVKHNKGYQSVSFGDGQNSYHIVDRNEHSSSDLHTPRLDKLVTEVAPATVTSSSTADILNPSKYSAFYRAGSGSQYIQDSQGKRHWVTGGYGYLTGGILPTSFFYHGSDGIQLYMGGNIHDHSILPSFGEAGDSGSPLFGWNTAKGQWELVGVYSGVGGGTNLIYSLIPQSFLSQIYSEDNDAPVFFNASSGAPLQWKFDSSTGTGSLKQGSDEYAMHGQKGSDLNAGKNLTFLGHNGQIDLENSVTQGAGSLTFTDDYTVTTSNGSTWTGAGIIVDKDASVNWQVNGVKGDNLHKIGEGTLVVQGTGVNEGGLKVGDGTVVLNQQADSSGHVQAFSSVNIASGRPTVVLADNQQVNPDNISWGYRGGVLDVNGNDLTFHKLNAADYGATLGNSSDKTANITLDYQTRPADVKVNEWSSSNRGTVGSLYIYNNPYTHTVDYFILKTSSYGWFPTGQVSNEHWEYVGHDQNSAQALLANRINNKGYLYHGKLLGNINFSNKATPGTTGALVMDGSANMSGTFTQENGRLTIQGHPVIHASTSQSIANTVSSLGDNSVLTQPTSFTQDDWENRTFSFGSLVLKDTDFGLGRNATLNTTIQADNSSVTLGDSRVFIDKKDGQGTAFTLEEGTSVATKDADKSVFNGTVNLDNQSVLNINEIFNGGIQANNSTVNISSDSAVLENSTLTSTALNLNKGANVLASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNTWSGSLNAPDATVSMTDTQWSMNGNSTAGNMKLNRTIVGFNGGTSSFTTLTTDNLDAVQSAFVMRTDLNKADKLVINKSATGHDNSIWVNFLKKPSDKDTLDIPLVSAPEATADNLFRASTRVVGFSDVTPTLSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASAGLYSGKTKSWGGGFYASGLFRSGAYFDLIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTGRAGLHYEFDLTDSADVHLKDAAGEHQINGRKDGRMLYGVGLNARFGDNTRLGLEVERSAFGKYNTDDAINANIRYSF

SEQ ID NO: 761 - DNA, 216 bp, Escherichia coli
atggctaccgttactgttcatcgtccgcgctgtaattccgataaagtttatcgacatggtcgtagttgttcccagcatgagcgtttccgttgtcgttcatgtaaacgtgttttccagctcacttactcttatgaagccagaaaacccggctttaaggagctgatcgttgaaatggcgcataatggcacaggggccgtgatatcgccagaatactga

SEQ ID NO: 762 - protein, 71 aa, Escherichia coli
MATVTVHRPRCNSDKVYRHGRSCSQHERFRCRSCKRVFQLTYSYEARKPGFKELIVEMAHNGTGAVISPEY

SEQ ID NO: 763 - DNA, 177 bp, Escherichia coli
gtgccgaaggagaaatacctgaccggcaaaatcttcacgcaacgtattgaacgtaacaacctgaccctccgcacccgcatcaagcggctggtaagtaaaacaatctgcttctcgcgttccgttgaaatccacgaaaaagtcatcggttccttcattgaaaagcacatgttctactga

SEQ ID NO: 764 - protein, 58 aa, Escherichia coli
MPKEKYLTGKIFTQRIERNNLTLRTRIKRLVSKTICFSRSVEIHEKVIGSFIEKHMFY

SEQ ID NO: 765 - DNA, 231 bp, Escherichia coli
gtgcaagcagggaaacaccggaccaaaccaatcagctgttcgaaaatggcaagcggattaatatgccatggcggctttaagccgcacgcatggggtgtggcaagcctgatggatgttactgtgcttgtggtggcgtctttgctggtctggttgttggttaatcgcgaaaatcattatgccagaggaataccacaggacgttcaggttttgcataaaaaagcccaccattaa

SEQ ID NO: 766 - protein, 76 aa, Escherichia coli
MQAGKHRTKPISCSKMASGLICHGGFKPHAWGVASLMDVTVLVVASLLVWLLVNRENHYARGIPQDVQVLHKKAHH

SEQ ID NO: 767 - DNA, 615 bp, Escherichia coli
atgaatatatttgaacaaactccaccaaaccgcagacgttatggtcttgctgcattcattgggctgattgctggcgttgtttccgcatttgttaagtggggggcagaagttccattgccaccacgtagtccggttgatatgtttaatgcagcgtgtggtccggaatcattaatcagggctgcaggccaaattgattgctcccgtaactttctcaatcctccgtacatttttcttcgggattggttgggactgacagatccaaattcggctgtttataccttcgccgggcatgtctttaactgggttggtgtaacgcacataatcttttcgatagtttttgccgttggttactgtgtggtcgccgaagtatttccgaaaattaaactttggcagggcttactggcaggtgctttagcgcaactttttgttcatatgatttcattccctctcatgggacttacgccacctctctttgatcttccgtggtatgagaatgtctctgaaatttttggacatttagtctggttctggtctattgaaattattcgcagagatttacgaaacagaattacccatgagccagatcctgagatccctttaggctcaaatagataa

SEQ ID NO: 768 - protein, 204 aa, Escherichia coli
MNIFEQTPPNRRRYGLAAFIGLIAGVVSAFVKWGAEVPLPPRSPVDMFNAACGPESLIRAAGQIDCSRNFLNPPYIFLRDWLGLTDPNSAVYTFAGHVFNWVGVTHIIFSIVFAVGYCVVAEVFPKIKLWQGLLAGALAQLFVHMISFPLMGLTPPLFDLPWYENVSEIFGHLVWFWSIEIIRRDLRNRITHEPDPEIPLGSNR

SEQ ID NO: 769 - DNA, 318 bp, Escherichia coli
aatccatgcatgacgtgtggtgcctgttgtgcatttttccgcgtctctttttactgggccgaagccgacgatgctggcggtaccattcccgccaggctcactgaacaaatatccccttttcaccgatgcatgagcggtactaatcagaaaaatccccgatgtattgcccttgcaggaacaccgggcaaaaatgcctgctgcacgatatatgaaaatcgatcgtccacatgcagagaattcgccatgtctggtgagaacggagaagtcaatgaggcttgcaatcgtgcaagagctaaatatgggctaacaccgttataa

SEQ ID NO: 770 - protein, 105 aa, Escherichia coli
NPCMTCGACCAFFRVSFYWAEADDAGGTIPARLTEQISPFHRCMSGTNQKNPRCIALAGTPGKNACCTIYENRSSTCREFAMSGENGEVNEACNRARAKYGLTPL

SEQ ID NO: 771 - DNA, 711 bp, Escherichia coli
atgttcaggcgacgtggcgtaacattaactaaggccctgctgacagtggtctgtatgctggcggcacctttgacacaggcgatttcggtcggcaatctgactttttcactgccgtccgagactgactttgtcagcaaacgtgtcgtgaataacaacaaaagcgcgcggatataccgtattgccatcagtgctattgatagcccgggcagcagtgaattgcgcacccgaccggtggatggtgaactacttttcgccccccgccagctggcgttgcaggctggtgagagcgagtattttaaattttactatcatggcccacgggataaccgcgagcgctactaccgggtctcatttcgcgaggtccccactcgtaacctgacaaaacgcagcccaagcggcggtgaggtcagcacggagccggtggtggtgatggataccattctggtagtacgaccacgtcaggttcagtttaaatggtccttcgatcaggtgaccggaacggtaagtaacaccggcaacacgtggtttaagctactgattaaaccaggatgtgattcgaccgaagaggaaggcgatgcctggtatctacgtccgggagacgtggttcatcagcctgagttacgtcagccggggaatcattatctggtctataacgacaaattcattaagattagcgattcctgtccggctaagcccccttcggcggactaa

SEQ ID NO: 772 - protein, 236 aa, Escherichia coli
MFRRRGVTLTKALLTVVCMLAAPLTQAISVGNLTFSLPSETDFVSKRVVNNNKSARIYRIAISAIDSPGSSELRTRPVDGELLFAPRQLALQAGESEYFKFYYHGPRDNRERYYRVSFREVPTRNLTKRSPSGGEVSTEPVVVMDTILVVRPRQVQFKWSFDQVTGTVSNTGNTWFKLLIKPGCDSTEEEGDAWYLRPGDVVHQPELRQPGNHYLVYNDKFIKISDSCPAKPPSAD

SEQ ID NO: 773 - DNA, 1644 bp, Escherichia coli
atgagagttaacctactgatagcgatgataatctttgcgctaatctggcctgcaaccgcgctcagagcggcagtgagcaaaacaacctgggcggatgctccggcacgcgagtttgtgtttgtcgaaaacaactcagacgacaactttttcgtcactcctggcggggcgctggatccgcgcctgaccggtgccaaccgctggaccggtttaaaatacaatggttcaggaaccatctatcagcaaagcctcggctacattgataacggttacaacaccggcctttataccaactggaagtttgatatgtggctggaaaattcaccagtttcatctcctttaactggcttgcgctgcatcaactggtacgcagggtgtaatatgaccaccagtcttatcctgccgcaaaccaccgacgccagtggattttatggcgcgacggtgaccagcggcggcgcgaaatggatgcacggcatgttgtcagacgcgttttaccagtatctgcaacaaatgcccgtcggcagcagctttacaatgaccatcaatgcctgccagacctctgtgaactatgacgccaacagcggcgcacgctgtaaggatcaggcctccggcaactggtatgttcgcaacgtcacccatacgaaagcagcaaatctgcggttgataaatacccactcgctggcggaagtatttatcaacagcgacggagtaccgactctgggcgaagggaacgccgactgccggacgcaaaccatcggcagccgttcaggattaagttgtaagatggttaactataccctgcaaacaaacggactcagcaacacctcaatccatatattcccggcgatcgccaactcgtcgttagcctcggccgtcggggcgtacgatatgcagttcagtctgaatggcagttcatggaaaccggtgagcaatactgcctattactacaccttcaacgagatgaagagcgcagactcgatctatgttttcttctcgagcaacttctttaaacagatggtgaacctcgggatcagcgatatcaacaccaaagatctattcaactttcgctttcagaacaccacatcaccggagtctggctggtatgaattttctacctccaacacgctgattatcaaaccccgtgatttcagcatcagtattatctccgatgaatatactcagacaccgtcgcgggagggatatgttggcagcggcgagtcggcactcgatttcgggtatatcgtaaccaccagcggtaaaacagctgccgacgaagtgctgatcaaggtgaccggacccgcgcaggtgattggcgggcgctcctattgtgtcttcagctccgatgacggtaaggcgaaagtaccgttcccggcgacgctttcctttattacccgcaacggagctacaaaaacctacgatgccgggtgcgatgatagctggcgggatatgaccgatgcgctgtggttgaccacaccgtggactgatatctctggcgaagtggggcagatggataagaccacagtcaaattttcgattccaatggataacgccatttctctgcgtacggtagatgataacggctggtttggcgaagtcagcgcttcaggagagattcatgttcaggcgacgtggcgtaacattaactaa

SEQ ID NO: 774 - protein, 547 aa, Escherichia coli
MRVNLLIAMIIFALIWPATALRAAVSKTTWADAPAREFVFVENNSDDNFFVTPGGALDPRLTGANRWTGLKYNGSGTIYQQSLGYIDNGYNTGLYTNWKFDMWLENSPVSSPLTGLRCINWYAGCNMTTSLILPQTTDASGFYGATVTSGGAKWMHGMLSDAFYQYLQQMPVGSSFTMTINACQTSVNYDANSGARCKDQASGNWYVRNVTHTKAANLRLINTHSLAEVFINSDGVPTLGEGNADCRTQTIGSRSGLSCKMVNYTLQTNGLSNTSIHIFPAIANSSLASAVGAYDMQFSLNGSSWKPVSNTAYYYTFNEMKSADSIYVFFSSNFFKQMVNLGISDINTKDLFNFRFQNTTSPESGWYEFSTSNTLIIKPRDFSISIISDEYTQTPSREGYVGSGESALDFGYIVTTSGKTAADEVLIKVTGPAQVIGGRSYCVFSSDDGKAKVPFPATLSFITRNGATKTYDAGCDDSWRDMTDALWLTTPWTDISGEVGQMDKTTVKFSIPMDNAISLRTVDDNGWFGEVSASGEIHVQATWRNIN

SEQ ID NO: 775 - DNA, 2526 bp, Escherichia coli
atgcctttacgacggttctccccaggactgaaagcccagtttgccttcggcatggtctttttgttcgttcagcccgatgccagcgctgctgacataagtgcgcagcaaataggtggggtgattattccgcaggccttcagtcaggcgcttcaggacggcatgagcgtcccgctctatattcatctcgccggtagccagggtcgccaggacgatcagcgaatcggcagcgcttttatctggttggatgatggacagttacgcatccggaaaatacagctggaagagagtgaagataacgccagtgtcagcgaacaaactcgacagcaactgatgactctggccaacgccccgttcaatgaggcccttaccatccccctgactgacaacgcgcagttggatctcagcttgcgccaactgctgctgcagctggtggtcaagcgcgaagcgctgggcaccgtactacgctcacgtagcgaagacatcgggcagtccagtgttaacaccctcagcagtaatctgagctataacttcggcgtctataacaaccagttgcgtaacggcgggagcaacacctccagctatctgtcgctgaataacgttactgcgctgcgcgaacatcacgtggtgctcgacggctcactgtacgggattggtagcggtcaacaggacagtgaattatataaagcgatgtatgaacgcgattttgctggtcaccgatttgccggtggaatgctcgacacctggaacttgcagtccttagggccgatgaccgccatttcagcagggaagatttacggcctttcctggggaaaccaggccagctccaccatcttcgacagcagccaatcggccacgccagtgatcgcctttttaccggcggcgggcgaagtacatctcacccgtgatgggcgactactaagcgttcagaacttcaccatgggcaatcatgaagtggatacccggggtctaccgtacggtatttacgatgtggaagttgaggtaatcgttaacggtcgcgtgatcagcaaacgcacccagcgggtcaataagctgtttagccggggacgtggcgtcggtgcaccgctggcgtggcagatatggggcggtagctttcatatggatcgctggtcggaaaacgggaaaaagacgcgaccagccaaagagagttggctggcaggtgcctcgacctccggctcactgagtacgtttagctgggcggcaacgggatatggatacgataatcaggcggtgggtgaaacccgtctgacgctgccgcttgggggggcgatcaacgttaacctgcaaaacatgctggccagtgacagctcatggagcaacatcgccagcatcagcgccactctacctggaggcttcagttcgctgtgggttaaccaggaaaaaacccgcattggcaatcaattgcgacgtagcgatgccgacaaccgtgcaatcggcggcacactcaacctgaactcactgtggtcgaagctgggtacgttcagcatcagctacaatgatgaccgccgctacaacagccattattacacggcagattactatcaaagtgtctacagcggtacctttggttcgcttggcctgcgggccggtattcagcgctataacaacggcgacagcagcgccaatacagggaaatatatcgctctcgatctctcgctaccactgggcaactggtttagcgcagggatgacccatcaaaacggctacaccatggcaaacctgtcagcacgcaaacagtttgatgaaggaaccattcgcactgttggtgccaatctgtcacgagccatctccggcgataccggtgatgacaaaaccctcagcggtggggcgtatgcacagttcgacgctcgttacgccagcggaacgctgaacgtcaatagcgcggcggacggctacatcaatactaatttgaccgccaacggcagcgtcggctggcagggtaaaaacatcgctgccagcgggcggaccgatggcaacgctggggtgatattcgacactggcctggagaacgatggtcagatcagcgccaaaatcaacgggcggattttcccgcttaacggcaagcgtaactatctcccgctctctccctatggaagatatgaggtggagttgcagaacagcaaaaactcactcgacagttacgatatcgtcagcggtcgcaaaagtcatctgactctctatccaggcaatgtcgctgtcattgagccagaggtgaagcagatggttaccgtctccggtcgtatccgtgcggaagacggcacactgctggctaacgcacggattaacaaccatatcggccgaacccgaaccgatgaaaacggcgagtttgtcatggacgtggataagaaataccccactatcgattttcgctacagtggcaataaaacctgcgaagtggcactggaactcaaccaggcgcgcggtgccgtctgggtcggtgatgtggtctgcagcggcctctcatcgtgggcggcggtgacgcagacaggagaagagaatgagagttaa

SEQ ID NO: 776 - protein, 841 aa, Escherichia coli
MPLRRFSPGLKAQFAFGMVFLFVQPDASAADISAQQIGGVIIPQAFSQALQDGMSVPLYIHLAGSQGRQDDQRIGSAFIWLDDGQLRIRKIQLEESEDNASVSEQTRQQLMTLANAPFNEALTIPLTDNAQLDLSLRQLLLQLVVKREALGTVLRSRSEDIGQSSVNTLSSNLSYNFGVYNNQLRNGGSNTSSYLSLNNVTALREHHVVLDGSLYGIGSGQQDSELYKAMYERDFAGHRFAGGMLDTWNLQSLGPMTAISAGKIYGLSWGNQASSTIFDSSQSATPVIAFLPAAGEVHLTRDGRLLSVQNFTMGNHEVDTRGLPYGIYDVEVEVIVNGRVISKRTQRVNKLFSRGRGVGAPLAWQIWGGSFHMDRWSENGKKTRPAKESWLAGASTSGSLSTFSWAATGYGYDNQAVGETRLTLPLGGAINVNLQNMLASDSSWSNIASISATLPGGFSSLWVNQEKTRIGNQLRRSDADNRAIGGTLNLNSLWSKLGTFSISYNDDRRYNSHYYTADYYQSVYSGTFGSLGLRAGIQRYNNGDSSANTGKYIALDLSLPLGNWFSAGMTHQNGYTMANLSARKQFDEGTIRTVGANLSRAISGDTGDDKTLSGGAYAQFDARYASGTLNVNSAADGYINTNLTANGSVGWQGKNIAASGRTDGNAGVIFDTGLENDGQISAKINGRIFPLNGKRNYLPLSPYGRYEVELQNSKNSLDSYDIVSGRKSHLTLYPGNVAVIEPEVKQMVTVSGRIRAEDGTLLANARINNHIGRTRTDENGEFVMDVDKKYPTIDFRYSGNKTCEVALELNQARGAVWVGDVVCSGLSSWAAVTQTGEENES

SEQ ID NO: 777 - DNA, 669 bp, Escherichia coli
atgaaaaagcaccttctgcctctcgctctgctgttttccggaatatcaccggcccaggcgctggatgtcggcgatatatcatcgtttatgaacagtgacagcagcacgctaagcaaaacgatccaaaacagtaccgacagtggccgcctcatcaatatccgtctcgaacggctctcttcaccgcttgacgacgggcaggttatcgcaatggacaagccggatgagttgctactcactcccgccagcttgctgctacccgcccaagccagcgaagtgatccgcttcttctataagggaccagcagatgaaaaagagcgctactaccgcattgtctggtttgatcaggccctcagtgatgcgcagcgcgataatgccaaccgtagcgctgtggccactgcttccgcccgcatcggcaccattctggtcgtcgcaccccgccaggcaaactaccactttcagtacgccaacggctccctgacaaatacaggaaatgcgacgctgcggatcctcgcctacggcccctgcctgaaagccgccaatggtaaggagtgtaaagagaattactacctgatgccgggcaagtcgcgtcgttttacccacgtggacacggcggataacaaaggacgggttgcactttggcagggtgataagttcattcccgtgaaatag

SEQ ID NO: 778 - protein, 222 aa, Escherichia coli
MKKHLLPLALLFSGISPAQALDVGDISSFMNSDSSTLSKTIQNSTDSGRLINIRLERLSSPLDDGQVIAMDKPDELLLTPASLLLPAQASEVIRFFYKGPADEKERYYRIVWFDQALSDAQRDNANRSAVATASARIGTILVVAPRQANYHFQYANGSLTNTGNATLRILAYGPCLKAANGKECKENYYLMPGKSRRFTHVDTADNKGRVALWQGDKFIPVK

SEQ ID NO: 779 - DNA, 588 bp, Escherichia coli
atgaaaaaaaaggttctggcaatagctctggtaacggtgtttaccggtacaggtgtagcgcaggctgctgacgtaacagctcaggctgtagcgacctggtcagcaacagccaaaaaagacaccaccagtaagctggttgtgacgccactcggtagcctggcgttccagtatgccgaaggcattaaaggttttaactcacaaaaaggtctatttgacgtggctatcgagggtgactcaacggctaccgcctttaaactgacctcacgccttatcaccaacaccttaacccagttggatacctcaggttccacactgaatgtgggcgtggattataacggcgcggcagtcgaaaaaactggcgataccgtgatgatcgataccgccaacggcgtactgggcggcaaccttagcccactggctaacggttacaatgccagcaatcgtaccaccgcacaggatggtttcactttctccatcatcagcggcaccaccaatggtaccaccgcagtaaccgattacagcactctaccggaaggcatctggagcggcgacgttagcgtacagttcgacgctacctggaccagttaa

SEQ ID NO: 780 - protein, 195 aa, Escherichia coli
MKKKVLAIALVTVFTGTGVAQAADVTAQAVATWSATAKKDTTSKLVVTPLGSLAFQYAEGIKGFNSQKGLFDVAIEGDSTATAFKLTSRLITNTLTQLDTSGSTLNVGVDYNGAAVEKTGDTVMIDTANGVLGGNLSPLANGYNASNRTTAQDGFTFSIISGTTNGTTAVTDYSTLPEGIWSGDVSVQFDATWTS

SEQ ID NO: 781 - DNA, 168 bp, Escherichia coli
aaagataaaatcactgaccgggaaatggaaattatccgcatgacggctcagggaatgctgcctaaatcgattgccagaattgaaaattgtagtgtgaagacagtgtatacccatcggcggaatgcagaggccaagctgtactcaaaattatataagttggttcagtaa

SEQ ID NO: 782 - protein, 55 aa, Escherichia coli
KDKITDREMEIIRMTAQGMLPKSIARIENCSVKTVYTHRRNAEAKLYSKLYKLVQ

SEQ ID NO: 783 - DNA, 144 bp, Escherichia coli
atgatgaaagtccttaactctctgcgtaccgcaaaagaacgccatccagactgtcagattgtgaagcgaaaaggacggctgtatgtgatttgtaaatctaatccacgttttaaggccgttcagggtcgtaagaaaaaacgttga

SEQ ID NO: 784 - protein, 47 aa, Escherichia coli
MMKVLNSLRTAKERHPDCQIVKRKGRLYVICKSNPRFKAVQGRKKKR

SEQ ID NO: 785 - DNA, 273 bp, Escherichia coli
  n 8, 9, 10, 11, 12: n is any nucleotide
atgaatgnnnnnctgggcagaccagacgccaccatcacgcgatacgacaaaagcacgttcacctgctcatcggcctgtactgacgcggtgaatgcgccggaatggcggtattactggcaggtcaacatgccagccgccaccaacagcacctggatgacatgtggcgatccctgtgattccgcgctgcgtatctggggcgacaccgtcgtcgaatgtgtgcttaacaaactctgcccttcgcatacctacgtaatttttaaatatccggagtaa

SEQ ID NO: 786 - protein, 90 aa, Escherichia coli
  Xaa 3, 4: Xaa is any amino acid
MNXXLGRPDATITRYDKSTFTCSSACTDAVNAPEWRYYWQVNMPAATNSTWMTCGDPCDSALRIWGDTVVECVLNKLCPSHTYVIFKYPE

SEQ ID NO: 787 - DNA, 744 bp, Escherichia coli
atgcatcgtatagacacgaaaaccgcgcagaaggataagttcggcgcgggtaagaacggttttacccgtggtaacccccagacaggcacgcctgccaccgatctggatgatgactactttgacatgttgcaggaagaactctgcagcgtggtggaggcatccggtgccagtctggagaaggcgcggcacgaccagctgcttaccgcgcttcgtgcgctgctgttaagccgcaagaatccgtttagcgatatcaaatcggacggcacggtgaaaacggctctcgaaaaccttggtttgggagaagcggcaaaacggaatgtgggcaacggggaaaaccaaatccctgatatgtctttctggacggttactggtggcaatggaaattttgtgattcgtcaacctgacgggctaatcattcagatggttactgtaagtataagcggcccagtggcgatgaatggaatgactgataatgcttatgccatcacaggttctaataagtcttatattgccacagccacattgccctttgtatttcctaataaggtgctgggcgttatccctctggtatcaacaacagcttatggtggtgtatccagtaatattacaggttcatacgcgacggcggtttgttcttttgccgctgtcagggggaataatacgattgtgttcaaagtcgacaaaccactgaatgcagcctttccttcagataccagcgtctcagcgttaatcattggacggtaa

SEQ ID NO: 788 - protein, 247 aa, Escherichia coli
MHRIDTKTAQKDKFGAGKNGFTRGNPQTGTPATDLDDDYFDMLQEELCSVVEASGASLEKARHDQLLTALRALLLSRKNPFSDIKSDGTVKTALENLGLGEAAKRNVGNGENQIPDMSFWTVTGGNGNFVIRQPDGLIIQMVTVSISGPVAMNGMTDNAYAITGSNKSYIATATLPFVFPNKVLGVIPLVSTTAYGGVSSNITGSYATAVCSFAAVRGNNTIVFKVDKPLNAAFPSDTSVSALIIGR

SEQ ID NO: 789 - DNA, 363 bp, Escherichia coli
  n 340, 341, 342, 343, 344: n is any nucleotide
atgaactcagtattcttttcacccggaagtaaaagtttttatctgcaagaattgtttccagaatatgaggatgcgggaacgcttcctgatgatgttattgaaattaccagagaaacatatgagcaatttcttggtctgcatccagaagggaaagaaattggcgctgacagttcaggacggccagtatggattaattccccacccccttcaaaagaggatgaggtgttgacggctgaaatgaaaaaaatatctttggtttcagaagtcaatacctacatcaatacccatcagtggcctggcaaagctgctattggtcgtctgaaaggcgaggaactggcgnnnnncattccattcattaattaa

SEQ ID NO: 790 - protein, 120 aa, Escherichia coli
  Xaa 114, 115: Xaa is any amino acid
MNSVFFSPGSKSFYLQELFPEYEDAGTLPDDVIEITRETYEQFLGLHPEGKEIGADSSGRPVWINSPPPSKEDEVLTAEMKKISLVSEVNTYINTHQWPGKAAIGRLKGEELAXXIPFIN

SEQ ID NO: 791 - DNA, 375 bp, Escherichia coli
atcgatcatcttatgcctcaaagttggtattcctgttggcctctcgaaaatggtcgtatggtgacaaattcagatgctacggtattgaaccaaattgttctgtctggaaccgatcttacccctgaacagctactggtaaggaaacggcaacaagcgatatctactttgggaaatctaactttgcttaaccttagcgtaaaccgttctgttcagaatgctgtatttctgaaaaaacgtgatgctctcatcgtccacaccaatctacgactgaacattccacttatagttaaggataaatgggatgaggatgaaatcctggagcggggtaaaaagttgggggaaattgcattgaaagtatggccaaaacacgattaa

SEQ ID NO: 792 - protein, 124 aa, Escherichia coli
IDHLMPQSWYSCWPLENGRMVTNSDATVLNQIVLSGTDLTPEQLLVRKRQQAISTLGNLTLLNLSVNRSVQNAVFLKKRDALIVHTNLRLNIPLIVKDKWDEDEILERGKKLGEIALKVWPKHD

SEQ ID NO: 793 - DNA, 93 bp, Escherichia coli
gtgattgatgatggtttcgctgagagtatggatttttcgagaatggaggctatctccactttactggccgatgatttattgcagcatgattga

SEQ ID NO: 794 - protein, 30 aa, Escherichia coli
MIDDGFAESMDFSRMEAISTLLADDLLQHD

SEQ ID NO: 795 - DNA, 102 bp, Escherichia coli
atgaaaaagaataaagtacagcaaatcagtcataaactgattaatatcgttgtttttgtcgcaattgtagaatacgcctatttatttctccatttctattaa

SEQ ID NO: 796 - protein, 33 aa, Escherichia coli
MKKNKVQQISHKLINIVVFVAIVEYAYLFLHFY

SEQ ID NO: 797 - DNA, 1143 bp, Escherichia coli
atgacaaataaacacccatcattgttttctccttttatgctgacagaaaaaataaagctacgtaatcgtatcgttatggctcctatgacaacctggtcagctaatcctgatggaaccatctctgagcaagaactcgaattttataaacgtcgctcacaaaatgttggtttagtaataacaggatgtacctatgtcacgccaagcggcattgggtttactcatgaatttgccgcgtatgacgaccgtttcattaacagccttgaaaagttagcagctgcagccaaaagtggcggtgctccggctattttgcagattttccacgccggtaataaagccatcccagagcttgtgccaaataacgatgttattagtgccagcgcatcaagcgtaaaatctggtgactttatgaagagagtggtacaaagcagggaaatgactgaaaacgaaattcaggaaaccattagagcattcggagatgtcacaaaaagggcgattaaagcaggttttgatggcgttgaacttcatggtgcgcacggattccttctgcagaatttcttctcccctctatttaaccagcgtaatgaccgatggggaggagatcttgaaggacgtatgcgcttcccgctggccgtattacaggaagtaaaaaatgtagtctatgaatatgcgacaaagccctttgctatcggttacagaatatctcctgaagaatctgtaacaggggggctgcggatagaggatacttataaactccttgatcggctcatttcatccggtatttcgtatatacatacctcgctggtcagtattaacgatagctaccctgttgagtcgccaaatggcccccgaactattgaattgattttaaatcatattgcaggcagagtgccggtaatcgccgcaggtaaaatacgcacaccgtctcaggctcaagaagcaatttccgctggcctgccacttgttgcgatcggtaaagggctggtgataaatccagaatgggtgactttagctgaatcaggtagaagtcatgaaattcaaacagcccttaatccacaacgcgttcctgaattaaccattccggataaactatgggatcaaattcaggcatcgaaaggaactggctggtttccgttaatggattaa

SEQ ID NO: 798 - protein, 380 aa, Escherichia coli
MTNKHPSLFSPFMLTEKIKLRNRIVMAPMTTWSANPDGTISEQELEFYKRRSQNVGLVITGCTYVTPSGIGFTHEFAAYDDRFINSLEKLAAAAKSGGAPAILQIFHAGNKAIPELVPNNDVISASASSVKSGDFMKRVVQSREMTENEIQETIRAFGDVTKRAIKAGFDGVELHGAHGFLLQNFFSPLFNQRNDRWGGDLEGRMRFPLAVLQEVKNVVYEYATKPFAIGYRISPEESVTGGLRIEDTYKLLDRLISSGISYIHTSLVSINDSYPVESPNGPRTIELILNHIAGRVPVIAAGKIRTPSQAQEAISAGLPLVAIGKGLVINPEWVTLAESGRSHEIQTALNPQRVPELTIPDKLWDQIQASKGTGWFPLMD

SEQ ID NO: 799 - DNA, 921 bp, Escherichia coli
atgaaaactgtttcgataaaacacacttactgggatatagctgctgatatctatttccctgacgattttaatagtgaaaaaaagtatcctgccattatcagtgcccatccaattggaagctgcaaagaacagacatcgggtagtgtgtatggtgccgccctggcaaaagctggctttatcgtcattgcttttgatgccagttttcagggaagcagcggtggagaaccgcgttatctggaagatccaacaatgcgagtaaaagacttcagcattgtcgttgattaccttaccaccttaccttacgttgatgccgggcgtattggtgtactgggtatttgtggtggaggtggatatgccattaatgccgcaatgacagaacgtcggattaaagccattggtactgtcacgggtgcaaactacgggcgtcttatgcgtgagggatttacagcgtttaatcctatcggagcactcgaagcaatggcgcaacaaagaacagacgaagctaacggcgcaaaacttcgcgtagatgatttgctcccttcttctccggaagcagctcttgaagcgggattaacagaaatagacctttttgaagcaacagaatattatcgttcgccacgaggctgtgcgcctaatggggtaaatcgttcgctattttcacatcagactgttgccgtgggctgggatgcttttcatcttgcagaagtcctgttaactcaaccactaatggttgtagtgggcgatagagtgggcgcttttggtgcctatcgtgacggctgcgaaattattggtcgtgcagcctcaaaacataaagaactggtcgtggttgaaggttattcacattacgacctgtatgataagccagaacctgtgaaacaggcgctcgataaattaattcctttttacaaaacacatttgtaa

SEQ ID NO: 800 - protein, 306 aa, Escherichia coli
MKTVSIKHTYWDIAADIYFPDDFNSEKKYPAIISAHPIGSCKEQTSGSVYGAALAKAGFIVIAFDASFQGSSGGEPRYLEDPTMRVKDFSIVVDYLTTLPYVDAGRIGVLGICGGGGYAINAAMTERRIKAIGTVTGANYGRLMREGFTAFNPIGALEAMAQQRTDEANGAKLRVDDLLPSSPEAALEAGLTEIDLFEATEYYRSPRGCAPNGVNRSLFSHQTVAVGWDAFHLAEVLLTQPLMVVVGDRVGAFGAYRDGCEIIGRAASKHKELVVVEGYSHYDLYDKPEPVKQALDKLIPFYKTHL

SEQ ID NO: 801 - DNA, 990 bp, Escherichia coli
atgacttgtattggttatcatcaatggtctaatatctatcacagtgttaagttaaggtttacaatgatgaaaatagagccttcaattttgccttctcttgcctggtttgcgctgattgttcgtgccggcagtttttccagagcagcctctgaaatgggtattacgcgggccgcattgtcccagaatttaaaatctcttgaggaacgtcttaacaccaagctgatataccgtacgacccgcaatatgtcgcttactgaggaaggacagcatctgtatgaagtgctggtgtcggctttggggcaaattgatgatgcgttgaaagatgtcggtgatacccaacttgaacctacaggactgttgagaataaattcctcccgtgttgcagcaaggatgcttgttgagcctcatattggcgagtttcttactcgttaccctaaaacaaagatagaactcattatggatgacggtttatctaacattattgcggacggctgtgatgtgggcatacgtcttgagcaaggactggatgagcatatgactgccgttcctgtttctccgcttattaaactggttactgtggcatcgccagattatttaaaagaacacggtattcctgaaactcctcaggaattgagtaaccataattgtcttcggttgcggcataaaagtagcggtgcactctcagcatgggagttttcgaatgttgtggggggtaatgaagagttcgaaatagaggtgtcaggtaagtatatttctaatgatgacgaaagcatgatacgaatggcgctgaatggaacgggtatcattcaacatctggattttgcaatcgctgaacatatcaatgcgggcaagttacagccgattcttgaggattgggccgtttcatttcctggattttatatatatgtttcatcacgggtgagaatgccctctaaagttcgtgcttttattgattttatggtggagaaaagagtaaaaatagaaagttaa

SEQ ID NO: 802 - protein, 329 aa, Escherichia coli
MTCIGYHQWSNIYHSVKLRFTMMKIEPSILPSLAWFALIVRAGSFSRAASEMGITRAALSQNLKSLEERLNTKLIYRTTRNMSLTEEGQHLYEVLVSALGQIDDALKDVGDTQLEPTGLLRINSSRVAARMLVEPHIGEFLTRYPKTKIELIMDDGLSNIIADGCDVGIRLEQGLDEHMTAVPVSPLIKLVTVASPDYLKEHGIPETPQELSNHNCLRLRHKSSGALSAWEFSNVVGGNEEFEIEVSGKYISNDDESMIRMALNGTGIIQHLDFAIAEHINAGKLQPILEDWAVSFPGFYIYVSSRVRMPSKVRAFIDFMVEKRVKIES

SEQ ID NO: 803 - DNA, 894 bp, Escherichia coli
atgctcaaagaaaacttcaacgaactgcaaatctttcttgtggtggcaagagagcgaagttttaccaaagcagcgggcaaactcggcgtctctcagtctgcacttagccatgcaatgaaggctctggaggaaaggctcaatatccgcctcctgacacggactacccgcagtgtggctcccacagaagcgggggagagaatcattgcctgccttgaaccgcgtattgacgagcttgaacaggaactggaatcacttattcaattgaacggcacgccctccgggaatattcggttatctgccggggaacatgccgcgcgaagtctggtctggccgaagctaaaaccttttctcagagagtatcccgaaatcaatgtcgaactggtggtggataacggttttgtcgatattgttgaaggccgttttgatgccgggatacgactgggtgaaaatgttgataaagatatggttgcagtcaggattggaccagatatgcggatggctgtggtgggagctccggcgtattttgctgcaaaccctgcgcctgaaacgcctcacgagctacaaaatcatcgctgcatcaacatgcgtttgccaactgccggtgggctttaccactgggagttcgagcgagaagggaaaccgcttcgcgttaaggttgatgggcaactgacgtgtagtccattgccagaaagaattgatgccgcgttatcagggtttgggatcgcttgtgtccctgaagacatggttcaggagtatatagagtcaggcaagcttattcaggtgttacaggagtggtgtccaacttttcctgggtattatctttactaccccagccgcaagcagcatccgccagcttttgcgttgttgatcgatgcgcttcgctacaccgaataa

SEQ ID NO: 804 - protein, 297 aa, Escherichia coli
MLKENFNELQIFLVVARERSFTKAAGKLGVSQSALSHAMKALEERLNIRLLTRTTRSVAPTEAGERIIACLEPRIDELEQELESLIQLNGTPSGNIRLSAGEHAARSLVWPKLKPFLREYPEINVELVVDNGFVDIVEGRFDAGIRLGENVDKDMVAVRIGPDMRMAVVGAPAYFAANPAPETPHELQNHRCINMRLPTAGGLYHWEFEREGKPLRVKVDGQLTCSPLPERIDAALSGFGIACVPEDMVQEYIESGKLIQVLQEWCPTFPGYYLYYPSRKQHPPAFALLIDALRYTE

SEQ ID NO: 805 - DNA, 990 bp, Escherichia coli
atgcaaaaacgttatctgggtaaatccggactcgaagtctccgcccttgggctcggttgcatgggcttaagccacggctacggcccggcgaccgatacccgtcaggctatcgaacttattcgtgctgcgattgaacgtggtgtcaccttcttcgataccgccgaagtgtatggtccgtatctgaatgaagaagtggtcggcgaagccttaaaaccgtttcgtgaccgcgtggtaattgccactaaattcggttttaccttcggcgatgataataagcagcagattttaaacagccgtccggaacatatccgtgaagccgttgaaggatcattacgtcgtctgaaaacagatgttattgacctgctgtatcaacaccgtgttgatccagatgttcctattgaagatgttgcaggaacggtgaaagacctcatcgcagaaggtaaggtcaaacatttcggcctgtctgaagcaggagcacaaaccattcgtcgtgcacatgcggtacaacctgtcaccgccctgcaaagcgaatattccatgtggtggcgtgagcctgaacaggaaattctgccgttgcttgaagaactgggaattggttttgtccccttcagcccactaggtaaaggtttcctgacaggggcgattaagccgggaaccactttcggcaaagatgattaccgcagcaccgtaccgcgtttcgcagcacaagccattgaagccaatgaaaaactggtcaccttgttaggtgaactggctgcggagaaaggggtaacgtctgcacaaattgcactggcatggctattagcacaaaagccgtggattgttcccatccctggcaccactaaactgcaccggctggaagaaaacctggccgctgctgacattgttctttcgcagaaagatacgcagcagataagcgaggcgctggaaacaattaaaatcgtcggtgaacgttactcgcctgaacatcaggcacgcgtaggccgctaa

SEQ ID NO: 806 - protein, 329 aa, Escherichia coli
MQKRYLGKSGLEVSALGLGCMGLSHGYGPATDTRQAIELIRAAIERGVTFFDTAEVYGPYLNEEVVGEALKPFRDRVVIATKFGFTFGDDNKQQILNSRPEHIREAVEGSLRRLKTDVIDLLYQHRVDPDVPIEDVAGTVKDLIAEGKVKHFGLSEAGAQTIRRAHAVQPVTALQSEYSMWWREPEQEILPLLEELGIGFVPFSPLGKGFLTGAIKPGTTFGKDDYRSTVPRFAAQAIEANEKLVTLLGELAAEKGVTSAQIALAWLLAQKPWIVPIPGTTKLHRLEENLAAADIVLSQKDTQQISEALETIKIVGERYSPEHQARVGR

SEQ ID NO: 807 - DNA, 852 bp, Escherichia coli
atgcaaaaagtaaaactgaacaacggtattgaaatgcccctgttgggctttggtgtatttcagatgaccgatgccgccgaatgcgaaagagcggtcattgacgctattaacagcggttatcgactgattgacaccgccgcctcttatcaaaatgaaatccaggtcgggaacgccctgaaacaaagcggtatcgcccgtaacgaactctttgtcaccacgaaactctggttgcaggataccagttacgaaggggccaaagcccagttcgaacgctctctgaatcgactgcaacttgattacgttgacctgtacttgattcaccagccatatggcgatgtccacggggcctggcgtgccatggaagagctgcaacaggccggtaaaattcgcgctattggcgtcagtaacttccatcctgaccgactggcagaccttatcgcttttaataacgtcgttccggcggtaaaccaggttgaagttaaccctttcaatcagcagctacaggccgttccctggatgcaaagtcgtggcattcagccagaagcctgggcaccgtttgcggaagggaaaaatggtctgttccagcatcctgttctcacggcaattggcgagaagtatggcaaaagcgtgggccaggtagttctgcgctggatctaccaacgaggcattgtttcactggcaaaatcagtgcgaaaagaacgcatggaagagaacatcaacattctcgattttgaactcagccctgaagatatgctgcaaattaccgccctggataccgcaaccagcgcgttcttctctcaccgcgatcccgcaatggtggaatggctgactggccgcaaacttgatgtttaa

SEQ ID NO: 808 - protein, 283 aa, Escherichia coli
MQKVKLNNGIEMPLLGFGVFQMTDAAECERAVIDAINSGYRLIDTAASYQNEIQVGNALKQSGIARNELFVTTKLWLQDTSYEGAKAQFERSLNRLQLDYVDLYLIHQPYGDVHGAWRAMEELQQAGKIRAIGVSNFHPDRLADLIAFNNVVPAVNQVEVNPFNQQLQAVPWMQSRGIQPEAWAPFAEGKNGLFQHPVLTAIGEKYGKSVGQVVLRWIYQRGIVSLAKSVRKERMEENINILDFELSPEDMLQITALDTATSAFFSHRDPAMVEWLTGRKLDV

SEQ ID NO: 809 - DNA, 4251 bp, Escherichia coli
atgtcacgttataaaacagacaataaacagccacgatttcgttattcagttctggcccgctgcgtggcgtgggcaaatatctctgttcaggttctttttccactcgctgtcacctttacgccagtaatggcagcacgtgcgcagcatgcggttcagccacggttgagcatggaaaatactacggtaactgctgataataacgtggagaaaaatgtcgcgtcgcttgccgctaatgccgggacatttttaagcagtcagccagatagcgatgcgacacgtaactttattaccggaatggccaccgctaaagctaaccaggaaattcaggagtggctcgggaaatacggtactgcgcgcgtcaaactgaatgtcgataaaaatttctcgctgaaggactcttcgctggaaatgctttatccgatttatgatacaccgacaaatatgttgttcactcagggggcaatacatcgtaccgacgatcgtactcagtcaaatattggttttggctggcgtcatttttcagaaaatgactggatggcgggggtgaatacttttatcgatcatgatttatcccgtagtcatacccgcattggtgttggtgcggaatactggcgtgattatttgaaactgagcgccaatggttatatccgggcttctggctggaaaaaatcgccggatgttgaggattatcaggaacgcccggcgaatggctgggatattcgtgctgagggctatttacctgcctggccgcagcttggcgcaagcctgatgtatgaacagtattatggcgatgaagtcgggctgtttggtaaagataaacgccagaaagatccacatgcgattaccgctgaagtgaattacacgccagtgcctcttctgaccctgagtgccgggcataagcagggcaagagtggtgagaatgacactcgctttggcctggaagttaattatcggattggcgaacctctggaaaaacaactcgatacagacagcattcgcgagcgtcgaatgctggcaggcagccgctatgacctggttgagcgtaataacaatatcgttcttgagtatcgcaaatctgaagtgatccgtattgctctgcctgagcgtattgaaggcaagggcggccagacggtttccctggggcttgtggtcagcaaagcaactcacggtctgaaaaatgtgcaatgggaagcgccgtctttgctggccgcaggcggaaaaattacggggcagggcaatcagtggcaagtgacgctcccggcttatcaggcaggcaaagacaattattatgcgatttcagcgattgcctacgataacaaaggcaatgcctcgaaacgtgtgcagacagaagtagttattagcggagctggtatgagcgccgatcgtacggcgttaacgcttgacggtcagagccgtattcaaatgcttgctaacggtaatgagcaaaagccgctggtgctgtctctgcgcgacgccgagggccagccagtcacgggcatgaaagatcagatcaagactgaactaaccttcaaaccggctggaaatattgtgactcgtaccctgaaggccactaaatcacaggcaaagccaacactgggtgagttcaccgaaactgaagcaggggtgtatcagtctgtctttactaccggaacgcagtcaggtgaggcaacgattactgttagcgttgatgacatgagcaaaactgtcactgcagaactgcgggccacgatgatggatgtgtcaaactccaccctgagtgctaacgagccgtcaggtgatgtggttgctgatggtcagcaagcctacacgctgacactgacagcggtggactccgagggtaatccggtgacgggagaagccagccgcctgcgacttgttccgcaagacactaatggtgtaaccgttggtgccatttcggaaataaaaccaggggtttacagcgccacggtttcttcgacccgtgccggaaacgttgttgtgcgtgccttcagcgagcagtatcagctgggcacattacaacaaacgctgaagtttgttgccgggccgcttgatgcagcacattcgtccatcacactgaatcctgataaaccggtggttggcggtacagttacggcaatctggacggcaaaagatgctaatgacaaccctgtaactggcctcaatccggatgcaccgtcattatcgggcgcagctgctgctggttctacggcatcaggctggacggataatggcgacgggacctggactgcgcagatttctctcggcactacggcgggtgaattagacgttatgccgaagctcaatgggcaggacgcggcagcaaatgcggcaaaagtaaccgtggtggctgatgcattatcttcaaaccagtcgaaagtctctgtcgcagaagatcacgtaaaagccggtgaaagcacaaccgtaacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctcttcaacggccagcctgcagccaccgaagccgcgcagctgactgttattgccggagagatgtcatcagcgaactctacgcttgttgcggacaataaaactccaacggttaaaacgacgacggaactcaccttcaccatgaaggatgcgtacgggaatccggtcaccgggctgaagccagatgcaccagtgtttagtggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaatgttgcaggtgacgcatctaaggctgagattcgtgatatgacagtgaaggttaataaccaactggctaatggacagtctgctaaccagatcaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcaggggaacttgagatcgaggcctcggtgaaaaactctcagaagacggtcaaggtgaaattcaaggcggatttcagtaccggtcaggcgagcctggaggtagacgccgctgctcaaaaagtggcaaacggcaaagatgcctttacgctgacggcaacggttaaggatcaatacggcaaccttcttcctggcgctgtggtcgtctttaatctgcctcggggcgtcaaaccgcttgcagacggtaatatcatggtgaacgccgacaaggagggtaaagcggaactgaaagtggtttccgtgactgccggaacctatgagatcacggcgtcagcaggaaatgaccagccttcgaatgcgcagtctgtaacgtttgtggctgataagactacggcgaccatctccagtattgaggtgattggcaaccgtgcagtggcggacggcaaaaccaaacagacgtataaagttacggtgactgatgccaataacaacctgctgaaagatagcgaagtgacgctgactgccagcccggaaaatttagttctgactcccaatgggacggcgacaacgaatgagcaagggcaggctattttcaccgccacgaccactgtcgcagcgacatatacactcacggcgaaagtggaacaggccgacggtcaggaatcgacgaaaactgccgaatctaaattcgtcgcggatgataaaaacgcggtgctcgctgcatctccagagcgtgtagattctctggtggcggacgggaagactactgcaacactgacggttactctgatgtcgggtgtcaaccccgtaggaggaaccatgtgggtcgacattgaggctccggaaggggtgacagaggcggattatcagttcctgccgtcgaaaaatgaccatttcgcgagcgggaaaatcacgcgtacatttagtaccaacaagccaggtacatacacattcacattcaactctttgacatatggagggtatgaaatgaaaccagtgactgtgacaattaacgccgttcctgcagatactgaaggcgctgaggagaaataa

SEQ ID NO: 810 - protein, 1416 aa, Escherichia coli
MSRYKTDNKQPRFRYSVLARCVAWANISVQVLFPLAVTFTPVMAARAQHAVQPRLSMENTTVTADNNVEKNVASLAANAGTFLSSQPDSDATRNFITGMATAKANQEIQEWLGKYGTARVKLNVDKNFSLKDSSLEMLYPIYDTPTNMLFTQGAIHRTDDRTQSNIGFGWRHFSENDWMAGVNTFIDHDLSRSHTRIGVGAEYWRDYLKLSANGYIRASGWKKSPDVEDYQERPANGWDIRAEGYLPAWPQLGASLMYEQYYGDEVGLFGKDKRQKDPHAITAEVNYTPVPLLTLSAGHKQGKSGENDTRFGLEVNYRIGEPLEKQLDTDSIRERRMLAGSRYDLVERNNNIVLEYRKSEVIRIALPERIEGKGGQTVSLGLVVSKATHGLKNVQWEAPSLLAAGGKITGQGNQWQVTLPAYQAGKDNYYAISAIAYDNKGNASKRVQTEVVISGAGMSADRTALTLDGQSRIQMLANGNEQKPLVLSLRDAEGQPVTGMKDQIKTELTFKPAGNIVTRTLKATKSQAKPTLGEFTETEAGVYQSVFTTGTQSGEATITVSVDDMSKTVTAELRATMMDVSNSTLSANEPSGDVVADGQQAYTLTLTAVDSEGNPVTGEASRLRLVPQDTNGVTVGAISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAAGSTASGWTDNGDGTWTAQISLGTTAGELDVMPKLNGQDAAANAAKVTVVADALSSNQSKVSVAEDHVKAGESTTVTLVAKDAHGNAISGLSLSASLTGTASEGATVSSWTEKGDGSYVATLTTGGKTGELRVMPLFNGQPAATEAAQLTVIAGEMSSANSTLVADNKTPTVKTTTELTFTMKDAYGNPVTGLKPDAPVFSGAASTGSERPSAGNWTEKGNGVYVSTLTLGSAAGQLSVMPRVNGQNAVAQPLVLNVAGDASKAEIRDMTVKVNNQLANGQSANQITLTVVDSYGNPLQGQEVTLTLPQGVTSKTGNTVTTNAAGKVDIELMSTVAGELEIEASVKNSQKTVKVKFKADFSTGQASLEVDAAAQKVANGKDAFTLTATVKDQYGNLLPGAVVVFNLPRGVKPLADGNIMVNADKEGKAELKVVSVTAGTYEITASAGNDQPSNAQSVTFVADKTTATISSIEVIGNRAVADGKTKQTYKVTVTDANNNLLKDSEVTLTASPENLVLTPNGTATTNEQGQAIFTATTTVAATYTLTAKVEQADGQESTKTAESKFVADDKNAVLAASPERVDSLVADGKTTATLTVTLMSGVNPVGGTMWVDIEAPEGVTEADYQFLPSKNDHFASGKITRTFSTNKPGTYTFTFNSLTYGGYEMKPVTVTINAVPADTEGAEEK

SEQ ID NO: 811 - DNA, 858 bp, Escherichia coli
atgatcaggcagaagattctacagcagctcctggagtggattgagtgcaatcttgagcaccctatttcaatcgaagatatcgcacagaaatctggctacagcagacgcaacatccagcttctgttccgaaatttcatgcatgtgcctttgggagaatacattcgcaaacgaaggctttgtcgtgccgccattcttgtccggctctccgcgaaatctatgcttgatattgcactctctttgcattttgattcacagcagtcattcagccgcgaatttaaaaagttattcggctgctctccccgtgaataccgccaccgtgattattgggatctcgcaaatatcttcccttcttttttaatacgtcaacagcaaaagacggagtgtagattagtcaactttcctgagacacctatttttggcaattcatttaaatatgatattgaagtgtcgaataaattaccggatgaagaagtcaaactgcgacgtcatcatttagtcagatgtatgaagaattttaagacggatatctatttcgtctccacgttcgaaccatcaacaaaatcggtcgatttgctcacagttgaaacttttgccggtacggtatgcaaacaaaccgattcagagatgccgaaagagtggacaattaaccgaggactgtatgcctctttccgctatgaaggtgagtgggagcactaccctgaatgggcgcgaaacctctatctgatggaattacctgccagggggttagccagagtgaacggcagtgatattgagcgattttattacaatgaaaacttcgtcgaaattgatagcaataacattgtttgcgaaatttttatccccgttcgcccggtttag

SEQ ID NO: 812 - protein, 285 aa, Escherichia coli
MIRQKILQQLLEWIECNLEHPISIEDIAQKSGYSRRNIQLLFRNFMHVPLGEYIRKRRLCRAAILVRLSAKSMLDIALSLHFDSQQSFSREFKKLFGCSPREYRHRDYWDLANIFPSFLIRQQQKTECRLVNFPETPIFGNSFKYDIEVSNKLPDEEVKLRRHHLVRCMKNFKTDIYFVSTFEPSTKSVDLLTVETFAGTVCKQTDSEMPKEWTINRGLYASFRYEGEWEHYPEWARNLYLMELPARGLARVNGSDIERFYYNENFVEIDSNNIVCEIFIPVRPV

SEQ ID NO: 813 - DNA, 870 bp, Escherichia coli
gtggaattttccgtattaagtaacaatctgaaaatgccgatgatgggatttggtgtttttcaggttaccgataaagacgtgtgcaaacagtcagtgttgaatgctatccgcacgggttatcgactcatcgacactgcagcggtatacggtaatgaagatgccgtcggtgaagccgttcgtgaagccatatctgaaggtttatgtacccgagaagagttatttataacgtctaaattgtgggtgcaggatatgttgaatcaggatattgcagcagcaggtattgaagcatcattaaaaaaatcggggctagaatacttcgatctctatttattgcaccaggccatgcgcgattattttagtgcgtggcgtgcactcgaagatgcctatgaagagggcaaattaaaagcgattggggtttccaatttctaccctcatgttctggcgaacttttgtgaaacggtaagagttaaaccgatggtcaaccaggtcgagttgcatccctattttgcccaaccagaggcgctggcaaccatgaagtattataacgtgcagcctgaagcatgggctccgttaggtggtggacgacataaaccctttgaaaataatctgcttcagagtattgcagatgcccatcaaaaatcgatttctcaggtcattctgcgttggaatattcaacggggagtggtcgttattccgaaatcgacacatcaacagcgtatcgaagaaaattttgctatttgggatttctcactgacagagaaagaaatggcgcaaattagttcgcttgatttgggttatgttggggaatcggtaaaacattttaatcctgagtttgttcgtggttgtcttgctgtaaaaatacatgattga

SEQ ID NO: 814 - protein, 289 aa, Escherichia coli
MEFSVLSNNLKMPMMGFGVFQVTDKDVCKQSVLNAIRTGYRLIDTAAVYGNEDAVGEAVREAISEGLCTREELFITSKLWVQDMLNQDIAAAGIEASLKKSGLEYFDLYLLHQAMRDYFSAWRALEDAYEEGKLKAIGVSNFYPHVLANFCETVRVKPMVNQVELHPYFAQPEALATMKYYNVQPEAWAPLGGGRHKPFENNLLQSIADAHQKSISQVILRWNIQRGVVVIPKSTHQQRIEENFAIWDFSLTEKEMAQISSLDLGYVGESVKHFNPEFVRGCLAVKIHD

SEQ ID NO: 815 - DNA, 594 bp, Escherichia coli
atggaaagatacctgcacctgttaagtcggggagataaaattggcctgacattgattcgtctgagtattgcgattgtttttatgtggattgggttattaaagtttgtcccttacgaggcagacagcattacaccattcgtcgcaaacagtccactaatgtcgttcttttatgaacacccggaagactataaacagcatctgactcacgaaggcgaatacaaaccagaagcaagagcatggcaaacggctaataatacctatggtttttccaacggtcttggcgtcgtggaggtgattattgctctgctggttttggctaatcctgtcaatcgctggttaggtttattgggtgggctgatggcatttaccacgccgctggtaacactctcatttttaatcaccaccccggaggcatgggtacccgcattgggtgacgctcatcatggtttcccttatttatccggtgctggtcgtctggtattgaaagatactctgatgctggcaggtgctgtcatgataatggcagattcggcgcgggatattcttaaacaacgcagtaatgaatccagttcaacgttaaaaactgaatattga

SEQ ID NO: 816 - protein, 197 aa, Escherichia coli
MERYLHLLSRGDKIGLTLIRLSIAIVFMWIGLLKFVPYEADSITPFVANSPLMSFFYEHPEDYKQHLTHEGEYKPEARAWQTANNTYGFSNGLGVVEVIIALLVLANPVNRWLGLLGGLMAFTTPLVTLSFLITTPEAWVPALGDAHHGFPYLSGAGRLVLKDTLMLAGAVMIMADSARDILKQRSNESSSTLKTEY

SEQ ID NO: 817 - DNA, 252 bp, Escherichia coli
ttgatggtattttatatgtttaaaaaatctgttttatttgcaacactattatctggcgttatggcattttccaccaatgcagatgataaaataattctgaaacatatcagcgtctcatcagtatcagcatcaccgacagttcttgagaatgccattgctgatatggccagaaaatataatgcttcatcctggaaagttacatcgatgcgaattgataataattcaaccgcaacagcagtattgtataaataa

SEQ ID NO: 818 - protein, 83 aa, Escherichia coli
MMVFYMFKKSVLFATLLSGVMAFSTNADDKIILKHISVSSVSASPTVLENAIADMARKYNASSWKVTSMRIDNNSTATAVLYK

SEQ ID NO: 819 - DNA, 1326 bp, Escherichia coli
atgaataaatatcaggcagttattattggttttggcaaggctggaaaaacattagccgtcacgctggcaaaagcaggttggcgtgtggctctcatcgaacaatcaaatgcaatgtatggcgggacctgtattaatatcggctgtatcccaaccaaaacattggttcatgacgcacagcagcacacagattttgtccgtgccatacagcgtaaaaatgaagtggttaattttttacgtaataagaattttcataatcttgcggatatgcccaatatcgacgtgatcgacggccaggcggagtttatcaataatcatagcctgcgtgttcatcggcctgggagaaatctggagattcatggcgagaaaatttttattaataccggtgcacaagccgtggttccgccaattcctggaattaccaccacgcctggtgtatatgacagcaccggattacttaatctaaaagaattgcctgggcatttaggtattttgggcggcggatatattggcgttgagttcgcctctatgttcgctaattttggcagcaaagtaaccattttagaggcagcttcgctgtttttgcctcgggaagatcgggatattgctgataatatcgcgacgattttacgcgatcagggtgtcgatataatcctcaatgcccatgtggagcgaatcagtcaccatgaaaatcaagtgcaagtgcatagcgagcacgcccaactggcggtggatgcactgttaatagcttccggtcgtcaaccggctaccgcttcgttacatccagaaaatgcaggtatcgcagtaaacgagcgcggggcaattgtcgttgacaagcaattacataccaccgcagacaatatttgggcgatgggagatgttaccggcgggctgcaatttacttatatttcactggatgattaccgcattgtgcgtgatgagttgctgggagaaggcagacgtagtactgatgatcggaaaaatgtgccttattccgtattcatgacaccgccactgtccagggttggtatgacagaagaacaggccagagagagtggtgctgatattcaggtggtgacattgcctgtagctgcaattccgcgtgccagagtgatgaatgatactcgtggggtattaaaagcgattgttgataataaaacccaacgtatattaggggcatcactgctgtgtgttgactcccacgagatgatcaatatagtgaaaatggtgatggatgccgggctgccttatagcatattacgcgatcagatatttactcatccgtcgatgagcgaatcactcaatgatctattttcattagtcaaataa

SEQ ID NO: 820 - protein, 441 aa, Escherichia coli
MNKYQAVIIGFGKAGKTLAVTLAKAGWRVALIEQSNAMYGGTCINIGCIPTKTLVHDAQQHTDFVRAIQRKNEVVNFLRNKNFHNLADMPNIDVIDGQAEFINNHSLRVHRPGRNLEIHGEKIFINTGAQAVVPPIPGITTTPGVYDSTGLLNLKELPGHLGILGGGYIGVEFASMFANFGSKVTILEAASLFLPREDRDIADNIATILRDQGVDIILNAHVERISHHENQVQVHSEHAQLAVDALLIASGRQPATASLHPENAGIAVNERGAIVVDKQLHTTADNIWAMGDVTGGLQFTYISLDDYRIVRDELLGEGRRSTDDRKNVPYSVFMTPPLSRVGMTEEQARESGADIQVVTLPVAAIPRARVMNDTRGVLKAIVDNKTQRILGASLLCVDSHEMINIVKMVMDAGLPYSILRDQIFTHPSMSESLNDLFSLVK

SEQ ID NO: 821 - DNA, 855 bp, Escherichia coli
atggatgctcttagccgtttgttgatgcttaacgctccacaaggaacgatcgataagaattgcgtgttaggaagtgactggcaacttccacatggtgccggggaattgtcggttattcgttggcatgcgttaacgcaaggagcggcgaagctggaaatgccgacgggagagatttttacattacgcccgggaaatgtggtcctgctaccacaaaattcagctcatcgcctgagtcatgtcgataatgaatcgacctgtattgtctgtggcactcttcggctgcaacattcggcgcgttattttttaacgtctttgccggaaacgctgtttgtagcaccagtgaaccatagcgtggaatataactggctgagggaggcgatcccgtttttacaacaggaatccagatcggcaatgccgggagtggatgctctgtgtagccagatctgcgctacattctttaccctcgcggtgcgtgagtggattgcacaggttaatacagagaaaaacattctcagtttgcttctgcatccacgtcttggtgcggtaatacagcaaatgatggaaatgcctggacacgcctggaccgtcgaatcgctggccagcatcgcccacatgtcccgggcaagttttgcccagcttttccgtgatgtttccggaaccacgccgctggctgtattaacaaagttgcgtctacaaatagcggcccagatgttttcccgggaaatgctccctgttgtggtgatcgctgagtcagtaggctatgccagcgaatcatcttttcacaaggcgtttgtccgcgagtttggttgtactccgggagaatatcgggaaagggtcagacagcttgcaccctga

SEQ ID NO: 822 - protein, 284 aa, Escherichia coli
MDALSRLLMLNAPQGTIDKNCVLGSDWQLPHGAGELSVIRWHALTQGAAKLEMPTGEIFTLRPGNVVLLPQNSAHRLSHVDNESTCIVCGTLRLQHSARYFLTSLPETLFVAPVNHSVEYNWLREAIPFLQQESRSAMPGVDALCSQICATFFTLAVREWIAQVNTEKNILSLLLHPRLGAVIQQMMEMPGHAWTVESLASIAHMSRASFAQLFRDVSGTTPLAVLTKLRLQIAAQMFSREMLPVVVIAESVGYASESSFHKAFVREFGCTPGEYRERVRQLAP

SEQ ID NO: 823 - DNA, 720 bp, Escherichia coli
gtgaatgtcaatttctttgtcacctgcattggtgacgccctgaaatcaagaatggcacgagactccgtgctgctactggaaaaactcggctgtcgcgtaaatttcccggagaaacaaggatgctgcggtcagcctgcgatcaatagtggttatatcaaagaagcgattccagggatgaaaaatctgatcgccgcactggaggataacgacgatcccattatttcaccggctggctcttgcacctatgccgtaaaaagttacccgacgtatctggcggatgaacctgaatgggcatcacgtgccgaaaaggttgccgcgcgtatgcaggatctcacctcttttattgttaatacattaggggtagtcgatgtaggtgccagtttgcaagggagagcggtgtatcacccatcttgtagcctggcccgtaagctgggggtgaaggacgaaccacttacgctgctgaaaaatgtgcgtggactggagctgttgacctttgctgaacaggatacctgctgcggatttggcggcacgttctcggtcaaaatggccgaaatatccggcgagatggtgaaagaaaaggttgcgcacctgatggaagtccgccctgagtatttaattggtgctgacgtgagttgcctgctgaacatcagtggacgattacaacgggaagggcagaaagtcaaagtgatgcatattgctgaagtgctgatgagccgctga

SEQ ID NO: 824 - protein, 239 aa, Escherichia coli
MNVNFFVTCIGDALKSRMARDSVLLLEKLGCRVNFPEKQGCCGQPAINSGYIKEAIPGMKNLIAALEDNDDPIISPAGSCTYAVKSYPTYLADEPEWASRAEKVAARMQDLTSFIVNTLGVVDVGASLQGRAVYHPSCSLARKLGVKDEPLTLLKNVRGLELLTFAEQDTCCGFGGTFSVKMAEISGEMVKEKVAHLMEVRPEYLIGADVSCLLNISGRLQREGQKVKVMHIAEVLMSR

SEQ ID NO: 825 - DNA, 1428 bp, Escherichia coli
atgtcgatcaaaaccagtaatacagattttaagacacgcattcgtcagcaaattgaagatccgatcatgcgcaaagcggtggcaaacgcgcagcagcgtattggggcaaatcggcaaaaaatggtcgatgaattggggcactgggaggagtggcgcgatcgggccgcccagatacgtgatcatgttctgagtaatctcgacgcttatctgtaccagctctcagaaaaagtgacgcaaaacggaggtcacgtctattttgcaaaaaccaaagaagacgccacccgctacattttacaggttgcccaacgcaaaaatgcccggaaggtggtgaaatctaaatcgatggtgaccgaagagattggtgtcaatcatgtgttgcaggatgccgggattcaggtgattgaaaccgatctgggtgaatacattctccagctggatcaagatccgccctctcatgttgtggtcccggcaattcataaagatcgccatcagatccgtcgagtgctacacgaacatctgggctatgaggggccggaaacgcctgaagcgatgaccttattcattcggcaaaaaatccgcgaagatttcctcagtgctgaaataggtattaccggctgtaatttcgcggtggcagagaccggttcggtatgcctggtgaccaatgaaggtaatgcgcgaatgtgtaccacgctgcctaaaacgcatattgcagtgatgggaatggagcgtattgctcccacgtttgcagaggtagatgtattgatcaccatgctggcgcgcagtgccgttggtgcacgtttgacgggatacaacacctggctgacaggaccgcgcgaagcggggcacgttgatggtcctgaagagtttcatctggttattgtcgataacgggcgttctgaggtgctggcctctgaatttcgggatgtgctgcgctgtattcgttgcggggcttgtatgaatacttgtccggcatatcgccatattggcggtcatggatatggctctatttatccagggccaattggtgcggtgatttccccgttacttggcggttataaagattttaaagatttaccctacgcctgctctttatgcaccgcttgtgacagcgtgtgtccggtgcgtattccgctgtcaaaactgattttgcgtcatcgtcgggtgatggctgaaaaagggatcaccgcaaaagcagagcaacgggcgataaaaatgttcgcttatgccaatagtcatccaggattgtggaaagttgggatgatggctggtgctcatgcggcaagctggtttatcaatggcggcaaaacaccactcaaatttggcgcgattagcgactggatggaagcacgcgatcttcctgaagctgacggagagagtttccgtagttggtttaagaaacatcaggcgcaggagaaaaagaatggataa

SEQ ID NO: 826 - protein, 475 aa, Escherichia coli
MSIKTSNTDFKTRIRQQIEDPIMRKAVANAQQRIGANRQKMVDELGHWEEWRDRAAQIRDHVLSNLDAYLYQLSEKVTQNGGHVYFAKTKEDATRYILQVAQRKNARKVVKSKSMVTEEIGVNHVLQDAGIQVIETDLGEYILQLDQDPPSHVVVPAIHKDRHQIRRVLHEHLGYEGPETPEAMTLFIRQKIREDFLSAEIGITGCNFAVAETGSVCLVTNEGNARMCTTLPKTHIAVMGMERIAPTFAEVDVLITMLARSAVGARLTGYNTWLTGPREAGHVDGPEEFHLVIVDNGRSEVLASEFRDVLRCIRCGACMNTCPAYRHIGGHGYGSIYPGPIGAVISPLLGGYKDFKDLPYACSLCTACDSVCPVRIPLSKLILRHRRVMAEKGITAKAEQRAIKMFAYANSHPGLWKVGMMAGAHAASWFINGGKTPLKFGAISDWMEARDLPEADGESFRSWFKKHQAQEKKNG

SEQ ID NO: 827 - DNA, 696 bp, Escherichia coli
atggataatcggagcaaatttttgaataacgttgctcaggcactggggcgcccgctgcgacttgaaccgcaagcagaagatgcgccgcttaacaactatgctaacgagcggcttacccaacttacccaacagcagcgctgtgacgcgtttatccagtttgccagcgatgttatgttgacgcgctgtgaactgaccagcgaggcgaaggcggcagaagctgcaatacgtctgtgtaaagagctgggagatcagtcggtcgtgattagtggtgacacgaggctggaggaattggggattagcgaacgtttgcagcaggaatgcaatgccgttgtttgggatccggcgaaaggtattgagaacatatcacaagcagagcaggctaaagtgggcgtcgtatatgctgaatatggtttaaccgaatcgggaggcgtggttcttttttccgccgccgggcgcgggcgttcattgagcctgctcccggaatcttctctttttatcctgcgtaaaagcacaatcctgccgcgtgtagcgcaactcgcagaaaaattgcatcagaaagcgcaggccggtgaacgaatgccgtcatgtattaacatcatcagtggtcccagttcaacggcggacattgagcttatcaaagtcgtcggggttcatggtccggtgaaagcggtgtatctgattattgaggattgctga

SEQ ID NO: 828 - protein, 231 aa, Escherichia coli
MDNRSKFLNNVAQALGRPLRLEPQAEDAPLNNYANERLTQLTQQQRCDAFIQFASDVMLTRCELTSEAKAAEAAIRLCKELGDQSVVISGDTRLEELGISERLQQECNAVVWDPAKGIENISQAEQAKVGVVYAEYGLTESGGVVLFSAAGRGRSLSLLPESSLFILRKSTILPRVAQLAEKLHQKAQAGERMPSCINIISGPSSTADIELIKVVGVHGPVKAVYLIIEDC

SEQ ID NO: 829 - DNA, 102 bp, Escherichia coli
atgaaatctgtcgcagataagattgtattaatagtctgtatcaggaatgttcagggtaaatatcagcaaaaagccagcatcatgaatactggatatttatag

SEQ ID NO: 830 - protein, 33 aa, Escherichia coli
MKSVADKIVLIVCIRNVQGKYQQKASIMNTGYL

SEQ ID NO: 831 - DNA, 2298 bp, Escherichia coli
atgaaaaacagtaaggcattttaccgcagcgcattagcgacagctattgttatggctctttctgcaccagcattcgctactgatagcacggtatcaactgatccggttacgctgaatacagagaagacgactctggatcaagatgttgttattaacggtgataacaagattacagccgtaacaattgaaacgtcagattcagataaagaccttaatgttacttttggcggtcacgatattaccgccgcatcaacggtaaaccaagatttcgttgaaggtgtaaaagttagtggtaacaaaaatgttgtgattaatgctacagactccaccatcacagctcaaggtgaaggcacctatgtccggactgcaatggtcattgattcaactggcgatgttgttgttaatggcggtaatttcgttgcaaaaaatgaaaaaggtagtgcgacagggatatctctggaagcgaccacgggaaataatttaacgctcaatggtacaaccataaatgctcaaggtaataagagttacagcaacggctctacggcaatttttgctcaaaagggtaatttgttgcagggttttgacggtgatgcaaccgacaacatcacccttgctgactcaaatattattaatggcgggattgaaacaatagttactgccgggaataagacgggaattcatacagtcaacctgaatattaaggatggctcagtaattggggcggctaataataaacaaacaatttatgcctctgcttcggcacaaggcgcaggttcagcaacgcaaaatttaaatttgtctgttgctgattcaaccatctactctgatgtcctggccctttctgaaagcgagaattcagccagtaccacaacaaatgtaaatatgaacgttgcccgctcttactgggaaggtaatgcttataccttcaatagcggcgataaagcgggtagtgatctggatataaatctttccgatagttcagtctggaaaggcaaagtttcaggggcaggagatgccagtgtatctctgcaaaacgggtctgtctggaatgttacgggttcctcaactgttgatgctctggcagtaaaagacagtacggttaatatcacgaaggctacagtcaatactggcacgtttgcttctcaaaacggcactctgattgttgatgcctcttctgaaaacactctggatatcagcggtaaagcgagcggtgacttgcgtgtttacagtgcgggttcattggatcttatcaatgaacaaacggcatttatttctaccggcaaagacagcactctaaaagccacaggcacaacggaaggtggtctgtatcaatatgacctgacacagggagctgatggtaacttttatttcgtaaaaaacacgcataaagcatccaacgccagctccgtgattcaggcaatggcagctgctccggctaacgtcgctaatctgcaggctgacacgctctccgcccgtcaggatgctgtccgtctgagcgaaaatgacaagggtggcgtatggattcagtactttggcggtaaacagaaacataccaccgcgggaaatgcatcctatgacctggatgtaaatggtgtaatgctgggtggtgatacccgcttcatgactgaagatggtagctggctggccggtgtggcgatgtcttctgcgaaaggtgacatgactaccatgcagagcaaaggtgacactgaaggttacagcttccacgcttacctgagccgccagtataacaacggtatcttcattgatactgctgcacagtttggtcactacagcaacacggcagatgttcgcctgatgaatggtggcggtaccatcaaagctgactttaacaccaatggttttggtgcgatggttaaaggcggttacacatggaaagacggtaatggcctgtttattcagccatatgccaaactgtctgctctgactctggaaggtgtggattatcaactcaacggcgtggacgttcattctgacagctataactctgtgctgggtgaggccggtacgcgcgtgggttatgacttcgctgtgggcaacgcgaccgttaaaccttatctgaatctggccgcactgaacgaattctctgatggcaacaaagtccgtctgggtgatgagtctgtcaatgccagcattgacggtgcagcattccgcgtgggtgcaggtgtacaggctgatatcaccaaaaacatgggagcatatgcaagccttgactacaccaaaggtgacgacattgagaacccgctacagggtgtagttggtatcaatgtgacctggtaa

SEQ ID NO: 832 - protein, 765 aa, Escherichia coli
MKNSKAFYRSALATAIVMALSAPAFATDSTVSTDPVTLNTEKTTLDQDVVINGDNKITAVTIETSDSDKDLNVTFGGHDITAASTVNQDFVEGVKVSGNKNVVINATDSTITAQGEGTYVRTAMVIDSTGDVVVNGGNFVAKNEKGSATGISLEATTGNNLTLNGTTINAQGNKSYSNGSTAIFAQKGNLLQGFDGDATDNITLADSNIINGGIETIVTAGNKTGIHTVNLNIKDGSVIGAANNKQTIYASASAQGAGSATQNLNLSVADSTIYSDVLALSESENSASTTTNVNMNVARSYWEGNAYTFNSGDKAGSDLDINLSDSSVWKGKVSGAGDASVSLQNGSVWNVTGSSTVDALAVKDSTVNITKATVNTGTFASQNGTLIVDASSENTLDISGKASGDLRVYSAGSLDLINEQTAFISTGKDSTLKATGTTEGGLYQYDLTQGADGNFYFVKNTHKASNASSVIQAMAAAPANVANLQADTLSARQDAVRLSENDKGGVWIQYFGGKQKHTTAGNASYDLDVNGVMLGGDTRFMTEDGSWLAGVAMSSAKGDMTTMQSKGDTEGYSFHAYLSRQYNNGIFIDTAAQFGHYSNTADVRLMNGGGTIKADFNTNGFGAMVKGGYTWKDGNGLFIQPYAKLSALTLEGVDYQLNGVDVHSDSYNSVLGEAGTRVGYDFAVGNATVKPYLNLAALNEFSDGNKVRLGDESVNASIDGAAFRVGAGVQADITKNMGAYASLDYTKGDDIENPLQGVVGINVTW

SEQ ID NO: 833 - DNA, 762 bp, Escherichia coli
atgcgtttcgttcttttctgtccctcaggaattgtaccagcgcagttcgcagctctatcaaccggttctgtcggcaatgttacctgcatcagaacagaagaggagttacgcaataaattgcggcacaggccacagagtgtcgtgatatcggcagggcgacctgccgaatgcgctgaaatgtggttccgattttatcgggatcactcattcgtggtggtgttgtgcgtcgcgcccttttttctgccaccggatgtgagtatttctggcgttctcaaaaacctgaggttactgaaaccaggaatgtcagtagagcgtgtcatcagtattgcaaatgcctctggtgggttttcagggctgaagcatgcagaaattttgccagttatggacagttactctgtctttatgaaagaggtgaataaccgcacaaagacaatcgtcatgtcagaacgcttcccggaaaagcaaaagaaggtgttgtcgttacttcttgccggacacagctgggaatacagtgcgcagtttctcaaaacggggataagacagatatggcttgccgagcagtcgctaaaaaagcgttggggaataccggacagcatgtcattgcgggaagccctgctgctgagcagcaataattttcacggtgatggaaatgcattggaaacaacgaatgccatgacattgcgtgaaaacggaaataccaacaggtattccgtggtggtaaatgcagggacgcaggctttatctctgcataaatataaataa

SEQ ID NO: 834 - protein, 253 aa, Escherichia coli
MRFVLFCPSGIVPAQFAALSTGSVGNVTCIRTEEELRNKLRHRPQSVVISAGRPAECAEMWFRFYRDHSFVVVLCVAPFFLPPDVSISGVLKNLRLLKPGMSVERVISIANASGGFSGLKHAEILPVMDSYSVFMKEVNNRTKTIVMSERFPEKQKKVLSLLLAGHSWEYSAQFLKTGIRQIWLAEQSLKKRWGIPDSMSLREALLLSSNNFHGDGNALETTNAMTLRENGNTNRYSVVVNAGTQALSLHKYK

SEQ ID NO: 835 - DNA, 795 bp, Escherichia coli
atgaagaagcctctggttattatcagtgcctgtcagttcaccaggctggcactggagtctctcatcccaacggacaggtatatcgtgcgggtgtacagcaacgtcactacagaggttgaattcgttttaaagacctcctgtggctacctgttagctgatatcccttcgcttccttcgggggagttggttcttctggcttgtctcgcccgtttgcggagtgatgccgggcaatggcaggtctgcctgaccggtgactccgactggttcgataatgctcctgctgcaagtctgtataacggcttcccacgcatcggcaccatgctgacagcgagtcgttatcagaatcaaattatccgctggttactacgtcctttgcccggcgatatgagcgatttctggctcctgactgcacgggagttgagcgtgcttaagattctgatgcagggcatgagtttcagtgagattgcccgttatgaacaacgcagttcaaagaccctgcatgcgattgccacacgggctttaatgaaacttggactgggaacactgagcgatttcaggctgctctatacgggatgcggtgacagcagagtgaaacggaatatacggctacatgcaaaatatatcggacaacattccgctcatcgactcactcagtatgtgcagaacatggtatccggaatcctttatccagagaaagttgccgttggtgaatcaataaattctgacgccatttccggaaaagtactttccggacaaagaaaaaatatatctaaaaaaagaccaggattgttatga

SEQ ID NO: 836 - protein, 264 aa, Escherichia coli
MKKPLVIISACQFTRLALESLIPTDRYIVRVYSNVTTEVEFVLKTSCGYLLADIPSLPSGELVLLACLARLRSDAGQWQVCLTGDSDWFDNAPAASLYNGFPRIGTMLTASRYQNQIIRWLLRPLPGDMSDFWLLTARELSVLKILMQGMSFSEIARYEQRSSKTLHAIATRALMKLGLGTLSDFRLLYTGCGDSRVKRNIRLHAKYIGQHSAHRLTQYVQNMVSGILYPEKVAVGESINSDAISGKVLSGQRKNISKKRPGLL

SEQ ID NO: 837 - DNA, 549 bp, Escherichia coli
ctcacacaggatgaagtctacaggctgatggatgcagcccagagcatgtcctttcctgaaagaaatcgctgtctgattatgatggctttcattcacggttttagggccagtgaacttcttgatttacgtttatccgatattgatgcatctggaaaacaacttaatattcggcgtattaaaaatggtttctcgacaacacatcctcttcttcctgatgaatataatttgatcaagttgtggcttaagcagaggaagttaattgaaaacggagttgaaggagactggctttttctctcccggaaacgccgccctatcagcagacaacattttttttctatcattcgtgaggctggaaaacgtgcaggattagctgtaaaagcacatcctcatatgttacgtcatgcctgtggttttgctctggctgacaatggtgtcgatacccgactacttcaggattacctgggtcatcgaaatattcagcatactgtcagatacacagccagtaatgctgctcgttttaaaggggtgtggaaaaaaaagcctcgttaa

SEQ ID NO: 838 - protein, 182 aa, Escherichia coli
LTQDEVYRLMDAAQSMSFPERNRCLIMMAFIHGFRASELLDLRLSDIDASGKQLNIRRIKNGFSTTHPLLPDEYNLIKLWLKQRKLIENGVEGDWLFLSRKRRPISRQHFFSIIREAGKRAGLAVKAHPHMLRHACGFALADNGVDTRLLQDYLGHRNIQHTVRYTASNAARFKGVWKKKPR

SEQ ID NO: 839 - DNA, 1689 bp, Escherichia coli
ttgcaatttgactacatcattattggtgccggctcagccggcaacgttctcgctacccgtctgactgaagatccgaacacaaccgtgctgctgcttgaagcaggcggcccggactatcgctttgacttccgcacccagatgcccgccgcgctggcgttcccgctacagggcaaacgctacaactgggcctatgagacggaacccgaaccgtttatgaacaaccgccgcatggagtgcggacgcggcaaaggtctgggcggttcatcgctgatcaacggtatgtgctacatccgtggcaatgcgctggatctcgataactgggcacaagaacctggtctggagaactggagttatctcgactgcctgccctactatcgcaaggccgagactcgcgatgtgggcgagaacgactaccacggcggtgatggcccggtgagcgtcaccacctccaaacccggcgtcaatccgctgtttgaagcgatgattgaagcgggcgtgcaggcgggctacccgcgcacggacgatctcaacggctatcagcaggaaggttttggcccgatggatcgcaccgtcacgccgcatggccgtcgcgccagcaccgcgcgtggctatctcgatcaggccaaatcgcgccctaacctgaccattcgtactcacgccatgaccgatcacatcttttttgacggcaaacgcgcggtgggcgtcgagtggctggaaggcgacagcaccattccgacccgcgcggcggcgaataaagaagtgctgttatgtgcaggcgcgattgcttcaccgcagatcctgcaacgctccggcgtcggcaacgctgaactgctggcggagtttgatattccgctggtgcatgaattacctggcgtcggcgaaaatcttcaggatcacctggagatgtatctgcaatatgagtgcaaagaaccggtttccctctaccctgccctgcagtggtggaatcagccgaaaatcggtgcggagtggctgtttggcggcaccggcgttggtgccagcaaccactttgaagcaggcggatttattcgcagccgtgaggaatttgcgtggccgaatattcagtaccatttcctgccagtggcgattaactataacggctcgaacgcagtgaaagagcacggcttccagtgccacgtcggatcgatgcgctcgccaagccgtgggcatgtgcggattaaatcccgcgacccgcaccagcatccggcgattctgtttaactacatgtcgcacgagcaggactggcaggagttccgcgacgcaattcgcatcacccgggagatcatgcatcaaccggcgctggatcagtatcgtggccgcgaaatcagccccggtgtcgaatgccagacggatgagcagctcgatgagttcgtgcgtaaccacgccgaaaccgccttccacccgtgcggtacctgcaaaatgggttatgacgagatggcagtggttgacgccgaaggccgcgtacacgggctggaaggcctgcgcgtggtggatgcgtcaattatgccgcagattatcaccggcaatttgaacgccacgacgattatgattggcgagaaaatggcggatatgattcgcgggaaggatgcgttgccgaggagcacggcaagatattttgtggcaaatgggatgccggtgagagcgaaaaaaatgagtcgtgatgtgaactga

SEQ ID NO: 840 - protein, 562 aa, Escherichia coli
MQFDYIIIGAGSAGNVLATRLTEDPNTTVLLLEAGGPDYRFDFRTQMPAALAFPLQGKRYNWAYETEPEPFMNNRRMECGRGKGLGGSSLINGMCYIRGNALDLDNWAQEPGLENWSYLDCLPYYRKAETRDVGENDYHGGDGPVSVTTSKPGVNPLFEAMIEAGVQAGYPRTDDLNGYQQEGFGPMDRTVTPHGRRASTARGYLDQAKSRPNLTIRTHAMTDHIFFDGKRAVGVEWLEGDSTIPTRAAANKEVLLCAGAIASPQILQRSGVGNAELLAEFDIPLVHELPGVGENLQDHLEMYLQYECKEPVSLYPALQWWNQPKIGAEWLFGGTGVGASNHFEAGGFIRSREEFAWPNIQYHFLPVAINYNGSNAVKEHGFQCHVGSMRSPSRGHVRIKSRDPHQHPAILFNYMSHEQDWQEFRDAIRITREIMHQPALDQYRGREISPGVECQTDEQLDEFVRNHAETAFHPCGTCKMGYDEMAVVDAEGRVHGLEGLRVVDASIMPQIITGNLNATTIMIGEKMADMIRGKDALPRSTARYFVANGMPVRAKKMSRDVN

SEQ ID NO: 841 - DNA, 1473 bp, Escherichia coli
atgtcccgaatggcagaacagcagctttatatacatggtggttatacctccgccaccagcggtcgcaccttcgagaccattaacccggccaacggtaacgtgctggcgaccgtgcaggccgccgggcgtgaggatgtcgatcgcgccgtgaagagtgcccaacaagggcaaaaaatctgggcggcgatgaccgctatggaacgctcgcgtattctgcgtcgggccgttgatattctgcgtgaacgcaatgacgaactcgcaaaactggaaaccctcgacaccggaaaagcatattcggaaacctcaaccgtcgatatcgttaccggtgcggacgtgctggagtactatgccgggctgatcccggcgctggaaggcagccagatcccgttgcgtgagacgtcatttgtttatacccgccgcgaaccgctgggtgtggtggcggggattggcgcatggaactacccgatccagattgctttgtggaaatccgcccccgcgctggcggcgggtaacgcgatgatcttcaaaccgagcgaagtcaccccgcttaccgcgttaaagctggctgaaatttacagcgaagcgggcctgccggacggtgtatttaacgtgttgccgggcgtgggcgcggagaccgggcaatatctgaccgatcatccgggcattgccaaagtgtcatttaccgggggtgtcgccagcggcaaaaaagtgatggctaactcggcagcttcctccctgaaagaagtgaccatggagctgggcggtaaatcaccgctgatcgttttcgacgatgcggatctcgatctcgccgccgatatcaccatgatggcgaatttcttcagctccggtcaggtgtgtaccaacggcactcgcgtcttcgttccgacgaaatgcaaagccgcatttgaacaaaagattctggcgcgcgttgagcgcattcgcgcgggcgacgttttcgatccgcaaactaacttcggcccgctggtcagcttcccgcatcgcgataacgtgctgcgctatatcgccaaaggcatagaggaaggcgcgcgcgtactgtgcggcggcgatgtactgaagggggatagcttcgataacggcgcatgggttgcaccgaccgtgttcaccgattgcagcgacgatatgaccattgtgcgagaagagattttcgggccggtgatgtccattctgacctacgagtcggaagacgaagtcattcgccgcgctaacgataccgactacggtctggcggcgggtatcgtgacggcggacctgaacctcgcgcatcgcgtcattcatcagctggaagcgggtatttgctggatcaacacctggggcgaatccccggcagagatgcccgttggcggctacaaacactccggcattggtcgcgagaacggagtgatgacgctccagagttacacccaggtgaagtccatccaggttgagatggctaaattccagtccatattctaa

SEQ ID NO: 842 - protein, 490 aa, Escherichia coli
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTDHPGIAKVSFTGGVASGKKVMANSAASSLKEVTMELGGKSPLIVFDDADLDLAADITMMANFFSSGQVCTNGTRVFVPTKCKAAFEQKILARVERIRAGDVFDPQTNFGPLVSFPHRDNVLRYIAKGIEEGARVLCGGDVLKGDSFDNGAWVAPTVFTDCSDDMTIVREEIFGPVMSILTYESEDEVIRRANDTDYGLAAGIVTADLNLAHRVIHQLEAGICWINTWGESPAEMPVGGYKHSGIGRENGVMTLQSYTQVKSIQVEMAKFQSIF

SEQ ID NO: 843 - DNA, 588 bp, Escherichia coli
atgcccaaattggggatgcagtcgatccggcgcagacaactgatcgacgccacgctggaagcaataaatgaagtgggcatgcacgatgcaacgatcgcgcagatcgcccgccgtgcaggcgtttctacggggatcatcagccactatttcagggacaaaaatggtctgctggaagcaaccatgcgcgatatcaccagtcagctgcgtgacgcggttttgaatcgattacatgcacttccgcagggcagtgcagagctgcgattacaggcgattgttggcggaaacttcgatgaaacccaggtgagcagtgcggcgatgaaagcctggctggccttctgggccagcagtatgcatcagccgatgctctatcgcttgcagcaggtcagtagccgccgcttattgtcgaatctggtgagcgaatttcgccgcgagttaccgcgccaacaggcacaggaagcgggctacggccttgccgcgctaattgacggattatggctgcgcgcggcactgagcggcaaagcgctggataaacctctcgcacactcgctgacccgtcactttattactcagcatttacccaccgattaa

SEQ ID NO: 844 - protein, 195 aa, Escherichia coli
MPKLGMQSIRRRQLIDATLEAINEVGMHDATIAQIARRAGVSTGIISHYFRDKNGLLEATMRDITSQLRDAVLNRLHALPQGSAELRLQAIVGGNFDETQVSSAAMKAWLAFWASSMHQPMLYRLQQVSSRRLLSNLVSEFRRELPRQQAQEAGYGLAALIDGLWLRAALSGKALDKPLAHSLTRHFITQHLPTD

SEQ ID NO: 845 - DNA, 2034 bp, Escherichia coli
atgacagacctttcacacagcagggaaaaggacaaaatcaatccggtggtgttttacacttccgccggactgattttgttgttttccctgacaacgatcctgtttcgcgacttctcggccctgtggattggccgcacgctggactgggtctctaaaaccttcggttggtactatctgctggcggcaacgctctatattgtctttgtagtctgtatcgcttgttcgcgttttggttcggtgaagctcgggccagaacaatcaaaaccggaattcagtctgctgagttgggcggcgatgctgtttgctgccgggatcggtatcgacctgatgttcttctccgtagccgaaccggtaacgcagtatatgcagccgccggaaggcgcgggacagacgattgaggccgcgcgtcaggcgatggtctggacgctgtttcactacggcttaaccggctggtcgatgtatgcgctgatgggcatggcgctcggatactttagctatcgttataatttgccgctcactatccgctcggcgctgtacccgatcttcggtaaacggattaacgggccgataggtcactcagtggatattgctgcggtgatcggcaccatcttcggtattgccactacgctcggtatcggtgtggtacagcttaactatggcttgagcgtgctgtttgatattcccgattcgatggcggcgaaagcggcactgatcgccttgtcggtgatcatcgccactatctcggtgacatccggtgtcgataagggcattcgcgtgttatcggaactcaacgttgcgctggcgctgggattgatcctgttcgtgttgtttatgggcgacacctcgttcctgcttaatgcactggtgctgaatgttggcgactatgtgaatcgctttatgggcatgacgctcaacagttttgccttcgaccgtccggttgagtggatgaataactggacgctcttcttctgggcatggtgggtggcatggtcgccgtttgtcggcttgttcctggcgcgtatctcgcgtgggcgtaccattcgccagttcgtgctgggcacgttgattattccgtttaccttcacgctgttatggctctcggtattcggcaatagcgcgctgtatgaaatcatccacggcggcgctgcatttgccgaggaagcgatggtccatccggagcgcggcttctacagcctgctggcgcagtatccggcgtttacctttagcgcctccgtcgccaccattactggcctgctgttttatgtgacctcggcggactccggtgcgttggtgctggggaatttcacctcgcagcttaaagatatcaacagcgacgcacccggctggctgcgcgtcttctggtcggtggcgattggcctgctgacgctaggcatgctgatgaccaacgggatatccgcgctgcaaaacaccacggtgattatgggcctgccgttcagctttgtgatcttcttcgtgatggcggggttgtataaatctctgaaggtagaagattaccgccgtgaaagtgccaaccgcgataccgcgccgcgaccgctggggcttcaggatcgcctgagctggaaaaaacgtctctcgcgcctgatgaattatccgggcacgcgttacactaaacagatgatggagacggtctgttatccggcaatggaagaagtggcgcaggaactgcggttgcgcggcgcgtacgtggagctaaaaaacctgccgccggaagagggacaacagttggggcatctggatttgttggtgcatatgggcgaagagcagaactttgtctatcagatttggccgcagcaatattcagtgccgggctttacctaccgcgcacgtagcgggaaatcgacctactaccggctggaaaccttcctgttagaaggcagccagggcaacgacctgatggactacagcaaagagcaggtgatcaccgatattctcgaccagtacgagcggcaccttaactttatccatctccatcgtgaagcgccgggccatagcgtgatgttcccggactcgtga

SEQ ID NO: 846 - protein, 677 aa, Escherichia coli
MTDLSHSREKDKINPVVFYTSAGLILLFSLTTILFRDFSALWIGRTLDWVSKTFGWYYLLAATLYIVFVVCIACSRFGSVKLGPEQSKPEFSLLSWAAMLFAAGIGIDLMFFSVAEPVTQYMQPPEGAGQTIEAARQAMVWTLFHYGLTGWSMYALMGMALGYFSYRYNLPLTIRSALYPIFGKRINGPIGHSVDIAAVIGTIFGIATTLGIGVVQLNYGLSVLFDIPDSMAAKAALIALSVIIATISVTSGVDKGIRVLSELNVALALGLILFVLFMGDTSFLLNALVLNVGDYVNRFMGMTLNSFAFDRPVEWMNNWTLFFWAWWVAWSPFVGLFLARISRGRTIRQFVLGTLIIPFTFTLLWLSVFGNSALYEIIHGGAAFAEEAMVHPERGFYSLLAQYPAFTFSASVATITGLLFYVTSADSGALVLGNFTSQLKDINSDAPGWLRVFWSVAIGLLTLGMLMTNGISALQNTTVIMGLPFSFVIFFVMAGLYKSLKVEDYRRESANRDTAPRPLGLQDRLSWKKRLSRLMNYPGTRYTKQMMETVCYPAMEEVAQELRLRGAYVELKNLPPEEGQQLGHLDLLVHMGEEQNFVYQIWPQQYSVPGFTYRARSGKSTYYRLETFLLEGSQGNDLMDYSKEQVITDILDQYERHLNFIHLHREAPGHSVMFPDS

SEQ ID NO: 847 - DNA, 1089 bp, Escherichia coli
atgaattcatgtgattttcgtgtttttctgcaagagttcggtacaacggttcatttgtcattgcctggtagcgtatccgagaaagaacgactgctactcaagctgctgatgcagggaatgtctgtaacagaaatatcacagtacagaaatcgcagtgcaaagaccatttcacatcaaaagaaacagctctttgagaaactggggattcagagcgatattactttctggcgggatattttctttcagtacaatccggagatcatatccgccacgggtaataatagtcacaaatatattaatgataatcactatcaccatatcgtcacgcctgaagccatcagtctggcgttggaaaaccacgagtttaaaccgtggatccaaccggttttctgcgcgcagactggggtactgacgggctgtgaagtgcttgtccgctgggaacatccacaaacgggaatgatcccaccggatcagtttattcctctggcggagtcatccggtcttattgtcataatgactcgccagctgatgaaacagactgcggatattctgatgccggtaaaacatttgctgccggacaatttccatattggtatcaacgtctcggcgggctgttttttggctgcgggatttgaaaaagagtgtctgaacctggttaagaaattaggtaacgataaaatcaagctggttcttgagctgacggaacgtaatcctattccggtaacgccagaagccagagcgatatttgacagccttcatcagcacaatattacttttgcgctggatgactttggtacgggttatgcgacctatcgttacttgcaggcgttcccggtcgattttattaaaattgacaagtcgtttgtgcaaatggcgagtgtcgatgaaatctccggtcatattgtggacaatattgtcgaactggcgcgtaagcctggtctgagtatcgtggcggaaggggtagaaacccaggagcaggcggatttaatgatcggtaaaggcgttcactttttacagggctatttgtactctccgccagtaccgggtaataaatttatctctgaatgggtaatgaaagcaggtggttga

SEQ ID NO: 848 - protein, 362 aa, Escherichia coli
MNSCDFRVFLQEFGTTVHLSLPGSVSEKERLLLKLLMQGMSVTEISQYRNRSAKTISHQKKQLFEKLGIQSDITFWRDIFFQYNPEIISATGNNSHKYINDNHYHHIVTPEAISLALENHEFKPWIQPVFCAQTGVLTGCEVLVRWEHPQTGMIPPDQFIPLAESSGLIVIMTRQLMKQTADILMPVKHLLPDNFHIGINVSAGCFLAAGFEKECLNLVKKLGNDKIKLVLELTERNPIPVTPEARAIFDSLHQHNITFALDDFGTGYATYRYLQAFPVDFIKIDKSFVQMASVDEISGHIVDNIVELARKPGLSIVAEGVETQEQADLMIGKGVHFLQGYLYSPPVPGNKFISEWVMKAGG

SEQ ID NO: 849 - DNA, 933 bp, Escherichia coli
atgaactcaatttttaccgaagagaatctgttggcatttactaccgctgcgcgttttggcagcttcagtaaagccgcagaagagttgggtttaaccacttccgccattagctacaccattaaacgtatggaaacagggctggatgtggtgctgttcactcgcagtacccgcagcattgagttaacggagtccgggcgttattttttccgcaaagctaccgacctgctgaatgattttcacgccattaaacgcagtatcgatactatttcgcagggcatagaagcgcgtgtgcgcatttgtattaatcagctgctttatacgcccaaacacaccgcgcgcttattacaggtgctgaaaaagcagtttcctacctgccagattaccgtgacgaccgaagtgtataacggcgtctgggatgcgattattaataatcaggcaaatatcgccatcggcgcgcccgacacgctgctggacggcggcggcattgattacacggagattggcgcgattcgctgggcttttgccatcgccccggatcacccattagcctttgtgccggagccgatcgccgaaagccagctgcgtctctaccctaatatcatggtggaggacaccgcgcatacgattaataaaaaagtgggctggttgctgcatgggcaggagtcaattctggtgccagatttcaacaccaaatgtcagtgccagattttaggtgaaggaattggttttttgccggattacatggtccgtgaggcgatggcgcaatccttgctggttacccgacaaatccataacccgcgccaggattcacgcatgttactcgcaacccagcactctgccaccggtcaggtgacgcagtggattaaaaaacaatttgcgccaaatggcatattaacggggatctatcaggatttactgcatcgggagaattaa

SEQ ID NO: 850 - protein, 310 aa, Escherichia coli
MNSIFTEENLLAFTTAARFGSFSKAAEELGLTTSAISYTIKRMETGLDVVLFTRSTRSIELTESGRYFFRKATDLLNDFHAIKRSIDTISQGIEARVRICINQLLYTPKHTARLLQVLKKQFPTCQITVTTEVYNGVWDAIINNQANIAIGAPDTLLDGGGIDYTEIGAIRWAFAIAPDHPLAFVPEPIAESQLRLYPNIMVEDTAHTINKKVGWLLHGQESILVPDFNTKCQCQILGEGIGFLPDYMVREAMAQSLLVTRQIHNPRQDSRMLLATQHSATGQVTQWIKKQFAPNGILTGIYQDLLHREN

SEQ ID NO: 851 - DNA, 498 bp, Escherichia coli
atgaacggactcacggcaacgggtgtcaccgtcggtatttgtgcagggctttggcagttagtgtcttcacatgtcgggctctctcagggatgggaattattaggaaccattggcttcgtcgccttttgcagtttttatgccgcaggcggcggtaaatcggggtttatcaaaagcctggcggttaattattccgggatggtgtgggcgtttttcgccgcgctggctgccggttggctggccccggtgagtggactgtccgcgttctgggcgagcgtgattacgactgtacccttctcggcggtggtggtctggcaagggcgtttctggttactgtcttttattcccggaggctttctcggcatgacgctattttttgccagcgggatgaactggacggtgacattactgggttttctggcgggtaactgcgtggggataatttcagaatacggcggacaaaaattaagcgaagcgacgaccaaaagcgacgggtattaa

SEQ ID NO: 852 - protein, 165 aa, Escherichia coli
MNGLTATGVTVGICAGLWQLVSSHVGLSQGWELLGTIGFVAFCSFYAAGGGKSGFIKSLAVNYSGMVWAFFAALAAGWLAPVSGLSAFWASVITTVPFSAVVVWQGRFWLLSFIPGGFLGMTLFFASGMNWTVTLLGFLAGNCVGIISEYGGQKLSEATTKSDGY

SEQ ID NO: 853 - DNA, 606 bp, Escherichia coli
atgactataaaaaatctacctgcagactatttattggctgcgcaacagggggatatcgataaagtaaaaatctgccttgcgctgggtgtcgatattaatacctgcgatcgtcaggggaaaacggcaattacgctggcaagtttatatcagcaatatgcttgcgttcaggcattaattgacgccggagcgaatattaataaacaagatcatacctgtttaaatccttttttaattagctgtctgaacgatgatttaacgctactacgaattattttaccggctaaacccgatcttaattgcgtaacccgttttggcggtgtcggcctgacgcctgcctgtgaaaaaggccatttaagtattgtaaaagagcttttggcgcatacggagattaacgttaaccagaccaaccatgttggctggacgccgctactggaagcgattgtgcttaatgatggcgggattaaacagcaggcgattgtccagttattactggaacacggtgccagcccgcatctgacggataaatatggcaaaacaccgctggaactggcgcgagaacggggctttgaagagattgcgcagttactgattgccgcaggcgcataa

SEQ ID NO: 854 - protein, 201 aa, Escherichia coli
MTIKNLPADYLLAAQQGDIDKVKICLALGVDINTCDRQGKTAITLASLYQQYACVQALIDAGANINKQDHTCLNPFLISCLNDDLTLLRIILPAKPDLNCVTRFGGVGLTPACEKGHLSIVKELLAHTEINVNQTNHVGWTPLLEAIVLNDGGIKQQAIVQLLLEHGASPHLTDKYGKTPLELARERGFEEIAQLLIAAGA

SEQ ID NO: 855 - DNA, 864 bp, Escherichia coli
gtgtgggcgctaactgcggatgctgattttctggcgcagcgggggcaaggacaggttgaacaggtctttgccagagcggtaaatatcgcactcccggctcgccagcagttgctgacgctgctttgtgaagagtacgacaatgcgccaaacagttgtcggttggcactcactcactttaatggtctgttccggcatggtgataaggttcagtttgacgatcaaggcattacggttggtcaacatcttcatatagagatgagtcattgccagcgttggctgtccccaaccttgcaaatgaccgctctgaattttcaccttatcgcctggcaacagtggcacgacattattcatcagcacctgggggaaaatgaaaccctgtttaattatcgcggcgataatccgttttatcaggcgttaaataaagaactacatattaaacgacgggcagttattcaggccgtaaacgataaacaaaatatcgccgtagcggtcgccagtatgatgggcttagggattggccttacgccatcagccgacgattatttaacaggtctggcgcttattttatttcttcccggacatccggcggaaaaatacaaagaggaattttatctcggtctgcaacgcggcagaaataataccacgttattaagtgccatcacgctggaagccgcattacaacaacgctgccgggaaaatattcatcgttttattcacaacattatttatgacatccctgggaacgcaactcaggcaatagaaaaaattaaacatattggctccagttccggctgcgacatgctgtatggcatggccgatggttgtgcgctgagtcaaacctacggagggaattatgtcagttaa

SEQ ID NO: 856 - protein, 287 aa, Escherichia coli
MWALTADADFLAQRGQGQVEQVFARAVNIALPARQQLLTLLCEEYDNAPNSCRLALTHFNGLFRHGDKVQFDDQGITVGQHLHIEMSHCQRWLSPTLQMTALNFHLIAWQQWHDIIHQHLGENETLFNYRGDNPFYQALNKELHIKRRAVIQAVNDKQNIAVAVASMMGLGIGLTPSADDYLTGLALILFLPGHPAEKYKEEFYLGLQRGRNNTTLLSAITLEAALQQRCRENIHRFIHNIIYDIPGNATQAIEKIKHIGSSSGCDMLYGMADGCALSQTYGGNYVS

SEQ ID NO: 857 - DNA, 1548 bp, Escherichia coli
atgtcagttaaaatagtcattaaaccgaatacctattttgattctgtctcgctgatgtctatctccacgcgtgcaaataaactcgacggcgtcgagcaggcatttgtggcgatggcgaccgaaatgaacaaaggcgtgttgaagaatttaggactgctgacgccggagctggagcaggcgaaaaacggcgacctgatgattgtcatcaatggtaaatcgggtgtggacaacgagcagttgctggcggagattgaagaactgttcaacaccaaagcgcaaagcggctcgcacgaggcgcgttacgccactattgccagcgccaaaaagcatatcccggaaagtaacctggcagtgatttcggtcaacggtctgtttgccgctcgcgaagcgcgtcaggcgctgcaaaatgacctcaacgtgatgctgttttccgataatgtctcagttgaagatgaactggcgctcaaacagttggcccatgaaaaagggctgctgatgatggggccagactgcggcacggcgattatcaacggcgcggcgctctgctttggtaacgccgtgcgtcgcggcaacatcggtattgttggcgcatctggcaccggcagccaggaattgagcgtccgtatccatgaatttggtggcggcgtttcacaactgatcggcaccggcgggcgcgacctgagcgagaaaatcggtggcctgatgatgctcgatgccatcgggatgctggaaaacgatccgcaaactgaaatcattgtgcttatctccaaaccgcctgcgcctgcggtggcccgcaaagtgctggaacgcgcacgcgcctgccgcaagccagtggtggcctgcttcctcggtcgtggcgaaacgccagtggatgagcaggggctacagtttgctcgcggcagcaaagaggcggcattgaaagcggtgatgctctccggcgtgaaacaagaacatctcgacctgcatacgcttaaccagccgttgattgcggatgtgcgtgcgcgtctgcaaccgcagcagaaatacattcgtggtctgttctgcggcggtacgctgtgtgacgaaaccctgttcgcggtgatggaaaaacatggcgatgtctacagcaatatccagcccgatcctgaattccgcctgcaagatatcaaccgcagcatcaaacacaccttcctcgactttggcgatgatgacttcaccaacggcaagccgcatccaatgattgacccgaccaaccgtatcagccgcgtgatcgaagaagcgcgcgatccagaagtggcggtgatcgtgatggattttgttctcggatttggatcgcatgaagatccggtcggttccaccatcgaggcgatcaaagaagcgaaagcgatcgccgctgccgaaggacgcgagttgatcattctcgcctatgtgctgggcaccgatctcgatacgccatcattagaacaacaaagccagatgctgcttgatgccggagtgattctggcgagcagcagcaccaataccggattgctggcgcgtgaatttatctgcaaaggggaggaagcctga

SEQ ID NO: 858 - protein, 515 aa, Escherichia coli
MSVKIVIKPNTYFDSVSLMSISTRANKLDGVEQAFVAMATEMNKGVLKNLGLLTPELEQAKNGDLMIVINGKSGVDNEQLLAEIEELFNTKAQSGSHEARYATIASAKKHIPESNLAVISVNGLFAAREARQALQNDLNVMLFSDNVSVEDELALKQLAHEKGLLMMGPDCGTAIINGAALCFGNAVRRGNIGIVGASGTGSQELSVRIHEFGGGVSQLIGTGGRDLSEKIGGLMMLDAIGMLENDPQTEIIVLISKPPAPAVARKVLERARACRKPVVACFLGRGETPVDEQGLQFARGSKEAALKAVMLSGVKQEHLDLHTLNQPLIADVRARLQPQQKYIRGLFCGGTLCDETLFAVMEKHGDVYSNIQPDPEFRLQDINRSIKHTFLDFGDDDFTNGKPHPMIDPTNRISRVIEEARDPEVAVIVMDFVLGFGSHEDPVGSTIEAIKEAKAIAAAEGRELIILAYVLGTDLDTPSLEQQSQMLLDAGVILASSSTNTGLLAREFICKGEEA

SEQ ID NO: 859 - DNA, 1419 bp, Escherichia coli
atgagccagtcactgtttagccaaccgttgaacgttattaacgtcggtatcgccatgtttagcgatgatctgaaaaagcagcatgtagaagtgacccaactcgactggacgccgccggggcagggcaatatgcaggtggtgcaggcactggacaacattgccgattcgccactggcggacaaaatcgcctccgcgaatcagcaggcgctggagcgcattatccagtcgcatccggtgctgattggttttgatcaggcgattaacgtggtgccgggcatgacggcgaaaaccattcttcacgccgggccgccggtcacctgggaaaaaatgtgcggcgcgatgaaaggcgcggtcaccggagcgctggtgtttgaaggactggcgaaagatctcgacgaggcggctgagctggcggcttccggggagatcaccttctcgccgtgccacgaacacgactgtgtgggatcgatggcgggcgtcacctcggcctcgatgtttatgcacatcgtgaaaaacaaaacctatggcaacatcgcttataccaacatgagcgagcagatggcgaagattttgcgtatgggcgctaacgaccagagcgtgatcgaccgcctcaactggatgcgcgatgtgcagggacccatgctgcgcgacgcgatgaaaattatcggcgaaatcgatctgcgcttaatgctggcgcaggcgctgcatatgggcgatgaatgccataaccgcaataacgccgggacgacgttgctgattcaggcgctgacgccagggattattcaggcgggctattccgtcgaacaacagcgggaagtgtttgagtttgtcgccagctgcgactacttctccggcccgacgtggatggcgatgtgtaaagcggcgatggatgcggcgcacggcattgaatacagcactgtggtcaccaccatggcgcgtaacggcgtcgagttcggcctgcgggtcagcggattaccggggcaatggtttaccggtccggcgcagcaggtgatcgggccgatgtttgccggttataagccggaagattcggggctggatatcggcgacagcgccatcactgaaacctacggcattggcggatttgccatggcgaccgcgcctgcaatcgtcgcgctggtgggcggtacggtggaagaggctatcgatttctcccgccagatgcgtgaaatcactctcggtgaaaaccccaacgtcaccattccgctgctcggttttatgggcgtgccgtcggcaatcgacatcacccgcgtgggcagcagcggcattctgccggtgatcaacaccgccattgcccataaagatgcgggcatcggcatgattggcgcgggcattgtgcatccacccttcgcctgcttcgagaaagccatttttggctggtgcgaacgttacggcgtctga

SEQ ID NO: 860 - protein, 472 aa, Escherichia coli
MSQSLFSQPLNVINVGIAMFSDDLKKQHVEVTQLDWTPPGQGNMQVVQALDNIADSPLADKIASANQQALERIIQSHPVLIGFDQAINVVPGMTAKTILHAGPPVTWEKMCGAMKGAVTGALVFEGLAKDLDEAAELAASGEITFSPCHEHDCVGSMAGVTSASMFMHIVKNKTYGNIAYTNMSEQMAKILRMGANDQSVIDRLNWMRDVQGPMLRDAMKIIGEIDLRLMLAQALHMGDECHNRNNAGTTLLIQALTPGIIQAGYSVEQQREVFEFVASCDYFSGPTWMAMCKAAMDAAHGIEYSTVVTTMARNGVEFGLRVSGLPGQWFTGPAQQVIGPMFAGYKPEDSGLDIGDSAITETYGIGGFAMATAPAIVALVGGTVEEAIDFSRQMREITLGENPNVTIPLLGFMGVPSAIDITRVGSSGILPVINTAIAHKDAGIGMIGAGIVHPPFACFEKAIFGWCERYGV

SEQ ID NO: 861 - DNA, 864 bp, Escherichia coli
gtgaaagccgtggccgatacggtgctggaaatgctggcttccgattacgacattgtgctgacccatggcaacgggccgcaggtcgggctggatttacgccgcgcggagattgcccacgagcgcgaagggctgcccttaacgccgctggcgaactgtgtggcggatacgcaaggtggcattggctatctgatccagcaggcgctgaacaaccgactggcgcgtcacggcgagaaaaaagccgtcaccgtggtgactcaggtagaagtggataaaaacgatccggggtttgcccatcccatcaaacccattggcgcattctttagtgaaagccagcgtgacgaactacaaaaggcaaaccctgactggcgttttgttgaagatgccggacggggctatcgccgcgtggtcgcctcgccggaaccgaaacgtattgtcgaagcacctgccattaaggcgctgatccaacaaggctttgtggtgattggcgcgggcggcggcggaattccggtagtgcgtactgacgcgggggattaccaaagcgtggacgcggttatcgacaaagatctctctaccgcgctactggctcgcgaaattcacgccgacattctggtgatcaccactggcgtcgaaaaagtgtgtattcactttggcaaaccgcagcagcaggcgctggatcgcgtagatattgccaccatgacccgctatatgcaggaagggcatttcccacctggcagcatgttgccaaaaatcatcgccagcctgacgttcctggaacaaggcggcaaagaagtgattatcaccacgccggaatgcctgcctgcggcgctacgcggcgaaacgggcacccatattattaaaacctaa

SEQ ID NO: 862 - protein, 287 aa, Escherichia coli
MKAVADTVLEMLASDYDIVLTHGNGPQVGLDLRRAEIAHEREGLPLTPLANCVADTQGGIGYLIQQALNNRLARHGEKKAVTVVTQVEVDKNDPGFAHPIKPIGAFFSESQRDELQKANPDWRFVEDAGRGYRRVVASPEPKRIVEAPAIKALIQQGFVVIGAGGGGIPVVRTDAGDYQSVDAVIDKDLSTALLAREIHADILVITTGVEKVCIHFGKPQQQALDRVDIATMTRYMQEGHFPPGSMLPKIIASLTFLEQGGKEVIITTPECLPAALRGETGTHIIKT

SEQ ID NO: 863 - DNA, 1383 bp, Escherichia coli
atgaaagaaaacaatagccgccgtgaatttctgagccagagcggtaagatggtcaccgccgccgcgctgtttggtccctcagtgccgctcgcccatgcgggggtagctggcaccctaaactgcgaagcgaacaacaccatgaaaatcactgacccgtattactatctcgataacgtgctgctggaaaccggttttgactacgaaaatggcgtggcggtgcagacccgcacggcgcgccagactgtggaaattcagaacggtaaaattgttgccctgcgcgagaacaagcagcatccggacgccacgctgccgcactatgacgctggcggtaagcttatgttgcccactactcgcgacatgcatattcatctcgacaaaaccttttacggcggaccgtggcgctcactcaatcgccctgcaggcaccaccatccaggacatgattaagctcgagcaaaaaatgctgccggaactgcaaccctacactcaggagcgggcagaaaaactgatcgatttattgcagtcgaaaggcaccaccattgcccgcagccactgcaatatcgaaccggtttccggcctgaaaaatctgcaaaatttgcaggcggtgctggcgcgacgtcaggcgggcttcgagtgtgaaatcgtcgccttcccgcagcacggtttgctgctgtcgaaatcggaacccttaatgcgcgaagcgatgcaggcgggggcgcattacgtcggcgggctggacccgaccagtgttgatggcgcgatggaaaaatccctcgacaccatgttccagattgcactggactacgacaaaggcgtcgatattcacctgcacgaaaccactccggcaggcgtagcggccatcaattatatggttgaaacagtggagaaaacgccgcaactgaagggcaagctgaccatcagccacgcctttgcgctggcaacgctcaatgagcaacaggtagatgaactggcgcaccggatggcggcgcagcaaatttctatcgcctcgacggtgccgattggcacgttgcatatgccgctcaaacaactgcacgacaaaggcgtaaaagtgatgaccggcaccgacagcgttatcgaccactggtcgccttacggcctgggcgacatgctggaaaaagccaatctctacgcgcagctctatattcgtcctaacgaacagaatttgtcccgttcgctgtttttagccactggcgatgtattgccgctcaacgaaaaaggcgagcgtgtgtggcctaaagcgcaggatgacgccagctttgtgctggtggacgcctcctgttccgccgaggcggtggcgcgtatctcgccgagaacggcgacgttccataaagggcaactggtgtgggggagtgtggcaggttga

SEQ ID NO: 864 - protein, 460 aa, Escherichia coli
MKENNSRREFLSQSGKMVTAAALFGPSVPLAHAGVAGTLNCEANNTMKITDPYYYLDNVLLETGFDYENGVAVQTRTARQTVEIQNGKIVALRENKQHPDATLPHYDAGGKLMLPTTRDMHIHLDKTFYGGPWRSLNRPAGTTIQDMIKLEQKMLPELQPYTQERAEKLIDLLQSKGTTIARSHCNIEPVSGLKNLQNLQAVLARRQAGFECEIVAFPQHGLLLSKSEPLMREAMQAGAHYVGGLDPTSVDGAMEKSLDTMFQIALDYDKGVDIHLHETTPAGVAAINYMVETVEKTPQLKGKLTISHAFALATLNEQQVDELAHRMAAQQISIASTVPIGTLHMPLKQLHDKGVKVMTGTDSVIDHWSPYGLGDMLEKANLYAQLYIRPNEQNLSRSLFLATGDVLPLNEKGERVWPKAQDDASFVLVDASCSAEAVARISPRTATFHKGQLVWGSVAG

SEQ ID NO: 865 - DNA, 441 bp, Escherichia coli
ttgtttttccgtaatcgcgaaaatattctcatgaccataaaagaaaaaatctcacaaaaatatccccatgcttccttttgtacttttggcgattcagcagcgttggccgatcacctcgcaacgttgattgcgactggtgttaaaacagcttcctgtggttcgctggcgggatgtattgaagacaacgcatttccgatgattggggagtataagattgtagaaaatagccgtggtgagcctgtctgtgttatcagagtaattggcctgcatttactgcgcttttctgatgtcaccgcggagcttgcccgtaaggaaggtgaaggtgacctcagtcttgaatattggcgtaatgaacaccgtcgttttttccaggcagaaggatgctattcacccgaaatggacgttatctttgaagaatatgcccttattgacgttgtgtag

SEQ ID NO: 866 - protein, 146 aa, Escherichia coli
MFFRNRENILMTIKEKISQKYPHASFCTFGDSAALADHLATLIATGVKTASCGSLAGCIEDNAFPMIGEYKIVENSRGEPVCVIRVIGLHLLRFSDVTAELARKEGEGDLSLEYWRNEHRRFFQAEGCYSPEMDVIFEEYALIDVV

SEQ ID NO: 867 - DNA, 987 bp, Escherichia coli
atgatgaataaacgttttgttatcaatatggtgtcttcgctgttattaggcgctgcgctaatttctgcgccgctccaggccgcggaaaaagtcgtggtgaatatctctaaagtcgatggtatgccgtggtttaatcgcatgggcgaaggtgtggttgaggcgggtaaagcctttggtgttaatgcgtcacaggtggggccttcaagtactgatgctccacaacaagttaaaattattgaggatttaatcgcccgtaaggttaatgcaattacaattgtgccaaacgatgccaacgtgctggaaccggtattcaaaaaagcgcgagatgccggaattgtggttctgaccaacgaatcccccggtcagccaagtgctaactgggatatcgaaatcattgataacgaaaaatttgccgctgaatatgttgagcatatggcgaaacgcatgggtggcaagggcggctatgtgatttacgtgggtagtttgaccgtgccgcagcataacttatgggctgacttgctggtgaaataccagaaagagcattacccggatatgcatgaagttacccgccgcatgccggttgccgagagtgtggatgactcacgtcgtactacactggacctgatgaaaacctatcctgacttgaaagcggttgtctcctttggttcaaacggtccgattggcgcgggacgtgcagtgaaagagaaacgggcgaaaaataaagtcgcagtctatggcatgatgatcccttcacaggcggcatcactgattaaaagtggtgatatcaccgaagggattacttacgatccggcctctgcaggttacgcactcgcggccgtcgccagcacgttgctgaagggtgaagagatcaaacctggattagaaatgcagaatctgggtaaggccgacgtagatatggataagcgaattatccgtttccataaggtattactggtcaacaaagacaatatcgactcactttattaa

SEQ ID NO: 868 - protein, 328 aa, Escherichia coli
MMNKRFVINMVSSLLLGAALISAPLQAAEKVVVNISKVDGMPWFNRMGEGVVEAGKAFGVNASQVGPSSTDAPQQVKIIEDLIARKVNAITIVPNDANVLEPVFKKARDAGIVVLTNESPGQPSANWDIEIIDNEKFAAEYVEHMAKRMGGKGGYVIYVGSLTVPQHNLWADLLVKYQKEHYPDMHEVTRRMPVAESVDDSRRTTLDLMKTYPDLKAVVSFGSNGPIGAGRAVKEKRAKNKVAVYGMMIPSQAASLIKSGDITEGITYDPASAGYALAAVASTLLKGEEIKPGLEMQNLGKADVDMDKRIIRFHKVLLVNKDNIDSLY

SEQ ID NO: 869 - DNA, 1485 bp, Escherichia coli
atggaaaccttcctttcccttcgtcatatcaacaaaacgtttcatgccacgcgagcgctgcgcgatgtttctctcgactttatgtcgggtgaagtgcactgtcttgccgggcaaaacggctgtggtaaatcgacgttgattaaaattatgtccggtgtttatcgcccggatgagggagcggaaattacgcttggtgggaaaaactggtcaaagctgacacccgccgcttcggtggcgcaggggattcaggtgatttatcaggacctctctttatttcctaacctgagtgtctgggagaatatcgccgtgaatcactatcaccacggtctgtttgttaaccgacgtcgtctgcgtgaggtggcgcaggcggcaatgaccagtattaacgtcacattgccactggatacgctcgtttctgagctttcaattgcccgctgtcagctggtggcaatttgccgtgcactggcgcaggacgcacggttgatcgtgatggatgaaccaaccgcttcgctgacccatcaggaagtgcaagggttattacaggtggtgcatcaattgcgggaacgcgggatctgcgtggtcttcgtcagtcatcgtctggaagaagtgatggaagtttccgaccgtatttcagtgctgaaagatggtgagctggtcgggacctttccggccgcagagatgaccacaaaacaactcggttttctgatgaccggccaggagtttgaatatcaggtgcgagagttgtggcagggaaaatccagcaccccggtgctggaggtgcgtaatttaagtcgtcatggggaatatctaaatattaacttgcgggtggaagcgggcgaagtggtatcgattgttggcctgcttggtgcggggcgcacggaattatgtctgagtctgtttggtatgacccgaccggatgctggcgagatcctcatcaacggccagctggttacactgcatagtaaccaggacgccatccgccacggtattggttatgtttcggaagatcgcatgtcgcgcggtttggtgatggcgcaatctattgaagacaacatcattagcactgtttttcacaaggtaaaagatcgcttcggctttctgagtgaagctaaagtgtgtgacctggtggacaggctaatcaaggcattgaccatcaaagtctctgatcctcatctcccggtgaatacgctttctggtggtaacgcgcagcgagtatcgatcgccaaatggctggcgattgggccacgactgttgattctcgatagcccgacagtcggtgttgatatcgccaacaaagcaggaatatacggcattatcagcgatctggcggctcatggcattgcggtattgatgatctgcgatgaaattgaagaagcgtggtatcaaagccaccggattttggtaatgcaaaaaggtcagatcacccatagcttcctgcctgacagcagttctcaggccaggattgcggaggtggtaaatggctga

SEQ ID NO: 870 - protein, 494 aa, Escherichia coli
METFLSLRHINKTFHATRALRDVSLDFMSGEVHCLAGQNGCGKSTLIKIMSGVYRPDEGAEITLGGKNWSKLTPAASVAQGIQVIYQDLSLFPNLSVWENIAVNHYHHGLFVNRRRLREVAQAAMTSINVTLPLDTLVSELSIARCQLVAICRALAQDARLIVMDEPTASLTHQEVQGLLQVVHQLRERGICVVFVSHRLEEVMEVSDRISVLKDGELVGTFPAAEMTTKQLGFLMTGQEFEYQVRELWQGKSSTPVLEVRNLSRHGEYLNINLRVEAGEVVSIVGLLGAGRTELCLSLFGMTRPDAGEILINGQLVTLHSNQDAIRHGIGYVSEDRMSRGLVMAQSIEDNIISTVFHKVKDRFGFLSEAKVCDLVDRLIKALTIKVSDPHLPVNTLSGGNAQRVSIAKWLAIGPRLLILDSPTVGVDIANKAGIYGIISDLAAHGIAVLMICDEIEEAWYQSHRILVMQKGQITHSFLPDSSSQARIAEVVNG

SEQ ID NO: 871 - DNA, 972 bp, Escherichia coli
atggctgaactgaaaaaacgccatgaattctggctggcattactgattgtggtgctgtttgttggccttgcctggcgcagcgacgagtttctgacattcggtaatttgtacgatctcgccaataactatgccatgttgactattctcgcctgtggtttgtttgtggtgttaatttccggtgggattgatatttcgtttccggcaatgaccatcattgcgcaatacggcatggtgctgctgctgcaaaaaattggtggcaactttgctgtcgcgtttgccctggcgggcggcatcggcattttacttggcttaattaacgccttactggttaatcgcctacgggtgccttctatcatcatcactatctcgacgctgaatattttttatggcctgctgttatggttgagtaaaggtgtgtggctgtacgactttccgccgtggtttgagcagggggtaatgttgttcaagtacaccgatgctgatggctatgactatggccttggtctgccgctgatcgccatgattacggtggtgctgctgacagcgtttatcatgaatttcaccagtgtagggcgcaaaatttatgcccttggcgggaaccgcgaatcagccagtcgcatcggctttagtgtgctgaaactgcaacttttcgtctatggctatatgggattgatgtctggtgctgcgggtgtagtgcagtcgtggacggtgatgactgtcgcccccgattctcttctgggttatgagctgacagtactggctgcggtggtgcttggcggcactagtttgctcggcgggcgcggcacgttaaccggtactttgctcggcgtggtgttgttggcagtgatgcaaaacgggctaaatttattgggagtctcgtcttactggcaaacattgatcaccggcatcatcatcgttgccagcattagcgccacggcgtggagtcagcatcagaaccggagtctgctatga

SEQ ID NO: 872 - protein, 323 aa, Escherichia coli
MAELKKRHEFWLALLIVVLFVGLAWRSDEFLTFGNLYDLANNYAMLTILACGLFVVLISGGIDISFPAMTIIAQYGMVLLLQKIGGNFAVAFALAGGIGILLGLINALLVNRLRVPSIIITISTLNIFYGLLLWLSKGVWLYDFPPWFEQGVMLFKYTDADGYDYGLGLPLIAMITVVLLTAFIMNFTSVGRKIYALGGNRESASRIGFSVLKLQLFVYGYMGLMSGAAGVVQSWTVMTVAPDSLLGYELTVLAAVVLGGTSLLGGRGTLTGTLLGVVLLAVMQNGLNLLGVSSYWQTLITGIIIVASISATAWSQHQNRSLL

SEQ ID NO: 873 - DNA, 957 bp, Escherichia coli
atgaaaaaatcgtggcgtaataacgttgagttttacttgatcggcctgctggtgctaactgttgccgccttcagcattactatgccggagattttctggtcgataagtaatttccagtccgtcgcttcgcaaatgcccgtgctgggcattctggcgttggctatggcggtgaccatgctttgcggtggcattaacttgtcaattatagccactgctaacgcctgttcactggtgatggcgtgggtggcgactcagtatccaccaggtattgctacggttgtcgctacgctgctggcgggcgctggcgcggcggtgataatcggtttatgtaacggcgtattgattgctggtattcgagtgtcgccaattcttgcaacacttgggatgatgacgttgctcaaaggggttaatattctggtgacaggcggtagcgccattgccaattatccctcatgggtgctgtggttgaatcatgcacagtggttcggtattccgctaccgatgtggttgtttaccgcagtggcgctggggctgtggatattgctggagaaaacgccgctcggtaaatccatttatctgattggttctaacgaacgagcaacactttactccggtattaacactcgtcgggtgctgatatgggtgtatgtcatttccgccttgctttgtgcggtagcggcatttttgatgatgtcgaaactcaactcggctaaggcctcttatggcgaatcttacttgctggtgtcaatcctcgcggcagtactcggcggggttaatccggacggcggcagcgggcggataattggtatggtgctggcgctgtttcttctgcaaattattgaaagcggcttcaatattctcggtataagcccctacctgacgatggccttatggggaacgttgctgctctgtttcattcaggctcgcggcatgttagggctggatcgggtggtttaa

SEQ ID NO: 874 - protein, 318 aa, Escherichia coli
MKKSWRNNVEFYLIGLLVLTVAAFSITMPEIFWSISNFQSVASQMPVLGILALAMAVTMLCGGINLSIIATANACSLVMAWVATQYPPGIATVVATLLAGAGAAVIIGLCNGVLIAGIRVSPILATLGMMTLLKGVNILVTGGSAIANYPSWVLWLNHAQWFGIPLPMWLFTAVALGLWILLEKTPLGKSIYLIGSNERATLYSGINTRRVLIWVYVISALLCAVAAFLMMSKLNSAKASYGESYLLVSILAAVLGGVNPDGGSGRIIGMVLALFLLQIIESGFNILGISPYLTMALWGTLLLCFIQARGMLGLDRVV

SEQ ID NO: 875 - DNA, 1050 bp, Escherichia coli
atgaagatcaaagctgttggtgcatattccgctaaacaaccgcttgaaccgatggatatcacccggcgtgaaccgggaccgcatgatgtcaaaattgaaatcgcttactgtggcgtctgccattccgatatccaccaggtccgttccgagtgggcggggacggtttatccctgcgtgccgggccatgaaattgtagggcgcgtggtagccgttggtgatcaggtagaaaaatatgcgccgggcgatctggttggtgtcggctgcattgtcgacagttgtaaacattgcgaagagtgtgaagatgggctggaaaactactgtgatcacatgaccggaacctataactcgccgacaccggatgaaccgggccatactctgggcggctactcacaacagatcgtcgttcatgagcgatatgttctgcgtattcgtcacccgcaagagcagctggcggcggtggctcctttattgtgtgcaggaatcaccacgtactcgccgctacgccactggctggccgggccgggtaaaaaagtgggcgtggtcggcatcggcggtctgggacatatggggattaaactggcccacgcgatgggggcgcatgtggtggcatttaccacttctgagtcaaaacgcgaagcggcaaaagccctgggggccgatgaagttgttaactcacgcaatgccgatgagatggtggctcatgtgaagagtttcgatttcattttgaatacagtagctgcgccacataatctcgacgattttaccaccttgctgaagcgcgatggcaccataacgctggttggtgcgcctgcgacaccgcataaatcgccggaagttttcaacctgatcatgaaacgccgcgcgatagctggttctatgattggcggcattccagaaactcaggagatgctcgatttttgcgccgaacatggcatcgtggctgatatagagatgattcgggccgatcaaattaatgaagcctatgagcgaatgctgcgtggtgatgtgaaatatcgttttgttatcgataatcgcacactaacagactga

SEQ ID NO: 876 - protein, 349 aa, Escherichia coli
MKIKAVGAYSAKQPLEPMDITRREPGPHDVKIEIAYCGVCHSDIHQVRSEWAGTVYPCVPGHEIVGRVVAVGDQVEKYAPGDLVGVGCIVDSCKHCEECEDGLENYCDHMTGTYNSPTPDEPGHTLGGYSQQIVVHERYVLRIRHPQEQLAAVAPLLCAGITTYSPLRHWLAGPGKKVGVVGIGGLGHMGIKLAHAMGAHVVAFTTSESKREAAKALGADEVVNSRNADEMVAHVKSFDFILNTVAAPHNLDDFTTLLKRDGTITLVGAPATPHKSPEVFNLIMKRRAIAGSMIGGIPETQEMLDFCAEHGIVADIEMIRADQINEAYERMLRGDVKYRFVIDNRTLTD

SEQ ID NO: 877 - DNA, 669 bp, Escherichia coli
atgaagttacttcacttatttatggatgaaatcactatggatcctttgcacgccgtttatctgaccgtaggactgttcgtgattactttttttaatccgggagccaatctctttgtggtagtacaaaccagcctggcttccggtcgacgcgcaggggtgctgaccggactgggcgtggcgctgggcgatgcgttttattccgggttgggtttgtttggtcttgcaacgctaattacgcagtgtgaggagattttttcgcttatcagaatcgtcggcggcgcttatctcttatggtttgcgtggtgtagcatgcgccgccagtcaacaccgcagatgagcacactacaacaaccgattagtgccccctggtatgtctttttccgccgtggattaattaccgatctctctaacccgcaaaccgttttattttttatcagtattttctcagtaacattaaatgccgaaacaccaacatgggcacgtttaatggcctgggcggggattgtgctcgcatcaattatctggcgagtctttcttagtcaggcgttttctttgcccgcagtgcgtcgtgcttatgggcgtatgcaacgcgttgccagtcgggttattggtgcaattattggtgtattcgcgctacgcctgatttacgaaggggtgacgcagcggtga

SEQ ID NO: 878 - protein, 222 aa, Escherichia coli
MKLLHLFMDEITMDPLHAVYLTVGLFVITFFNPGANLFVVVQTSLASGRRAGVLTGLGVALGDAFYSGLGLFGLATLITQCEEIFSLIRIVGGAYLLWFAWCSMRRQSTPQMSTLQQPISAPWYVFFRRGLITDLSNPQTVLFFISIFSVTLNAETPTWARLMAWAGIVLASIIWRVFLSQAFSLPAVRRAYGRMQRVASRVIGAIIGVFALRLIYEGVTQR

SEQ ID NO: 879 - DNA, 276 bp, Escherichia coli
atgaaaataatctctaaaatgttagtcggtgcgttagcgtttgccgttaccaatgtctatgccgcagaattaatgaccaaagcggaatttgaaaaggttgaatcgcaatatgaaaaaataggtgatatttcaaccagcaatgaaatgtcgaccgcagatgcgaaagaagatttgatcaaaaaagcggatgaaaaaggggctgatgtgttggtgctgacctctggtcaaactgacaataagattcacggcacggcaaatatttataagaagaagtaa

SEQ ID NO: 880 - protein, 91 aa, Escherichia coli
MKIISKMLVGALAFAVTNVYAAELMTKAEFEKVESQYEKIGDISTSNEMSTADAKEDLIKKADEKGADVLVLTSGQTDNKIHGTANIYKKK

SEQ ID NO: 881 - DNA, 1230 bp, Escherichia coli
gtggcgtttcaaaaaacctttaatttgcgcctcgatcaacgtagctacattaccgaggaagacgcacgcgggcagattaacgagctaaaagctaacggcaccgaagcggtggtcggtgcggggctgattaccgatctggcagaagaagccggaatgaccggaatttttatctattccgccgccaccgtgcgccaggcattcagcgatgcgctggatatgacgcgcatgtcgttacgccataacactcacgatgccacccgtaacgccctgcgtactcgttacgtgctgggcgatatgctcggtcaatcaccacagatggaacaggtgcggcagactattttgctgtatgcccgctccagtgcagcggtgttgattgagggggaaacggggacgggcaaagagctggcggcccaggcgattcatcgggaatattttgcccgccacgatgcgcgacagggcaaaaagtcgcatccgtttgttgccgtcaactgcggggcgattgccgaatcgttgctggaagcagagctgtttggctatgaggaaggggcgttcaccggctcgcgacgcggaggtcgcgccgggctgttcgaaatcgcccacggtggcacgctgtttcttgacgagataggcgaaatgccgctgccgttgcagactcggctgctgcgggtgctggaagaaaaagaggtcacccgcgtcggcgggcatcagcctgttccggtggatgtgcgagtcattagcgccactcactgcaatctggaagaagatatgcggcaagggcagtttcgccgtgatctgttttatcggctgagtattttgcgtctgcaattgccaccactgcgcgagcgggtgacggatattctgccgctggcggaaagctttttgaaagtgtctctggcagcgctctccgccccgttttctgccgcattacgccagggattacaggcaagcgaaaccgtgctggtgcactacgactggccgggcaatattcgtgaactgcgcaatatgatggagcgactggcgctgtttttaagtgtggaaccgacgccggatttaacgccgcaatttttgcagctgctactgccggagctggcgcgcgagtcagcgaaaactcccgctccacgcttgctgacaccacaacaggcactggagaaatttaaaggcgataaaacagcagcggcgaattatttaggcataagccggacgaccttctggcggcggctgaaaaactga

SEQ ID NO: 882 - protein, 409 aa, Escherichia coli
MAFQKTFNLRLDQRSYITEEDARGQINELKANGTEAVVGAGLITDLAEEAGMTGIFIYSAATVRQAFSDALDMTRMSLRHNTHDATRNALRTRYVLGDMLGQSPQMEQVRQTILLYARSSAAVLIEGETGTGKELAAQAIHREYFARHDARQGKKSHPFVAVNCGAIAESLLEAELFGYEEGAFTGSRRGGRAGLFEIAHGGTLFLDEIGEMPLPLQTRLLRVLEEKEVTRVGGHQPVPVDVRVISATHCNLEEDMRQGQFRRDLFYRLSILRLQLPPLRERVTDILPLAESFLKVSLAALSAPFSAALRQGLQASETVLVHYDWPGNIRELRNMMERLALFLSVEPTPDLTPQFLQLLLPELARESAKTPAPRLLTPQQALEKFKGDKTAAANYLGISRTTFWRRLKN

SEQ ID NO: 883 - DNA, 123 bp, Escherichia coli
atgcgtaagtttatcggtgatcatcatctattgaaatttatgccggataaagcgttcgcgctgcattcggcagttcagtttttcagccgccgccagaaggtcgtccggcttatgcctaaataa

SEQ ID NO: 884 - protein, 40 aa, Escherichia coli
MRKFIGDHHLLKFMPDKAFALHSAVQFFSRRQKVVRLMPK

SEQ ID NO: 885 - DNA, 351 bp, Escherichia coli
ttgcggtgcgctatggcacatccaccacggcttaatgacgacaaaccggttatctggacggtatcggtaacgcgcctgttcgagctgtttcgcgatatcagtctcgagtttgatcacctggcgaatatcacccctattcagcttggctttgaaaaagcggtgacctacatccgcaagaaactggcaagcgaacgctgtgacgccatcattgccgctggctctaacggcgcgtatctgaaaagccgcctgtcagtgccagttattttgattaaaccgagcggctacgatgtgttacaggcactggcaaaagccggaaaactcacctcttctatcggcgttgtcacttattag

SEQ ID NO: 886 - protein, 116 aa, Escherichia coli
MRCAMAHPPRLNDDKPVIWTVSVTRLFELFRDISLEFDHLANITPIQLGFEKAVTYIRKKLASERCDAIIAAGSNGAYLKSRLSVPVILIKPSGYDVLQALAKAGKLTSSIGVVTY

SEQ ID NO: 887 - DNA, 99 bp, Escherichia coli
atgaaacgcggtgaaacattgcctgaaacgttaactgaaacgcatttttgcggattacttcatgactttatctctaacaaattgaaattaaacatttaa

SEQ ID NO: 888 - protein, 32 aa, Escherichia coli
MKRGETLPETLTETHFCGLLHDFISNKLKLNI

SEQ ID NO: 889 - DNA, 891 bp, Escherichia coli
atgtctctacactctccaggtaaagcgtttcgcgctgcactgtctaaagaaaatccattgcagattgttggcaccattaacgccaaccatgcgctgttggcgcagcgtgccggatatcaggcaatttatctctccggcggtggcgtggcggcagggtcgctggggctgcccgatctcggtatttctactcttgatgacgtgctgacagatattcgccgtatcaccgacgtttgttcgctgccgctgctggtggatgcggatatcggttttggttcttctgcttttaacgtggcgcgcaccgtgaaatcgatgattaaagccggtgcggcaggattgcatattgaagatcaggttggtgcgaaacgctgcggtcatcgcccgaacaaagcgatcgtctcgaaagaggagatggtggatcggatccgcgcggcggtggatgcgaaaaccgatcctgattttgtgatcatggcgcgcaccgatgcgctggcggtagaggggctggacgccgcgatcgagcgtgcgcaggcctatgttgaagcgggtgccgagatgttgttcccggaggcgattaccgaactcgccatgtaccgccagtttgccgatgcggtgcaggtgccgatcctcgctaacattaccgaatttggtgccacgccgctgtttactaccgatgaattacgcagtgcccatgttgcaatggcgctgtacccgctttcagcgttccgtgccatgaaccgcgccgctgaacatgtctacaacgtcctgcgtcaggaaggcacgcagaaaagcgtcatcgacaccatgcagacccgcaacgagctgtacgaaagcatcaactactaccagtacgaagagaagctcgacgacctgtttgcccgtaaccaggcgaaataa

SEQ ID NO: 890 - protein, 296 aa, Escherichia coli
MSLHSPGKAFRAALSKENPLQIVGTINANHALLAQRAGYQAIYLSGGGVAAGSLGLPDLGISTLDDVLTDIRRITDVCSLPLLVDADIGFGSSAFNVARTVKSMIKAGAAGLHIEDQVGAKRCGHRPNKAIVSKEEMVDRIRAAVDAKTDPDFVIMARTDALAVEGLDAAIERAQAYVEAGAEMLFPEAITELAMYRQFADAVQVPILANITEFGATPLFTTDELRSAHVAMALYPLSAFRAMNRAAEHVYNVLRQEGTQKSVIDTMQTRNELYESINYYQYEEKLDDLFARNQAK

SEQ ID NO: 891 - DNA, 1170 bp, Escherichia coli
atgagcgacacaacgatcctgcaaaacagtacccatgtcattaaaccgaaaaaatcggtggcgctttctggcgttccggcgggcaatacggcgctctgcaccgtgggtaaaagtggcaatgacttgcattaccgtggctacgatattcttgatctggcggcacattgcgaatttgaagaagtggcgcatctgctgatccacggcaaactgccgacccgtgacgaacttgccgcctacaaaacgaaactgaaagccctgcgcggtttaccggctaacgtgcgtactgtgctggaagccttaccagcggcgtcgcacccgatggatgttatgcgcaccggcgtttccgcgctcggctgcacactgccggaaaaagaggggcacactgtatctggtgcgcgggatattgccgacaaactgctggcgtcacttagctcgattcttctctactggtatcactacagccataacggcgaacgcatccagccggaaactgatgacgactctatcggcggtcacttcctgcatctgctgcacggcgaaaagccgtcgccaagctgggaaaaggcgatgcatatctcgctggtgctgtacgccgaacacgagtttaacgcttccacctttaccagccgggtgattgcgggcactggctctgatatgtattccgcgattattggcgcgattggcgcactgcgcggaccgaaacacggcggggcgaatgaagtgtcgctggagatccagcaacgctacgaaacgccggacgaagccgaagcagatatccgcaagcgggtggaaaacaaagaagtggtcattggttttgggcatccggtttataccatcgccgacccgcgccaccaggtgatcaaacgcgtggcaaagcagctctcgcaggaaggcggctcgctgaagatgtacaacatcgccgatcgcctggaaacagtgatgtgggagagcaaaaagatgttccccaatctcgactggttctccgctgtttcctacaacatgatgggtgttcccaccgagatgttcacaccactgtttgttatcgcccgcgtcaccggctgggcggcgcacattatcgaacaacgtcaggacaacaaaattatccgtccttccgccaattatgttggaccggaagaccgccagtttgtcgcgctggataagcgccagtaa

SEQ ID NO: 892 - protein, 389 aa, Escherichia coli
MSDTTILQNSTHVIKPKKSVALSGVPAGNTALCTVGKSGNDLHYRGYDILDLAAHCEFEEVAHLLIHGKLPTRDELAAYKTKLKALRGLPANVRTVLEALPAASHPMDVMRTGVSALGCTLPEKEGHTVSGARDIADKLLASLSSILLYWYHYSHNGERIQPETDDDSIGGHFLHLLHGEKPSPSWEKAMHISLVLYAEHEFNASTFTSRVIAGTGSDMYSAIIGAIGALRGPKHGGANEVSLEIQQRYETPDEAEADIRKRVENKEVVIGFGHPVYTIADPRHQVIKRVAKQLSQEGGSLKMYNIADRLETVMWESKKMFPNLDWFSAVSYNMMGVPTEMFTPLFVIARVTGWAAHIIEQRQDNKIIRPSANYVGPEDRQFVALDKRQ

SEQ ID NO: 893 - DNA, 1452 bp, Escherichia coli
atgtcagctcaaatcaacaacattcgcccggaatttgatcgtgaaatcgttgatatcgtcgattacgtgatgaactacgaaatcagctccagagtagcctacgacaccgcacattactgcctgctcgacacgctcggctgcggtcttgaagctctcgaatacccagcctgtaaaaaactgctggggccaattgtccccggcaccgtcgtccccaacggcgtgcgcgtccccggaactcagttccagctcgaccccgtccaggcggcatttaacatcggcgcgatgatccgctggctcgatttcaacgatacctggctggcggcggagtgggggcatccttccgacaacctcggcggcattctggcaacggcggactggctttcgcgcaacgcgatcgccagcggcaaagcgccgttgaccatgaaacaggtgctgaccggaatgatcaaagcccatgaaattcagggctgcatcgcgctggaaaactcctttaaccgcgttggtctcgaccacgttctgttagtgaaagtggcttccaccgccgtggtcgccgaaatgctcggcctgacccgcgaggaaattctcaacgccgtttcgctggcatgggtagacggacagtcgctgcgcacttatcgtcatgcaccgaacaccggtacgcgtaaatcctgggcggcgggcgatgccacgtcccgcgcggtacgtctggcgctgatggcgaaaacgggcgaaatgggttacccgtcagctctgaccgcgccggtgtggggtttctacgacgtctcctttaaaggtgagtcgttccgcttccagcgcccgtacggttcttacgtcatggaaaatgtgctgttcaaaatctcctttccggcggagttccactcccagacggcagttgaagcagcgatgacgctctatgaacagatgcaggcagcaggcaaaacggcggcggatatcgaaaaagtgaccattcgcacccacgaagcctgtattcgcatcatcgacaaaaaagggccgctcaataacccggctgaccgcgaccactgcattcagtacatggtggcgatcccgctgctgttcgggcgcttaacggcggcagattacgaggacaacgttgcgcaagataaacgcattgacgccctgcgcgagaagatcaattgctttgaagatccggcatttactgctgactaccacgacccggaaaaacgcgccatcgccaatgccattacccttgagttcaccgacggcacgcgctttgaagaagtggtggtggagtaccccattggtcatgctcgccgccgtcaggatggcattccgaaactggtcgataaattcaaaatcaatctcgcgcgccagttcccgactcgccagcagcagcgcattctggaggtttctctcgacagaactcgcctggaacagatgccggtcaatgagtatctcgacctgtacgtcatttaa

SEQ ID NO: 894 - protein, 483 aa, Escherichia coli
MSAQINNIRPEFDREIVDIVDYVMNYEISSRVAYDTAHYCLLDTLGCGLEALEYPACKKLLGPIVPGTVVPNGVRVPGTQFQLDPVQAAFNIGAMIRWLDFNDTWLAAEWGHPSDNLGGILATADWLSRNAIASGKAPLTMKQVLTGMIKAHEIQGCIALENSFNRVGLDHVLLVKVASTAVVAEMLGLTREEILNAVSLAWVDGQSLRTYRHAPNTGTRKSWAAGDATSRAVRLALMAKTGEMGYPSALTAPVWGFYDVSFKGESFRFQRPYGSYVMENVLFKISFPAEFHSQTAVEAAMTLYEQMQAAGKTAADIEKVTIRTHEACIRIIDKKGPLNNPADRDHCIQYMVAIPLLFGRLTAADYEDNVAQDKRIDALREKINCFEDPAFTADYHDPEKRAIANAITLEFTDGTRFEEVVVEYPIGHARRRQDGIPKLVDKFKINLARQFPTRQQQRILEVSLDRTRLEQMPVNEYLDLYVI

SEQ ID NO: 895 - DNA, 1887 bp, Escherichia coli
atgtcttttagcgaattttatcagcgttcgattaacgaaccggagcagttctgggccgagcaggcccggcgtattgactggcagacgccctttacgcaaacgctcgaccacagcaacccgccgtttgcccgttggttttgtgaaggccgaaccaacttgtgtcacaacgctatcgatcgctggctggagaaacagccagaggcgctggcattgattgccgtctcttcggaaacagaggaagagcgtacctttacctttcgtcagctgcatgacgaagtgaacgcggtggcctcaatgttgcgttcattgggggtgcagcgtggcgatcgggtgctggtgtatatgccgatgattgccgaagcgcatattactctgctggcctgcgcgcgtattggcgctattcactcggtggtgtttggtggatttgcctcgcacagcgtggcggcgcgaattgatgatgctaaaccggtgctgattgtctcggctgatgccggagcgcgcggtggcaaaatcattccctataaaaaattactcgacgatgcgataagtcaggcgcagcatcagccgcgccacgttttactggtggatcgcggactggcgaaaatggcgcgcgtcagcgggcgggatgtcgatttcgcgtcgttgcgccatcaacacatcggtgcgcgggtgccggtggcgtggctggaatccaacgaaacctcctgcattctctacacctccggcacgaccggcaaacctaaaggtgtgcagcgtgatgtcggcggatatgcggtggcgctggcgacctcgatggacaccatttttggcggcaaagcgggcggcgtgttcttttgtgcttcggatatcggctgggtggtagggcattcgtatatcgtttacgcgccgctgctggcggggatggcgactatcgtttacgaaggattgccgacctggccggactgcggcgtgtggtggaaaattgtcgagaaatatcaggttagccgcatgttctcagcgccgaccgccattcgcgtgctgaaaaaattccctaccgctgaaattcgcaaacacgatctttcgtcgctggaagtgctctatctggctggagaaccgctggatgagccgaccgccagttgggtgagcaatacgctggatgtgccggtcatcgacaactactggcagaccgaatccggctggccgattatggcgattgctcgcggtctggatgacaggccgacgcgtctgggaagccccggcgtgccgatgtatggctataacgtgcagttgctcaatgaagtcaccggcgaaccgtgtggcgtcaatgagaaagggatgctggtagtggaggggccattgccgccaggctgtattcagaccatctggggcgacgacgaccgctttgtgaagacgtactggtcgctgttttcccgtccggtgtacgccacttttgactggggcatccgcgatgctgacggttatcactttattctcgggcgcactgacgatgtgattaacgttgccggacatcggctgggtacgcgtgagattgaagagagtatctccagtcatccgggcgttgccgaagtggcggtggttggggtgaaagatgcgctgaaagggcaggtggcggtggcgtttgtcattccgaaagagagcgacagtctggaagaccgtgaggtggcgcacttgcaagagaaggcaattatggcgctggtagacagccagattggcaactttggccgcccggcgcacgtctggtttgtctcgcaattgccaaaaacgcgatccggaaaaatgctgcgccgcacgatccaggcgatttgcgaaggacgcgatcctggggatctgacgaccattgatgatccggcgtcgttggatcagatccgccaggcgatggaagagtag

SEQ ID NO: 896 - protein, 628 aa, Escherichia coli
MSFSEFYQRSINEPEQFWAEQARRIDWQTPFTQTLDHSNPPFARWFCEGRTNLCHNAIDRWLEKQPEALALIAVSSETEEERTFTFRQLHDEVNAVASMLRSLGVQRGDRVLVYMPMIAEAHITLLACARIGAIHSVVFGGFASHSVAARIDDAKPVLIVSADAGARGGKIIPYKKLLDDAISQAQHQPRHVLLVDRGLAKMARVSGRDVDFASLRHQHIGARVPVAWLESNETSCILYTSGTTGKPKGVQRDVGGYAVALATSMDTIFGGKAGGVFFCASDIGWVVGHSYIVYAPLLAGMATIVYEGLPTWPDCGVWWKIVEKYQVSRMFSAPTAIRVLKKFPTAEIRKHDLSSLEVLYLAGEPLDEPTASWVSNTLDVPVIDNYWQTESGWPIMAIARGLDDRPTRLGSPGVPMYGYNVQLLNEVTGEPCGVNEKGMLVVEGPLPPGCIQTIWGDDDRFVKTYWSLFSRPVYATFDWGIRDADGYHFILGRTDDVINVAGHRLGTREIEESISSHPGVAEVAVVGVKDALKGQVAVAFVIPKESDSLEDREVAHLQEKAIMALVDSQIGNFGRPAHVWFVSQLPKTRSGKMLRRTIQAICEGRDPGDLTTIDDPASLDQIRQAMEE

SEQ ID NO: 897 - DNA, 1260 bp, Escherichia coli
gtgtcgcaagataacaactttagccaggggccagtcccgcagtcggcgcggaaaggggtattggcattgacgttcgtcatgctgggattaaccttcttttccgccagtatgtggaccggcggcactctcggaaccggtcttagctatcatgatttcttcctcgcagttctcatcggtaatcttctcctcggtatttacacttcatttcttggttacattggcgcaaaaaccggcctgaccacccatcttcttgctcgcttctcgtttggtgttaaaggctcatggttgccttcactgctgctgggcggcacccaggttggctggtttggcgttggcgtggcgatgttttctattccggtgggcaaggcaaccgggctggatattaatttgctgattgccgtctccggtttactgatgaccgtcaccgtcttctttggcatttcggcgctgacggttctttcggtgattgcggttccggctatcgcctgccttggcggttattccgtgtggctggccgttaacggcatgggcggcctggacgtattaaaagcggtcgttcccgcacaaccgttagatttcaatgtcgcgctggcgctggttgtggggtcattcatcagtgcgggtacgctcaccgctgactttgtccggtttggtcgcaatgccaaactggcggtgctggtggcgatggtggcctttttcctcggcaactcgttgatgtttattttcggtgcagcgggcgctgcggcactggggatggcggatatctctgatgtgatgattgctcagggcctgctgctgcctgcgattgtggtgctggggctgaatatctggaccaccaacgataacgcgctctatgcgtcgggtttaggtttcgccaacattaccggtatgtcgagcaaaaccctttcggtgattaacggtattatcggtacggtctgcgcattatggctgtataacaattttgtcggctggttgaccttcctttcggcagctattcctccagtgggcggcgtgatcatcgctgattatctgatgaaccgtcgccgctatgagcactttgcgaccacgcgtatgatgagtgtcaattgggtggcgattctggcggtcgcgctggggattgccgcaggccactggttaccgggaattgttccggtcaacgcggtattaggtggcgcgctgagctatctgatccttaacccgattttgaatcgtaaaacgacagcagcaatgacgcatgtggaggctaacagtgtcgaataa

SEQ ID NO: 898 - protein, 419 aa, Escherichia coli
MSQDNNFSQGPVPQSARKGVLALTFVMLGLTFFSASMWTGGTLGTGLSYHDFFLAVLIGNLLLGIYTSFLGYIGAKTGLTTHLLARFSFGVKGSWLPSLLLGGTQVGWFGVGVAMFSIPVGKATGLDINLLIAVSGLLMTVTVFFGISALTVLSVIAVPAIACLGGYSVWLAVNGMGGLDVLKAVVPAQPLDFNVALALVVGSFISAGTLTADFVRFGRNAKLAVLVAMVAFFLGNSLMFIFGAAGAAALGMADISDVMIAQGLLLPAIVVLGLNIWTTNDNALYASGLGFANITGMSSKTLSVINGIIGTVCALWLYNNFVGWLTFLSAAIPPVGGVIIADYLMNRRRYEHFATTRMMSVNWVAILAVALGIAAGHWLPGIVPVNAVLGGALSYLILNPILNRKTTAAMTHVEANSVE

SEQ ID NO: 899 - DNA, 1299 bp, Escherichia coli
atgtggaggctaacagtgtcgaataatgctttacaaacaattattaacgcccagttacccggcaaagaggggctgtggcagattcatcttcacgacggaaaaatcagcgccattgatgcgcaatccggggtgatgcccgtaactgaaaacagcctggatgccgaacaaggtttagttttaccgccgtttgtggagccgcatattcacctggacaccacgcaaaccgccggacaaccgaactggaatcagtccggcacgctgtttgaaggcattgaacgctgggccgagcgcaaagcgttattaactcatgacgatgtgaaacaacgcgcatggcaaacgctgaaatggcagattgccaacggcattcagcatgtgcgtacccatgtcgatgtctccgacgcaacgctgactgcgttgaaagcgatgctggaagtgaaacaggaagttgcgccgtggattgatctgcaaatcgtcgccttcccgcaggaagggattttgtcgtatcccaacggtgaagcgctgctggaagaggcgctacgcttaggggcagatgttgttggggcgattccgcattttgaatttacccgtgaatacggcgtggagtcgctgcataaaaccttcgccctggcgcaaaaatacgaccgtctcatcgacgttcactgtgatgagatcgatgacgagcagtcgcgctttgtcgaaaccgttgctgccctggcgcaccgtgaaggcatgggcgcgcgagtcaccgccagccatactacggcaatgcactcctataacggggcgtatacttcgcgcctgttccgtttgctgaaaatgtccggtattaactttgtcgccaacccgttggtcaatattcatctgcaaggacgtttcgatacgtatccaaaacgtcgcggcatcacgcgcgttaaagagatgctggagtccggcattaacgtctgctttggtcacgatgatgtcttcgatccgtggtatccgctgggaacggcgaatatgctgcaagtgctgcatatggggctgcatgtttgccagctgatgggctacgggcagattaacgacggcctgaatttaatcacccaccacagcgccaggacgttgaatttgcaggattacggcattgccgccggaaacagcgccaacctgattatcctgccggctgaaaatgggtttgatgcgctgcgccgtcaggttccggtacgttattcggtacgtggcggcaaggtgattgccagcacacaaccggcacaaaccaccgtatatctggagcagccagaagccatcgattacaaacggtaa

SEQ ID NO: 900 - protein, 432 aa, Escherichia coli
MWRLTVSNNALQTIINAQLPGKEGLWQIHLHDGKISAIDAQSGVMPVTENSLDAEQGLVLPPFVEPHIHLDTTQTAGQPNWNQSGTLFEGIERWAERKALLTHDDVKQRAWQTLKWQIANGIQHVRTHVDVSDATLTALKAMLEVKQEVAPWIDLQIVAFPQEGILSYPNGEALLEEALRLGADVVGAIPHFEFTREYGVESLHKTFALAQKYDRLIDVHCDEIDDEQSRFVETVAALAHREGMGARVTASHTTAMHSYNGAYTSRLFRLLKMSGINFVANPLVNIHLQGRFDTYPKRRGITRVKEMLESGINVCFGHDDVFDPWYPLGTANMLQVLHMGLHVCQLMGYGQINDGLNLITHHSARTLNLQDYGIAAGNSANLIILPAENGFDALRRQVPVRYSVRGGKVIASTQPAQTTVYLEQPEAIDYKR

SEQ ID NO: 901 - DNA, 663 bp, Escherichia coli
atgcggcgcgagcgccttatccgaccaacatatcagggcggaatgatcgcaatgaacatgtcgatgacagaaagaataaaagcaggcaagctatttaccgatatgtgcgaaggcttacctgaaaaaagacttcgtggaaaaacgttaatgtatgagtttaatcactcgcatccatcagaagttgataaaagagaaagtctgattaaagaaatgtttgccacggtaggggaaaacgcctgggtagaaccccccgtctatttctcttacggttccaacatctatataggccgcaatttttatgcaaatttcaatttaaccattgtcgacgactacacggtaacgatcggtgataacgtactgattgcacccaacgttactctttccgttacgggacacccggtacaccatgaattgagaaaaaacggagagatgtactcttttccgataacgattggcaataacgtctggatcggaagtcatgtggttattaatccaggcgtcaccatcggggataattctgttattggcgcgggtagtgtcgtcacaaaagacattccaccaaacgtcgtggctgctggcgttccttgtcgggttattcgcgaaataaacgaccgggataagcaatattatttcaaagattttaaagttgagtcttcagtttaa

SEQ ID NO: 902 - protein, 220 aa, Escherichia coli
MRRERLIRPTYQGGMIAMNMSMTERIKAGKLFTDMCEGLPEKRLRGKTLMYEFNHSHPSEVDKRESLIKEMFATVGENAWVEPPVYFSYGSNIYIGRNFYANFNLTIVDDYTVTIGDNVLIAPNVTLSVTGHPVHHELRKNGEMYSFPITIGNNVWIGSHVVINPGVTIGDNSVIGAGSVVTKDIPPNVVAAGVPCRVIREINDRDKQYYFKDFKVESSV

SEQ ID NO: 903 - DNA, 1254 bp, Escherichia coli
atgtactatttaaaaaacacaaacttttggatgttcggtttattctttttcttttacttttttatcatgggggcctacttcccgtttttcccgatttggctacatgacatcaaccatatcagcaaaagtgatacgggtattatttttgccgctatttctctgttctcgctattattccaaccgctgtttggtctgctttctgacaaactcgggctgcgcaaatacctgctgtggattattaccggcatgttagtgatgtttgcgccgttctttatttttatcttcggaccactgttacaatacaacattttagtaggatcgattgttggtggtatttatcttggcttttgttttaacgccggtgcgccagcagtagaggcatttatcgagaaagtcagccgtcgcagtaatttcgaatttggtcgcgcgcggatgtttggctgtgttggctgggcgctgtgtgcctcgattgtcggcatcatgttcaccatcaataatcagtttgttttctggctgggttctggctgtgcactcatcctcgccgttttactctttttcgccaaaacggatgcgccctcttcagccacggttgccaatgcggtaggtgccaaccattcggcatttagccttaagctggcgctggaactgttcagacagccaaaactgtggtttttgtcactgtatgttattggcgtttcctgcacctacgatgtttttgaccaacagtttgctaatttctttacttcgttttttgctaccggtgaacagggtacgcgggtatttggctacgtaacgacaatgggcgaattacttaatgcctcgattatgttctttgcgccactgatcattaatcgcatcggtgggaaaaatgccctgctgctggctggcactattatgtctgtacgtattattggctcatcgttcgccacctcagcgctggaagtggttattctgaaaacgctgcatatgtttgaagtaccgttcctgctggtgggctgctttaaatatattaccagccagtttgaagtgcgtttttcagcgacgatttatctggtctgtttctgcttctttaagcaactggcgatgatttttatgtctgtactggcgggcaatatgtatgaaagcatcggtttccagggcgcttatctggtactgggtctggtggcgctgggcttcaccttaatttccgtgttcacgcttagcggccccggcccgctttccttgctgcgtcgtcaggtgaatgaagtcgcttaa

SEQ ID NO: 904 - protein, 417 aa, Escherichia coli [sequence omitted]

SEQ ID NO: 905 - DNA, 3075 bp, Escherichia coli
atgactatgattacggattctctggccgtcgtattacaacgtcgtgactgggaaaaccctggcgttacccaacttaatcgccttgcggcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgacgccgatactgtcgtcgtcccctcaaactggcagatgcacggttacgacgcgcccatctacaccaacgtgacctatcccattacggtcaatccgccgtttgttcccgcggagaatccgacaggttgttactcgctcacatttaatattgatgaaagctggctacaggaaggccagacgcgaattatttttgatggcgttaactcggcgtttcatctgtggtgcaacgggcgctgggtcggttacggccaggacagccgtttgccgtctgaatttgacctgagcgcatttttacacgccggagaaaaccgcctcgcggtgatggtgctgcgctggagtgacggcagttatctggaagatcaggatatgtggcggatgagcggcattttccgtgacgtctcgttgctgcataaaccgaccacgcaaatcagcgatttccaagttaccactcgctttaatgatgatttcagccgcgcggtactggaggcagaagttcagatgtacggcgagctgcgcgatgaactgcgggtgacggtttctttgtggcagggtgaaacgcaggtcgccagcggcaccgcgcctttcggcggtgaaattatcgatgagcgtggcggttatgccgatcgcgtcacgctacgcctgaacgttgaaaatccggaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctacccgcgatgagcgaacgcgtaacgcggatggtgcagcgcgatcgtaatcacccgagtgtgatcatctggtcgctggggaatgaatcaggccacggcgctaatcacgacgcgctgtatcgctggatcaaatctgtcgatccttcccgcccggtacagtatgaaggcggcggagccgacaccacggccaccgatattatttgcccgatgtacgcgcgcgtggatgaagaccagcccttcccggcggtgccgaaatggtccatcaaaaaatggctttcgctgcctggagaaatgcgcccgctgatcctttgcgaatatgcccacgcgatgggtaacagtcttggcggcttcgctaaatactggcaggcgtttcgtcagtacccccgtttacagggcggcttcgtctgggactgggtggatcagtcgctgattaaatatgatgaaaacggcaacccgtggtcggcttacggcggtgattttggcgatacgccgaacgatcgccagttctgcatgaacggtctggtctttgccgaccgcacgccgcatccggcgctgacggaagcaaaacaccagcagcagtttttccagttccgtttatccgggcgaaccatcgaagtgaccagcgaatacctgttccgtcatagcgataacgagttcctgcactggatggtggcgctggatggcaagccgctggcaagcggtgaagtgcctctggatgttggcccgcaaggtaagcagttgattgaactgcctgaactgccgcagccggagagcgccggacaactctggctaacggtacgcgtagtgcaaccaaacgcgaccgcatggtcagaagccggacacatcagcgcctggcagcaatggcgtctggcggaaaacctcagcgtgacactcccctccgcgtcccacgccatccctcaactgaccaccagcggaacggatttttgcatcgagctgggtaataagcgttggcaatttaaccgccagtcaggctttctttcacagatgtggattggcgatgaaaaacaactgctgaccccgctgcgcgatcagttcacccgtgcgccgctggataacgacattggcgtaagtgaagcgacccgcattgaccctaacgcctgggtcgaacgctggaaggcggcgggccattaccaggccgaagcggcgttgttgcagtgcacggcagatacacttgccgacgcggtgctgattacgaccgcccacgcgtggcagcatcaggggaaaaccttatttatcagccggaaaacctaccggattgatgggcacggtgagatggtcatcaatgtggatgttgcggtggcaagcgatacaccgcatccggcgcggattggcctgacctgccagctggcgcaggtctcagagcgggtaaactggctcggcctggggccgcaagaaaactatcccgaccgccttactgcagcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagccaacaacaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 906 - protein, 1024 aa, Escherichia coli
MTMITDSLAVVLQRRDWENPGVTQLNRLAAHPPFASWRNSEEARTDRPSQQLRSLNGEWRFAWFPAPEAVPESWLECDLPDADTVVVPSNWQMHGYDAPIYTNVTYPITVNPPFVPAENPTGCYSLTFNIDESWLQEGQTRIIFDGVNSAFHLWCNGRWVGYGQDSRLPSEFDLSAFLHAGENRLAVMVLRWSDGSYLEDQDMWRMSGIFRDVSLLHKPTTQISDFQVTTRFNDDFSRAVLEAEVQMYGELRDELRVTVSLWQGETQVASGTAPFGGEIIDERGGYADRVTLRLNVENPELWSAEIPNLYRAVVELHTADGTLIEAEACDVGFREVRIENGLLLLNGKPLLIRGVNRHEHHPLHGQVMDEQTMVQDILLMKQNNFNAVRCSHYPNHPLWYTLCDRYGLYVVDEANIETHGMVPMNRLTDDPRWLPAMSERVTRMVQRDRNHPSVIIWSLGNESGHGANHDALYRWIKSVDPSRPVQYEGGGADTTATDIICPMYARVDEDQPFPAVPKWSIKKWLSLPGEMRPLILCEYAHAMGNSLGGFAKYWQAFRQYPRLQGGFVWDWVDQSLIKYDENGNPWSAYGGDFGDTPNDRQFCMNGLVFADRTPHPALTEAKHQQQFFQFRLSGRTIEVTSEYLFRHSDNEFLHWMVALDGKPLASGEVPLDVGPQGKQLIELPELPQPESAGQLWLTVRVVQPNATAWSEAGHISAWQQWRLAENLSVTLPSASHAIPQLTTSGTDFCIELGNKRWQFNRQSGFLSQMWIGDEKQLLTPLRDQFTRAPLDNDIGVSEATRIDPNAWVERWKAAGHYQAEAALLQCTADTLADAVLITTAHAWQHQGKTLFISRKTYRIDGHGEMVINVDVAVASDTPHPARIGLTCQLAQVSERVNWLGLGPQENYPDRLTAACFDRWDLPLSDMYTPYVFPSENGLRCGTRELNYGPHQWRGDFQFNISRYSQQQLMETSHRHLLHAEEGTWLNIDGFHMGIGGDDSWSPSVSAEFQLSAGRYHYQLVWCQK

SEQ ID NO: 907 - DNA, 1083 bp, Escherichia coli
gtgaaaccagtaacgctatacgatgtcgcagagtatgccggtgtctcttatcagaccgtttcccgcgtggtgaaccaggcctgccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgttgcggcgataaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcgctaatgttccggcgttatttcttgatgtctctgaccagactcccatcaacagtattattttctcccatgaagacggtacgcgactgggcgtggagcacctggtcgcattgggtcaccagcaaatcgcgctgttagcaggcccattaagttctgtctcggcgcgtctgcgtctggcaggctggcataaatatctcacacgcaatcaaattcagccgatagcggaacgggaaggcgactggagtgccatgtccggttttcaacaaaccatgcaaatgctaaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcgtgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccacccttccgcccaatacgcaaaccgcctctccccgcgcgttggccgattcattaatgcagctggcacgacaagtttcccgactggaaagcgggcagtga

SEQ ID NO: 908 - protein, 360 aa, Escherichia coli
MKPVTLYDVAEYAGVSYQTVSRVVNQACHVSAKTREKVEAAMAELNYIPNRVAQQLAGKQSLLIGVATSSLALHAPSQIVAAIKSRADQLGASVVVSMVERSGVEACKAAVHNLLAQRVSGLIINYPLDDQDAIAVEAACANVPALFLDVSDQTPINSIIFSHEDGTRLGVEHLVALGHQQIALLAGPLSSVSARLRLAGWHKYLTRNQIQPIAEREGDWSAMSGFQQTMQMLNEGIVPTAMLVANDQMALGAMRAITESGLRVGADISVVGYDDTEDSSCYIPPLTTIKQDFRLLGQTSVDRLLQLSQGQAVKGNQLLPVSLVKRKTTLPPNTQTASPRALADSLMQLARQVSRLESGQ

SEQ ID NO: 909 - DNA, 99 bp, Escherichia coli
gtgggttttctctcacctgtgacctggcgtcagcattttaaatctcacttcggcgtcagcctcgccgaatggcgcaaaacctttcgcggtatggcatga

SEQ ID NO: 910 - protein, 32 aa, Escherichia coli
MGFLSPVTWRQHFKSHFGVSLAEWRKTFRGMA

SEQ ID NO: 911 - DNA, 552 bp, Escherichia coli
ttggaaacaaagatggcaaaacttaccttacaagagcagttgctcaaagcgggactagtcaccagcaaaaaagcggcgaaggtggagagaacggcgaaaaaatcgcgcgttcaggcgcgtgaagctcgggctgcggtagaagaaaataaaaaggcacagcttgagcgtgataaacagcttagcgaacagcaaaaacaagcggcgttggcgaaagaatataaagcccaggtgaagcagctcattgaaatgaaccgaatcaccattgccaatggcgatattggttttaacttcactgacggcaatctgattaagaagatttttgtcgataagctcacacaggcgcagttgattaatggtcgtctggcgattgctcgcttgttggtcgataacaatagcgaaggtgaatacgccattattcccgccagcgttgccgataaaattgctcagcgtgatgccagcagtattgtgttgcacagcgcgctcagcgccgaagagcaggatgaagacgatccgtatgccgacttcaaagtgcctgatgatttgatgtggtaa

SEQ ID NO: 912 - protein, 183 aa, Escherichia coli
METKMAKLTLQEQLLKAGLVTSKKAAKVERTAKKSRVQAREARAAVEENKKAQLERDKQLSEQQKQAALAKEYKAQVKQLIEMNRITIANGDIGFNFTDGNLIKKIFVDKLTQAQLINGRLAIARLLVDNNSEGEYAIIPASVADKIAQRDASSIVLHSALSAEEQDEDDPYADFKVPDDLMW

SEQ ID NO: 913 - DNA, 834 bp, Escherichia coli
atggaactcattgaaaaacatgccagctttggcggctggcaaaatgtgtatcggcattattcccaatcactgaaatgtgaaatgaatgtcggcgtctatctcccaccaaaagccgagaatgaaaaattgccggtgttgtactggctttcaggcctgacctgcaacgagcagaatttcattactaaatcggggatgcagcgttacgcggctgagcacaacattattgttgttgcgccggacaccagtccgcgaggcagtcatgtcgcagatgctgaccgttacgatctcgggcaaggtgccgggttttacctgaacgcgacgcaagcgccgtggaatgaacattacaaaatgtatgactatatccgcaacgagctgccgaatttagtgatgcatcattttccagcaacggccagaaagtctatctcaggtcattctatgggcgggctgggcgcgctggtgctggcgttacgtaacccagatgaatatgtcagcgtctcggcgttttcgcccattgtctccccatcgcaagtaccgtggggacagcaagcctttgccgcatatcttggtgaaaataaagatgcctggttggattacgacccggtgagtcttatttcacaaggtcaacgcgttgcggaaatcatggttgatcagggattgagtgatgatttttacgcagaacagctgcggactccaaatcttgaaaagatctgccaggagatgaatatcaagacgttaatccgttatcacgagggttatgatcacagctattattttgtctccagttttattggcgagcatattgcgtaccacgccaataaactgaatatgcgttga

SEQ ID NO: 914 - protein, 277 aa, Escherichia coli
MELIEKHASFGGWQNVYRHYSQSLKCEMNVGVYLPPKAENEKLPVLYWLSGLTCNEQNFITKSGMQRYAAEHNIIVVAPDTSPRGSHVADADRYDLGQGAGFYLNATQAPWNEHYKMYDYIRNELPNLVMHHFPATARKSISGHSMGGLGALVLALRNPDEYVSVSAFSPIVSPSQVPWGQQAFAAYLGENKDAWLDYDPVSLISQGQRVAEIMVDQGLSDDFYAEQLRTPNLEKICQEMNIKTLIRYHEGYDHSYYFVSSFIGEHIAYHANKLNMR

SEQ ID NO: 915 - DNA, 1110 bp, Escherichia coli
atgaaatcacgtgctgccgttgcatttgctcccggtaaaccgctggaaatcgttgaaattgacgttgcaccaccgaaaaaaggtgaagtgctgattaaagtcacccataccggtgtttgccataccgacgcatttaccctctccggcgatgacccggaaggtgtcttcccggtggttctcggtcacgaaggggccggggttgttgttgaagtcggtgaaggcgtaaccagcgtcaaacctggcgaccatgtgatcccgctttacaccgcagagtgcggcgagtgtgagttctgtcgttctggcaaaaccaacctgtgtgtcgcggttcgcgaaacgcagggcaaaggcttgatgccagacggcaccacccgtttttcttacaacgggcagccgctttatcactacatgggatgctcaacattcagtgaatacaccgtggtagcggaagtgtctctggccaaaattaatccagaagcaaaccatgaacacgtctgcctgctgggctgtggcgtgaccaccggtattggcgcggtacacaacacagctaaagtccagccaggtgattctgttgccgtgtttggtcttggcgcgattggtctggcagtggttcagggcgcgcgtcaggcgaaagcgggacggattatcgctatcgataccaacccgaagaaattcgaactggcgcgtcgcttcggtgccaccgactgcattaacccgaatgactacgacaaaccgattaaagatgtcctgctggatatcaacaaatggggtatcgaccatacctttgaatgcatcggtaacgtcaacgtgatgcgtgcggcgctggaaagtgcgcaccgcggctggggtcaatcggtgatcatcggtgtcgcaggatctggtcaggaaatctccacccgtccattccagttggtcaccggtcgcgtatggaaaggttccgcgtttggcggcgtgaaaggtcgttcccagttaccgggtatggttgaagatgcgatgaaaggtgatatcgatctggaaccgtttgtcacgcataccatgagcctggatgaaattaatgacgccttcgacctgatgcatgaaggtaaatccattcgaaccgtaattcgttactga

SEQ ID NO: 916 - protein, 369 aa, Escherichia coli
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFELARRFGATDCINPNDYDKPIKDVLLDINKWGIDHTFECIGNVNVMRAALESAHRGWGQSVIIGVAGSGQEISTRPFQLVTGRVWKGSAFGGVKGRSQLPGMVEDAMKGDIDLEPFVTHTMSLDEINDAFDLMHEGKSIRTVIRY

SEQ ID NO: 917 - DNA, 195 bp, Escherichia coli
tcgctggagggtgatgccgaatgccgtgccatactccaacagatcgctgccgttcggggcgcggctaacggactgatggcagaagtgcttgaaagccatatccgggaaacgtttgaccgaaatgactgctacagccgcgaagtcagccaatccgttgacgacactattgaactggttcgtgcctatcttaaatag

SEQ ID NO: 918 - protein, 64 aa, Escherichia coli
SLEGDAECRAILQQIAAVRGAANGLMAEVLESHIRETFDRNDCYSREVSQSVDDTIELVRAYLK

SEQ ID NO: 919 - DNA, 774 bp, Escherichia coli
atgataaaacggacgttattagcggcggcaatttttagcgcattacccgtttatgccgggttaacttccattaccgcgggctacgattttaccgattattctggcgatcatggcaaccgtaatttagcgtatgctgaactggtggcgaaagttgaaaacgcaacgctgctttttaatctttcccaggggcgtcgtgattatgaaactgaacatttcaatgccactcgcggccagggtgcagtctggtacaaatggaataactggctgacaacccgaacgggtattgcctttgcggataatacgccggtctttgcccgccaggattttcgtcaggatattaacctggccctgttgccaaaaacgcttttcacgaccggttatcgctacactaaatattacgatgatgtcgaagtcgatgcctggcaaggtggcatatcactctatactggcccggtgatcaccagctatcgctatacccattatgactccagcgatgcaggtggtagttacagcaatatgatttccgtgcgtctgaatgacccgcgcggcactggttacacgcaactatggctaagccgcggaacaggtgcttacacctacgactggacgccagaaacacgctacggcagcatgaagagcatcagtttgcaacgtattcaaccgctgactgagcaacttaatctcgggttgacggcaggtaaagtgtggtacgacaccccaaccgatgattataacggtctgcaacttgcagcccatctgacctggaaattctga

SEQ ID NO: 920 - protein, 257 aa, Escherichia coli
MIKRTLLAAAIFSALPVYAGLTSITAGYDFTDYSGDHGNRNLAYAELVAKVENATLLFNLSQGRRDYETEHFNATRGQGAVWYKWNNWLTTRTGIAFADNTPVFARQDFRQDINLALLPKTLFTTGYRYTKYYDDVEVDAWQGGISLYTGPVITSYRYTHYDSSDAGGSYSNMISVRLNDPRGTGYTQLWLSRGTGAYTYDWTPETRYGSMKSISLQRIQPLTEQLNLGLTAGKVWYDTPTDDYNGLQLAAHLTWKF

SEQ ID NO: 921 - DNA, 525 bp, Escherichia coli
gtgattattgatgaaagtgccggtgaggttgttatcggcgcgaatacccgtatttgccacggtgccgttattcagggtccggtagtgattggcgcaaactgcctaataggtaattatgcgtttattcgtcctggcacaataatcagcaatggcgtaagaattggttttgccaccgaaattaaaaatgcggttattgaagcggaagccacgattggtccgcaatgctttattgccgactcggtagttgcaaaccaggcatatttgggcgcacaagtacgaaccagtaatcatcgtctggatgaacagcccgtgtctgttcgaactccagatggaattatcgctaccggatgcgataaattaggttgttatatcgggcagcgttcacgccttggcgtacaagttattattttgcctgggcgaattatttccccgaacacgcaacttggcccgcgcgtgattgtagaacgtaatttacctaccggaacttattcactccgacaagaacttatccgtacaggagattaa

SEQ ID NO: 922 - protein, 174 aa, Escherichia coli
MIIDESAGEVVIGANTRICHGAVIQGPVVIGANCLIGNYAFIRPGTIISNGVRIGFATEIKNAVIEAEATIGPQCFIADSVVANQAYLGAQVRTSNHRLDEQPVSVRTPDGIIATGCDKLGCYIGQRSRLGVQVIILPGRIISPNTQLGPRVIVERNLPTGTYSLRQELIRTGD

SEQ ID NO: 923 - DNA, 1197 bp, Escherichia coli
atgaaaacctggatctttatatgtatggccgtagcaatattgctatggtttctgagtacgttaaggcgtaagcccagccaaaagaaaggctgtattgacgccattatacctgcttataacgaaggcccgtgtctggcgcagtcactggataatctgctgcgtaacccttatttttgccgggtaatttgcgttaacgacggctccatggacaataccgaagcggtcatggcggaagtcaaacgcaaatggggcgaccgctttgttgccgtcacgcaaaaaaataccggtaaaggtggtgcgctgatgaatggcctcaattacgccacctgcgatcaggtttttttaagtgatgccgacacctatgttccgcccgatcaagacggaatgggctatatgctggcggaaattgagcgtggcgctgatgccgtaggcggcattccctctactgcgttgaaaggcgcgggtctgttaccacacatccgcgcgaccgtaaagttgccgatgattgttatgaagcgcacgctacagcagcttctgggcggcgcaccgtttatcatcagcggtgcctgcgggatgttccgtactgatgtattgcgtaagttcggtttctcggatcgtactaaagtcgaagaccttgatctcacctggacattggtggcaaacggctaccgtattcggcaggcgaatcgctgcatcgtatacccacaggaatgtaacagtccgcgtgaggagtggcgccgctggcggcgttggattgtgggctacgcggtctgtatgcgcctgcataaaagacttttatttagccgcttcggtatcttcagtatatttcctatgctgttggttgtgctttatggcgttggtatttatctcactacctggtttaatgaattcatcaccaccgggccacatggtgtggtgttggcaatgttcccgcttatctgggtcggcgtagtttgtgttattggtgcatttagcgcctggtttcatcgttgctggttgttggtgcctttagcaccgctttccgttgtgtatgtattattagcttatgccatctggattatttatggacttattgccttttttactggacgcgaacctcagcgcgacaaacccacccgctattccgcactggtggaagcgtcaaccgcttattcccacccttctgtcacaggaactgaaaaactatctgaagcttaa

SEQ ID NO: 924 - protein, 398 aa, Escherichia coli
MKTWIFICMAVAILLWFLSTLRRKPSQKKGCIDAIIPAYNEGPCLAQSLDNLLRNPYFCRVICVNDGSMDNTEAVMAEVKRKWGDRFVAVTQKNTGKGGALMNGLNYATCDQVFLSDADTYVPPDQDGMGYMLAEIERGADAVGGIPSTALKGAGLLPHIRATVKLPMIVMKRTLQQLLGGAPFIISGACGMFRTDVLRKFGFSDRTKVEDLDLTWTLVANGYRIRQANRCIVYPQECNSPREEWRRWRRWIVGYAVCMRLHKRLLFSRFGIFSIFPMLLVVLYGVGIYLTTWFNEFITTGPHGVVLAMFPLIWVGVVCVIGAFSAWFHRCWLLVPLAPLSVVYVLLAYAIWIIYGLIAFFTGREPQRDKPTRYSALVEASTAYSHPSVTGTEKLSEA

SEQ ID NO: 925 - DNA, 687 bp, Escherichia coli
atggagtgtcataaagtggataaggttttagattcagcgatcctttcttcggcaaataaaagaaagggtatccttgccattggcgcgcatcctgacgatatagaattaggctgtggcgcatcgctagctcgccttgcgcaaaaaggaatttatattgctaccgtagtgatgactaccggtaattctggcgtagatggaataatcgatcgccacgaagaatcacgcaacgctctaaagatattagggtgccaccaaactattcatcttaattttgctgacacccgcgctcatttacagctcaatgatatgatttctgccctggaaaacatcataaaaaatcaaattccctctgatgttgaaattatacgtgtatataccatgcatgatgctgaccgccatcaggatcatcttgcagtctatcaagcctcaatggttgcctgtcgcgctattccgcaaattctcggctatgaaacaccaagtacctggctttcatttatgcctcaggtttttgaatccgtgaaagaagaatatttttctcttaaactgactgcgttaaaaaaacataaaagtcagagccagcgagattatatgcgcccggagcgtctgcgtgcagttgctcaatttcgcgggcaacaggtcaatagcgatctgggtgaaggttttgttattcataaaatgattctttga

SEQ ID NO: 926 - protein, 228 aa, Escherichia coli
MECHKVDKVLDSAILSSANKRKGILAIGAHPDDIELGCGASLARLAQKGIYIATVVMTTGNSGVDGIIDRHEESRNALKILGCHQTIHLNFADTRAHLQLNDMISALENIIKNQIPSDVEIIRVYTMHDADRHQDHLAVYQASMVACRAIPQILGYETPSTWLSFMPQVFESVKEEYFSLKLTALKKHKSQSQRDYMRPERLRAVAQFRGQQVNSDLGEGFVIHKMIL

SEQ ID NO: 927 - DNA, 963 bp, Escherichia coli
atggtaatttcatcgcgtaacacatttcttgccgcactggcattcatcgcttttcaggcgcaggcggtgaacgtcaccgtggcgtatcaaacctccgccgaaccggcgaaagtggctcaggccgacaacacctttgctaaagaaagcggagcaaccgtggactggcgtaagtttgacagtggagccagcatcgtgcgggcgctggcttcgggcgatgtgcaaatcggcaacctcggttccagcccgttagcggttgcaaccagccaacaggtgccgattgaagtcttcttgctggcgtcaaaactgggtaactccgaagcgctggtggtaaagaaaactatcagtaaaccggaagacttgattggtaaacgcatcgccgtaccgtttatctccaccacccactacagcctgctggcggcgctgaaacactggggtattaaacctgggcaagttgagattgtgaacctgcagccgcccgcaattatcgccgcatggcagcggggagatattgatggtgcttatgtctgggcaccggcggttaacgccctggaaaaagatggcaaggtgctgaccgattctgaacaggtcgggcagtggggcgcgccgacactggacgtctgggtcgtgcggaaagattttgccgagaaacatccagaggtcgtgaaagcgttcgctaaaagcgccatcgatgctcagcaaccgtacattgctaacccagacgcgtggctgaaacagccggaaaacatcagcaaactggcgcggttaagcggcgtgccggaaggtgacgttccggggctggtgaagggaaatacctatctgacgccgcagcaacaaacggcagaactgaccggaccggtgaacaaagcgatcatcgacaccgcgcagtttttgaaagagcagggcaaagtcccggctgtagcgaatgattacagccagtacgttacctcgcgcttcgtgcaataa

SEQ ID NO: 928 - protein, 320 aa, Escherichia coli
MVISSRNTFLAALAFIAFQAQAVNVTVAYQTSAEPAKVAQADNTFAKESGATVDWRKFDSGASIVRALASGDVQIGNLGSSPLAVATSQQVPIEVFLLASKLGNSEALVVKKTISKPEDLIGKRIAVPFISTTHYSLLAALKHWGIKPGQVEIVNLQPPAIIAAWQRGDIDGAYVWAPAVNALEKDGKVLTDSEQVGQWGAPTLDVWVVRKDFAEKHPEVVKAFAKSAIDAQQPYIANPDAWLKQPENISKLARLSGVPEGDVPGLVKGNTYLTPQQQTAELTGPVNKAIIDTAQFLKEQGKVPAVANDYSQYVTSRFVQ

SEQ ID NO: 929 - DNA, 768 bp, Escherichia coli
atgctgcaaatttctcatctttacgccgattatggcggcaaaccggcactggaagatatcaacctgacgctggaaagcggcgagcttctggtagttctggggccgtctggctgcggcaaaactacgttgctgaatttgattgctggttttgtgccttatcagcatggcagcattcaactggcgggtaagggtattcagggaccgggagcagagcgtggcgtagtttttcagaatgaagggctgttaccgtggcgcaatgtacaggacaacgtggcgttcggcctgcaactggcaggtgtagagaaaatgcagcgactggaaatcgcacaccagatggtgaaaaaagtcgggctggaaggcgcagaaaaacgctacatctggcagctttccggtggtcaacgtcagcgggtggggattgcccgcgcgttggcggcaaatccccagctgttattactcgacgaaccgtttggtgcgctggacgccttcacccgcgaccagatgcaaactctgctgctgaaactctggcaggagacgggaaagcaggtgctgttgattacccacgatatagaagaagcggtgtttatggcgactgaactggttctgctttcacccggcccaggccgtgtgctggagcggctgccgctcaactttgctcgccgctttgttgcgggagagtcgagccgcagcatcaagtccgatccacaattcatcgccatgcgcgaatatgttttaagccgcgtatttgagcaacgggaggcgttctcatga

SEQ ID NO: 930 - protein, 255 aa, Escherichia coli
MLQISHLYADYGGKPALEDINLTLESGELLVVLGPSGCGKTTLLNLIAGFVPYQHGSIQLAGKGIQGPGAERGVVFQNEGLLPWRNVQDNVAFGLQLAGVEKMQRLEIAHQMVKKVGLEGAEKRYIWQLSGGQRQRVGIARALAANPQLLLLDEPFGALDAFTRDQMQTLLLKLWQETGKQVLLITHDIEEAVFMATELVLLSPGPGRVLERLPLNFARRFVAGESSRSIKSDPQFIAMREYVLSRVFEQREAFS

SEQ ID NO: 931 - DNA, 828 bp, Escherichia coli
atgagtgtgctcattaatgaaaaactgcattcgcatcggctgaaatggcgctggccgctctcgcgtcaggtgaccttaagcattggtacgttagcggttttgctcactgtatggtgggcagtcgcggcgctgcaactgattagcccgctgtttttgccgccaccgcaacaggtactggcaaaactgctcaccattgccgggccgcagggatttatggacgccacgctgtggcagcatctggcagccagcctgacgcgcattgtgctggcgctactcgcggcggtgttgatcggtattccggtcgggatcgccatggggctaagcccgacggtgcgcggcattctggatccgataatcgagctttatcgtccggtgccgccgctggcttatttgccgctgatggtgatctggtttggtattggcgaaacctcgaagatcttactgatctatctagcgatttttgcgccggtggcgatgtcggcgctggcgggggtgaaaagcgcgcagcaggttcgcattcgtgccgcccagtcgctgggtgccagccgtgcgcaggtgctgtggtttgtcattttgcccggcgcgctgccggaaatcctcaccggattacgcattggtctgggtgtgggctggtctacgctggtggcggcggagctgattgccgcaacgcgcggtttaggatttatggttcagtcagcgggtgaatttctcgcgactgacgtggtgctggcggggatcgcggtgattgcgattatcgcctttcttttagaactgggtctgcgcgcgttacagcgccgcctgacgccctggcatggagaagtacaatga

SEQ ID NO: 932 - protein, 275 aa, Escherichia coli
MSVLINEKLHSHRLKWRWPLSRQVTLSIGTLAVLLTVWWAVAALQLISPLFLPPPQQVLAKLLTIAGPQGFMDATLWQHLAASLTRIVLALLAAVLIGIPVGIAMGLSPTVRGILDPIIELYRPVPPLAYLPLMVIWFGIGETSKILLIYLAIFAPVAMSALAGVKSAQQVRIRAAQSLGASRAQVLWFVILPGALPEILTGLRIGLGVGWSTLVAAELIAATRGLGFMVQSAGEFLATDVVLAGIAVIAIIAFLLELGLRALQRRLTPWHGEVQ

SEQ ID NO: 933 - DNA, 852 bp, Escherichia coli
atgagtgaacgtctgagcattaccccgctggggccgtatattggcgcacaaattacgggggccgacttaacgcgcccgttaagcgataatcagtttgaacagctttaccatgcggtgctgcgccatcatgtggtgtttctgcgcgatcaagctattacgccgcagcagcaacgcgcgctggcccagcgttttggcgagctgcatattcaccctgtttaccctcatgctgaaggggttgacgagatcatcgtcctggatacccataacgataatccgccggataacgacaactggcacaccgatgtgacatttattcaaacgccacccgcaggggcgattctggcggcgaaagagttaccctcgaccggcggcgatacgctctgggccagtggtattgccgcatatgaggcgctctctgttcccttccgccagctgttgagcgggttgcgtgcggagcatgatttccgtaaatcgttcccggaatacaagtaccgcaaaaccgaggctgagcatcaacgctggcgtgaggcggtcgcgaaaaatccaccgttgctacatccggtggtgcgaacgcatccggtgaccggtaaacaggcgctgtttgtgaacgaaggttttaccacacgaattgttgatgtcagcgagaaagagagcgaagccttgttaggttttttgtttgcccatatcactaaaccggagtttcaggtgcgctggcgctggcaaccgaatgatattgcgatttgggataaccgcgtgactcagcactatgccaatgcggattacctgccacagcggcggattatgcatcgggcgacgattcttggggatattccgttttatcgggcggggtaa

SEQ ID NO: 934 - protein, 283 aa, Escherichia coli
MSERLSITPLGPYIGAQITGADLTRPLSDNQFEQLYHAVLRHHVVFLRDQAITPQQQRALAQRFGELHIHPVYPHAEGVDEIIVLDTHNDNPPDNDNWHTDVTFIQTPPAGAILAAKELPSTGGDTLWASGIAAYEALSVPFRQLLSGLRAEHDFRKSFPEYKYRKTEAEHQRWREAVAKNPPLLHPVVRTHPVTGKQALFVNEGFTTRIVDVSEKESEALLGFLFAHITKPEFQVRWRWQPNDIAIWDNRVTQHYANADYLPQRRIMHRATILGDIPFYRAG

SEQ ID NO: 935 - DNA, 1008 bp, Escherichia coli
atgctcctcgattccacaaacatcaggcagaccatgacagatttaatccaacgccctcgtcgcctgcgcaaatctcctgcgctgcgcgctatgtttgaagagacaacacttagccttaacgacctggtgttgccgatctttgttgaagaagaaattgacgactacaaagccgttgaagccatgccaggcgtgatgcgcattccagagaaacatctggcacgcgaaattgaacgcatcgccaacgccggtattcgttccgtgatgactttcggcatctctcaccataccgatgaaaccggcagcgatgcctggcgggaagatggactggtggcgcgtatgtcgcgcatctgcaagcagaccgtgccagaaatgatcgttatgtcagacacctgcttctgtgaatacacatctcacggtcactgcggtgttctgtgcgagcatggcgtcgacaacgacgcgactctggaaaatttaggcaagcaagctgtggttgcagctgctgcaggcgcagacttcatcgccccttctgccgcgatggatggtcaggtacaggcgattcgccaggcgctggacgctgcgggctttaaagatacggcgattatgtcgtattcgaccaagttcgcctcctccttttatggcccgttccgtgaagctgccggaagcgcattaaaaggcgaccgcaaaagctatcagatgaacccaatgaaccgtcgtgaggcgattcgtgagtcgctgctggatgaagcccagggcgcagactgcctgatggttaaacctgccggagcatacctcgacatcgtgcgtgagctgcgtgaacgtactgaattgccgattggcgcgtatcaggtgagcggtgagtacgcgatgattaagttcgccgcgctggcgggtgctatagatgaagagaaagtcgtgctcgaaagcttaggttcgattaagcgtgcgggtgcggatctgattttcagctactttgcgctggatttggctgagaagaagattctgcgttaa

SEQ ID NO: 936 - protein, 335 aa, Escherichia coli
MLLDSTNIRQTMTDLIQRPRRLRKSPALRAMFEETTLSLNDLVLPIFVEEEIDDYKAVEAMPGVMRIPEKHLAREIERIANAGIRSVMTFGISHHTDETGSDAWREDGLVARMSRICKQTVPEMIVMSDTCFCEYTSHGHCGVLCEHGVDNDATLENLGKQAVVAAAAGADFIAPSAAMDGQVQAIRQALDAAGFKDTAIMSYSTKFASSFYGPFREAAGSALKGDRKSYQMNPMNRREAIRESLLDEAQGADCLMVKPAGAYLDIVRELRERTELPIGAYQVSGEYAMIKFAALAGAIDEEKVVLESLGSIKRAGADLIFSYFALDLAEKKILR

SEQ ID NO: 937 - DNA, 2988 bp, Escherichia coli
atgcactcctggaaaaagaaacttgtagtatcacaattagcattggcttgcactctggctatcacctctcaggctaatgcagcaaactatgatacctgggggtatcatgacaacaccacgaccgatttagtttggccgtatgacactgacaatgatggaattgccgatgctggcggcatggacccgatgggttcagacggtaactacgtaacttacaatggttttgtttactataacaatgccaatggcgatttcgatactgtctttaaaggcgataccgttaacggtaccatttctacttattacttgaatcatgattacgctagcggttctgttaaccaggtagatatcagcaattcagtaattcatggggcaatcacctctgaactgccatttggttattacagcattactcctgcagaagttaatgctaaaggtgaagttgtaactccacagacctataatggctataatttctataacggaatcactactgaccttgactacaattggtacgatggtgacgtattcactctgaacgtatccaattccaccattgatgatgactatgaagctctttacttcactgacacatatcttgatggtgataaatctaagtcaaccaatgaaacgttctataccgctctgggtgttgcagtaaatcttgatgttgaaagcaatatcaatattactaacaactcccgtgtagctggtattgcgctgtctgaaggcaatacaagcaacacgacttatactagcgaatatcatcagtgggacaacaacattaatgtgtctaactccactgtaacttcagggtcacagactccgctggaagaaagcaatggcttcttcggtaaatctgctgaaccaagtgattacgctggtaatggtggcgaaaatgacgtagctctgtcattctctgacaatgctggctcaaattattccatgaaaaacaatgtaaactttgaccattcaaccctgttgggtgatgtcgagttcacaagccactggaataacgatggcgtattcttctattcaaccggccatgacagcaatggtgacggtgtccttgataccaacggtggttgggtagatgatgctcagaacgttgatgaactgaacattactctgaacaacggtagtaagtgggttggctcagcaaacatgagtgctgaagtaattgctccggcagatatgtatgatgttgcgccgaacagcctgacccctggtgccactatcgaagctaacgattggggtcgtattattgacaacaaggtattccagagcggcgtatttaacgtagcactgaacaatggttcagaatggaataccgttaatagttcagtaattgatacattagctgtaaataatggctctcaggtaaatgttactgattcctctctggtctcagataccattggtttaaccaacggctcctcactgaatattggtgaagatggtttggttgctacagaccacctgactgttgatagctacagtaccgttaatttaaccgaatctactggctggaataactattctaacctgtatgccaatatcatcaccgtaactaacggtggtgtactggatgtgaacgttgatcagtttgatactgaagctttccgtactgacaaactggaactgactagcggcaacatcgctgaccacaacggcaatgtagtttctggtgtgttcgatatcaacagcagcgattatgttctgaacgctgacctggtgaacgaccgtacttgggataccgctcaggctaactacggctacggtgttgttgctatgaactctgatggtcatctgactatcaacggtaacggcgacgtagacaacggtactgaactggataacagctctgtagacaacgttgttgcggcaaccggtaactacaaagttcgtatcgacaacgcaactggcgctggcgcaatcgctgattacaaagataaagaaattatctatgtaaacgacgtcaacagcaacgcgaccttctctgctgctaacaaagctgacctgggtgcatacacctatcaggctgagcagcgtggtaacaccgttgttctgcaacagatggagctgaccgactacgctaacatggcgctgagcatcccgtctgcgaacaccaatatctggaacctggaacaagacaccgttggtactcgtctgaccaactctcgtcatggtctggctgataacggcggcgcatgggtaagctacttcggtggtaacttcaacggcgacaacggcaccatcaactatgatcaggatgttaacggcatcatggtcggtgttgataccaaaattgacggtaacaacgctaagtggatcgtcggtgcggctgcaggcttcgctaaaggtgatatgaatgaccgttctggtcaggtggatcaagacagccagactgcctacatctactcttctgctcacttcgcgaacaacgtctttgttgacggtagcttgagctactctcacttcaacaacgacctgtctgcaaccatgagcaacggtacttacgttgacggcagcaccaactccgacgcttggggctttggtttgaaagccggttacgacttcaaactgggtgatgcaggttacgtgactccttacggcagcgtttctggtctgttccagtctggtgatgattaccagctgagcaacgacatgaaagttgatggtcagtcttacgacagcatgcgttatgaactgggtgtagatgcaggttataccttcacctacagcgaagaccaggctctgactccgtacttcaaactggcttacgtctacgacgactctaacaacgataacgatgtgaacggtgattccatcgataacggtactgaagggtctgcggtacgtgttggtctgggtactcagttcagcttcaccaagaacttcagcgcctataccgatgctaactacctcggtggtggtgacgtagatcaagactggtccgcgaatgtgggtgttaaatatacctggtaa

SEQ ID NO: 938 - protein, 995 aa, Escherichia coli
MHSWKKKLVVSQLALACTLAITSQANAANYDTWGYHDNTTTDLVWPYDTDNDGIADAGGMDPMGSDGNYVTYNGFVYYNNANGDFDTVFKGDTVNGTISTYYLNHDYASGSVNQVDISNSVIHGAITSELPFGYYSITPAEVNAKGEVVTPQTYNGYNFYNGITTDLDYNWYDGDVFTLNVSNSTIDDDYEALYFTDTYLDGDKSKSTNETFYTALGVAVNLDVESNINITNNSRVAGIALSEGNTSNTTYTSEYHQWDNNINVSNSTVTSGSQTPLEESNGFFGKSAEPSDYAGNGGENDVALSFSDNAGSNYSMKNNVNFDHSTLLGDVEFTSHWNNDGVFFYSTGHDSNGDGVLDTNGGWVDDAQNVDELNITLNNGSKWVGSANMSAEVIAPADMYDVAPNSLTPGATIEANDWGRIIDNKVFQSGVFNVALNNGSEWNTVNSSVIDTLAVNNGSQVNVTDSSLVSDTIGLTNGSSLNIGEDGLVATDHLTVDSYSTVNLTESTGWNNYSNLYANIITVTNGGVLDVNVDQFDTEAFRTDKLELTSGNIADHNGNVVSGVFDINSSDYVLNADLVNDRTWDTAQANYGYGVVAMNSDGHLTINGNGDVDNGTELDNSSVDNVVAATGNYKVRIDNATGAGAIADYKDKEIIYVNDVNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 939 - DNA, 669 bp, Escherichia coli
atgcccgtcaaggatttgacgggcattactgcaaaggacgcgcaaatgttatctgtagttaaacctcttcaggaatttggtaagctcgataaatgtttgtccagatacggtacgcgcttcgagtttaataatgaaaagcaagttatattttccagtaatgtcaatagcgaagatactttcgttattttagagggcgttatctctttgcgtagagaagaaaacgtacttatcggtattacacaggctccttatattatggggctggctgatggtttaatgaaaaacgatataccatacaaattaatatcagaaggaaactgtacgggatatcatttgccagccaaacaaaccattactcttattgaacaaaatcaactctggcgagacgctttttactggttagcctggcaaaatagaattctggaattacgcgacgttcagctcattgggcataattcctacgaacaaatccgcgcgacgttattatcaatgattgactggaatgaagaattgcgatcacgtattggcgtgatgaattatatccatcaacgtacacgtatatcgcgttctgtcgttgcggaagttcttgctgctttgcgtaaaggcggctatatcgaaatgaataaaggcaaactggtcgctatcaaccgtttgccttcagagtattaa

SEQ ID NO: 940 - protein, 222 aa, Escherichia coli
MPVKDLTGITAKDAQMLSVVKPLQEFGKLDKCLSRYGTRFEFNNEKQVIFSSNVNSEDTFVILEGVISLRREENVLIGITQAPYIMGLADGLMKNDIPYKLISEGNCTGYHLPAKQTITLIEQNQLWRDAFYWLAWQNRILELRDVQLIGHNSYEQIRATLLSMIDWNEELRSRIGVMNYIHQRTRISRSVVAEVLAALRKGGYIEMNKGKLVAINRLPSEY

SEQ ID NO: 941 - DNA, 1158 bp, Escherichia coli
ttgaaacgtagtctgcttttttctgccgtgctgtatgcggcgtcattgacctccgtccatacggcgcagccgatcactgaaccggagtttgcctctgatattgtcgatcgttatgccgatcatattttttacggcagcggtgccacggggatggcgctggttgttatcgacggtaaccagcgcgtctttcgcagttatggcgaaacgcgacctggtaataacgttcgcccgcagctggattccgtcatacgtattgcttccctcaccaagttaatgaccagtgagatgctggtgaaattgctcgaccaggggaccgtgaagttaaacgatccgctaagtaaatatgctccgccaggcgcacgcgtaccgacctacaatgggacgcccattacgctggtgaatctggcaacccataccagcgccctgccccgtgaacagcccggtggcgcggcacatcgtccggtatttgtctggccaacgcgcgagcaacgctggaaatacctttccactgccaaactaaaagccgcgccgggcagccaggccgcgtactccaacctcgcattcgatctgctggcagatgcactggcgaatgcgtccggcaagccttatacccagttgtttgaagagcagattacccgtccgttggggatgaaagacaccacctacaccccctcaccggatcagtgccgccgtttaatggttgctgagcgcggtgccagtccgtgcaataacacgctggcggcaattggcagcggcggcgtctattccacgccaggcgatatgatgcgctggatgcagcagtatttgtcatctgatttttatcagcgcagtaaccaggctgatcgcatgcagacgttgatttatcagcgcgcgcagtttacaaaagtgattggcatggatgtccccggcaaagcggatgcgcttggtttaggctgggtatatatggccccgaaagagggtcgtccggggattattcagaagacaggtggtggtggcggtttcattacctatatggcgatgatcccgcagaagaatattggcgcgtttgtggtggtcactcgttcgccgttgacgcgctttaaaaatatgagcgatggcatcaatgacctggtgaccgagctaagcgggaataaaccgttggttatccccgcatcctga

SEQ ID NO: 942 - protein, 385 aa, Escherichia coli
MKRSLLFSAVLYAASLTSVHTAQPITEPEFASDIVDRYADHIFYGSGATGMALVVIDGNQRVFRSYGETRPGNNVRPQLDSVIRIASLTKLMTSEMLVKLLDQGTVKLNDPLSKYAPPGARVPTYNGTPITLVNLATHTSALPREQPGGAAHRPVFVWPTREQRWKYLSTAKLKAAPGSQAAYSNLAFDLLADALANASGKPYTQLFEEQITRPLGMKDTTYTPSPDQCRRLMVAERGASPCNNTLAAIGSGGVYSTPGDMMRWMQQYLSSDFYQRSNQADRMQTLIYQRAQFTKVIGMDVPGKADALGLGWVYMAPKEGRPGIIQKTGGGGGFITYMAMIPQKNIGAFVVVTRSPLTRFKNMSDGINDLVTELSGNKPLVIPAS

SEQ ID NO: 943 - DNA, 1221 bp, Escherichia coli
atgtttaagtcttttttcccaaagccgggaacgttttttctctcggcctttgtttgggcattgattgccgttatcttctggcaagccggtgggggtgattgggtggcgcgtatcaccggcgcttccgggcagatcccgattagcgccgcgcgtttctggtcgttggatttcctgattttttacgcttactacattgtttgcgtaggactttttgcattgttctggtttatctatagcccgcaccgttggcaatactggtcaatactcggtactgcgctgattatcttcgtcacctggtttttggtggaagtcggggttgccgtcaacgcctggtatgcgccgttctatgatctgattcaaacggcgctaagttcgccgcataaagtcaccatcgaacaattttaccgcgaagtgggcgtctttctggggattgcgctgatcgcggtggtgatcagtgtgctgaacaacttctttgtcagtcactacgtgttccgctggcgtacggcgatgaacgaatattacatggcgaactggcaacaactgcgtcatatcgaaggggccgcgcagcgtgtgcaggaagacaccatgcgttttgcttcaacgctggagaatatgggcgtcagctttatcaacgctatcatgacgttgatcgccttcctgccggtgctggtaacgctctccgcacatgtgccggagctgccgattgtcgggcacattccgtatggtctggtgattgccgctatcgtctggtcgctgatggggaccggattactggcagtggtagggatcaaactgccggggctggagtttaaaaaccagcgtgtagaggctgcctaccgtaaagagctggtttatggtgaagacgatgccacgcgcgcgacgccgcctacggtacgcgagctttttagcgccgtacggaaaaactatttccgcctctattttcactatatgtatttcaatatcgcccgcattctctatttgcaggtcgataacgttttcggtttgttcttgctgtttccgtcaattgttgccggtacgattacgctcggcctgatgacgcagattactaacgtttttggtcaggttcgcggtgctttccagtacctgattaactcatggaccacactggttgagttgatgtctatctacaaacgtctgcgcagctttgaacatgagctggatggtgacaaaattcaggaagtaacccataccttgagctaa

SEQ ID NO: 944 - protein, 406 aa, Escherichia coli
MFKSFFPKPGTFFLSAFVWALIAVIFWQAGGGDWVARITGASGQIPISAARFWSLDFLIFYAYYIVCVGLFALFWFIYSPHRWQYWSILGTALIIFVTWFLVEVGVAVNAWYAPFYDLIQTALSSPHKVTIEQFYREVGVFLGIALIAVVISVLNNFFVSHYVFRWRTAMNEYYMANWQQLRHIEGAAQRVQEDTMRFASTLENMGVSFINAIMTLIAFLPVLVTLSAHVPELPIVGHIPYGLVIAAIVWSLMGTGLLAVVGIKLPGLEFKNQRVEAAYRKELVYGEDDATRATPPTVRELFSAVRKNYFRLYFHYMYFNIARILYLQVDNVFGLFLLFPSIVAGTITLGLMTQITNVFGQVRGAFQYLINSWTTLVELMSIYKRLRSFEHELDGDKIQEVTHTLS

SEQ ID NO: 945 - DNA, 1095 bp, Escherichia coli
atgtcgcgcgtcaatcctctatcttcgctgtcattgttggcggttctgattttagcggggtgtagtagtcaggctccgcaaccgttgaaaaagggcgaaaaagcgatagatgtggcgagtgtcgtgcggcagaagatgcctgcgagcgtgaaagaccgcgatgcctgggcgaaagatctcgccaccacctttgaaagtcaggggctggcaccgacgctggaaaacgtctgctcggtgctggcggtggcgcagcaggagtcaaattatcaggcagatccggccgttccgggcttaagcaagatcgcctggcaagagattgaccgtcgtgctgaacggatgcacattcctgcttttctggtgcataccgcgctaaaaatcaaatcgccaaacggcaaaagctatagcgaacggttagattcggtgcgtacagaaaagcaattgagcgcgatttttgacgatctgatcagcatggtgccaatggggcagacgctgtttggttcgctcaatccggtgcgcaccggtgggccgatgcaggtcagtattgcttttgccgaacagcataccaaagggtatccgtggaaaatggacggtacagtccgtcaggaagtcttcagtcgccgcggcgggttgtggtttggtacttaccatttactgaattatcccgccagctatagcgcgccgatataccgttttgctgattttaacgctggctggtacgccagccgtaatgccgcgtttcagaacgcggtcagtaaggccagcggcgtgaagctggcactggacggtgatttaattcgttacgacagtaaagagcccgggaaaaccgaactggcaacgcgcaaactggcgggaaaactggggatgagcgacagcgaaattcgccgtcagttagagaaaggggacagcttctcttttgaggagacggcgctgtacaagaaagtttatcaacttgccgaagcgaaaaccggtaaatcactaccccgcgaaatgttgcctggcattcaactggaaagcccgaaaatcacccgcaatctgactacggcctggtttgcgaagcgcgtagacgaacggcgggcgcgttgtatgaaacagtga

SEQ ID NO: 946 - protein, 364 aa, Escherichia coli
MSRVNPLSSLSLLAVLILAGCSSQAPQPLKKGEKAIDVASVVRQKMPASVKDRDAWAKDLATTFESQGLAPTLENVCSVLAVAQQESNYQADPAVPGLSKIAWQEIDRRAERMHIPAFLVHTALKIKSPNGKSYSERLDSVRTEKQLSAIFDDLISMVPMGQTLFGSLNPVRTGGPMQVSIAFAEQHTKGYPWKMDGTVRQEVFSRRGGLWFGTYHLLNYPASYSAPIYRFADFNAGWYASRNAAFQNAVSKASGVKLALDGDLIRYDSKEPGKTELATRKLAGKLGMSDSEIRRQLEKGDSFSFEETALYKKVYQLAEAKTGKSLPREMLPGIQLESPKITRNLTTAWFAKRVDERRARCMKQ

SEQ ID NO: 947 - DNA, 309 bp, Escherichia coli
atggctgatttcaccctgtcaaaatcgctgtttagcggaaaatatcgcaatgcatcttcaacgcctggcaatattgcctatgcgttgtttgtgctgttttgcttttgggctggggcgcaattgctgaacctgctagtgcatgcgcccggcgtctatgagcgtttaatgcaggtccaggaaacaggtcgcccacgggtggaaattggtttaggtgtcggcaccatttttgggctgatcccgtttttagtaggctgcctcatttttgcagtagtggcgctatggctgcactggcgacatcgccgccagtaa

SEQ ID NO: 948 - protein, 102 aa, Escherichia coli
MADFTLSKSLFSGKYRNASSTPGNIAYALFVLFCFWAGAQLLNLLVHAPGVYERLMQVQETGRPRVEIGLGVGTIFGLIPFLVGCLIFAVVALWLHWRHRRQ

SEQ ID NO: 949 - DNA, 345 bp, Escherichia coli
gtgaatcttcgttgtgagtcacaaaatagcaaccttaagttaaatttattaacaattgcgaaagtgttgtctacaccacagacagttgttacagaatatgcaaggatgttgtttttcgttaacggagctgccatgaatctgcctgtaaaaatccgccgtgactggcactactatgcgttcgccattggccttatattcattcttaatggcgtggtggggttactgggatttgaagcaaaaggttggcagacctatgccgtcggtctggtgacgtgggtgattagtttctggctggcggggttgattattcgtcgtcgcgatgaagaaactgaaaacgcccaataa

SEQ ID NO: 950 - protein, 114 aa, Escherichia coli
MNLRCESQNSNLKLNLLTIAKVLSTPQTVVTEYARMLFFVNGAAMNLPVKIRRDWHYYAFAIGLIFILNGVVGLLGFEAKGWQTYAVGLVTWVISFWLAGLIIRRRDEETENAQ

SEQ ID NO: 951 - DNA, 1095 bp, Escherichia coli
atggaaaaactgcgggtaggaatcgtttttggtggtaaatcagcggaacatgaagtgtctctgcaatcggcaaaaaacattgtcgatgccattgataaaagtcgcttcgatgttgtgctgctgggcattgataaacaagggcaatggcacgtcagcgatgccagcaattatctgctaaatgcagacgatcctgcccatattgcgttgcgtccttcggcgaccagccttgcgcaggtgccaggtaaacatgagcatcagcttatcgacgcacaaaacggtcagccgttgccgacggtggatgtcattttcccgattgtccacggtacgctgggcgaagatggttccttgcagggaatgctgcgggtcgccaatttaccgtttgtaggttctgatgttctggcttcagcggcctgtatggataaagatgtcaccaaacgtctgctgcgcgatgccgggctgaacattgcgccatttattaccctgacgcgcgctaatcgtcacaacatcagttttgccgaagtggagtctaaactggggttaccgctgtttgtaaaaccggctaatcagggctcttctgttggtgtcagcaaagtaaccagtgaagaacagtacacaattgccgtcgatctggcgttcgagttcgatcataaagtgatcgttgagcaagggatcaaaggtcgtgaaatcgaatgcgcagttcttggcaacgataacccgcaagcaagcacctgtggcgagatcgtactcaccagcgatttctatgcctacgacaccaagtacattgacgaagatggcgcgaaagtggtagttccagcagccattgcgccagaaatcaacgataagatccgggcgattgccgttcaggcttatcagacgttgggatgcgcaggcatggcgcgtgtagacgtgtttttaaccccagagaacgaagtagtgatcaacgagatcaacaccctgcctggcttcaccaacatcagtatgtatccgaagctgtggcaagccagcggtctgggttacaccgacctgatcacgcgtttgattgagctggcgctggagcgtcacgctgcggataacgcactgaaaaccacaatgtaa

SEQ ID NO: 952 - protein, 364 aa, Escherichia coli
MEKLRVGIVFGGKSAEHEVSLQSAKNIVDAIDKSRFDVVLLGIDKQGQWHVSDASNYLLNADDPAHIALRPSATSLAQVPGKHEHQLIDAQNGQPLPTVDVIFPIVHGTLGEDGSLQGMLRVANLPFVGSDVLASAACMDKDVTKRLLRDAGLNIAPFITLTRANRHNISFAEVESKLGLPLFVKPANQGSSVGVSKVTSEEQYTIAVDLAFEFDHKVIVEQGIKGREIECAVLGNDNPQASTCGEIVLTSDFYAYDTKYIDEDGAKVVVPAAIAPEINDKIRAIAVQAYQTLGCAGMARVDVFLTPENEVVINEINTLPGFTNISMYPKLWQASGLGYTDLITRLIELALERHAADNALKTTM

SEQ ID NO: 953 - DNA, 123 bp, Escherichia coli
atgttgcaatcttctgctgacaaagcgagcaacgtactggtgaagaaagtgcgttatctcaaagatgtgtgcaagatcacaaaaatgatgaacgggaagctaatttattcctggcttaaatga

SEQ ID NO: 954 - protein, 40 aa, Escherichia coli
MLQSSADKASNVLVKKVRYLKDVCKITKMMNGKLIYSWLK

SEQ ID NO: 955 - DNA, 261 bp, Escherichia coli
atgaaaaatctcattgctgagttgttatttaagcttgcccaaaaagaagaagagtcgaaagaactgtgtgcgcaggtagaagctttggagattatcgtcacggcaatgcttcgcaatatggcgcaaaatgatcaacagcggttgattgatcaggtagagggggcgctgtacgaggtaaagcccgatgccagcattcctgacgacgatacggagctgctgcgcgattacgtaaagaagttattgaggcatcctcgtcagtaa

SEQ ID NO: 956 - protein, 86 aa, Escherichia coli
MKNLIAELLFKLAQKEEESKELCAQVEALEIIVTAMLRNMAQNDQQRLIDQVEGALYEVKPDASIPDDDTELLRDYVKKLLRHPRQ

SEQ ID NO: 957 - DNA, 1416 bp, Escherichia coli
gtgaaacaaagcactattgcactggcactcttaccgttactgtttacccccgtgacaaaagcccggacaccagaaatgcctgttctggaaaaccgggctgctcagggcgatattactgcacccggtggtgctcgccgcttaacgggtgatcagaccgccgctctgcgtgattctcttagcgataaacctgcaaaaaatattattttgctgattggcgatgggatgggggactcggaaattactgccgcacgcaattatgccgaaggtgcgggcggcttttttaaaggtattgatgccttaccgcttaccgggcaatacactcactatgcgctgaataaaaaaaccggcaaaccggactacgtcaccgactcggctgcatcagcaaccgcctggtcaacaggtgtcaaaacctataatggcgcgctgggcgtcgatattcacgaaaaagatcacccaacgattctggaaatggcaaaagccgcaggtctggcgaccggtaacgtttctaccgcagagttgcaggatgccacgcccgctgcgctggtggcgcatgtgacctcgcgcaaatgctacggtccgagtgcgaccagtgaaaaatgtccgggtaacgctctggaaaaaggcggaaaaggatcgattaccgaacagctgcttaacgcccgtgccgatgttacgcttggcggcggtgcaaaaacctttgctgaaacggcaaccgccggtgaatggcagggaaaaacgctgcgtgaacaggcacaggcgcgtggttatcagttggtgagcgatactgcctcactgaattcggtgacggaagcgaatcagcaaaaacccctattaggactgtttgctgacggcaatatgccagtgcgctggcaaggaccgaaagcaacgtaccacggtaatatagataagcccgcagtcacctgtacgcctaatccgcaacgtaatgacagtgtaccgaccctggcgcagatgaccgacaaagccattgaattgttgagtaaaaatgagaaaggctttttcctgcaagttgaaggtgcgtcaatcgataaacaggatcacgcagcgaatccttgtgggcaaattggcgagacggtcgatctcgatgaagccgtacaacgggcgctggaattcgctaaaaaggatggtaacacgttggtcatagtcaccgctgatcacgcccatgccagccagatagttgcgccggataccaaagctccgggcctcacccaggcgctaaataccaaagatggcgcagtgatggtgatgagttacgggaactccgaagaggattcacaagaacataccggcagtcagttgcgtattgcggcgtatggcccgcatgccgccaatgttgttggactgaccgaccagaccgatctcttctacaccatgaaagccgccctggggctgaaataa

SEQ ID NO: 958 - protein, 471 aa, Escherichia coli
MKQSTIALALLPLLFTPVTKARTPEMPVLENRAAQGDITAPGGARRLTGDQTAALRDSLSDKPAKNIILLIGDGMGDSEITAARNYAEGAGGFFKGIDALPLTGQYTHYALNKKTGKPDYVTDSAASATAWSTGVKTYNGALGVDIHEKDHPTILEMAKAAGLATGNVSTAELQDATPAALVAHVTSRKCYGPSATSEKCPGNALEKGGKGSITEQLLNARADVTLGGGAKTFAETATAGEWQGKTLREQAQARGYQLVSDTASLNSVTEANQQKPLLGLFADGNMPVRWQGPKATYHGNIDKPAVTCTPNPQRNDSVPTLAQMTDKAIELLSKNEKGFFLQVEGASIDKQDHAANPCGQIGETVDLDEAVQRALEFAKKDGNTLVIVTADHAHASQIVAPDTKAPGLTQALNTKDGAVMVMSYGNSEEDSQEHTGSQLRIAAYGPHAANVVGLTDQTDLFYTMKAALGLK

SEQ ID NO: 959 - DNA, 339 bp, Escherichia coli
atgaagagggatggtgcgatgaaaattacattactggttaccttgcttttcggtctggtttttttaaccaccgtcggcgctgccgagagaaccttaaccccacaacaacagcgtatgacctcttgtaatcagcaggcgacggcgcaggcgttgaaaggggatgctcgtaagacctacatgagtgattgcctgaagaacagcaaatctgcgcctggtgaaaaaagtttgacgccacagcagcaaaagatgcgcgaatgtaataatcaagcaacacaacaatctctgaaaggggatgatcgtaataagtttatgagtgcctgcctcaagaaagccgcctga

SEQ ID NO: 960 - protein, 112 aa, Escherichia coli
MKRDGAMKITLLVTLLFGLVFLTTVGAAERTLTPQQQRMTSCNQQATAQALKGDARKTYMSDCLKNSKSAPGEKSLTPQQQKMRECNNQATQQSLKGDDRNKFMSACLKKAA

SEQ ID NO: 961 - DNA, 1116 bp, Escherichia coli
atgttcccaaaaataatgaatgatgaaaactttttcaaaaaagcggcggcgcatggggaggaacctcctttaactcctcaaaacgaacatcagcggtccgggctgcgctttgcccgtcgcgtcagactaccccgcgcggttggcctggctggcatgttcttaccgattgcttcaacgctggtttcgcatccgtcgccgggctggtggtggctgttgttggtcggctgggcgttcgtctggccgcatttagcctggcaaatagcgagcagggccgtcgatccgcttagccgggaaatttacaacttaaaaaccgatgcagtattagcgggaatgtgggtaggcgtaatgggcgtaaacgcactgccttccaccgcgatgttgatgattatgtgtctgaatttgatgggggcaggcggcccccgtctgtttgtcgcgggtctggtgttgatggtggtctcctgccttgtcaccctcgagctgacgggcatcaccgtgtcgttcaatagcgcaccgctggaatggtggctctcccttcccattattgtcatttatcctctgctgtttggctgggtcagctaccagacggcgactaaactggcggaacataaacgcaggttgcaggtcatgagtacccgcgacggtatgacgggcgtgtataaccgacgtcattgggaaactatgttacgcaatgaatttgataactgtcggcggcataatcgcgatgcaacgttactgattatcgatatcgaccatttcaagagcatcaacgatacctggggccatgatgtgggtgatgaagcgattgtggcgcttacccgacagttacaaattaccctgcgcggtagcgatgtgattggtcggtttggcggcgatgagtttgcagtaatcatgtccggtacgccagctgagagcgccatcaccgccatgttacgggtgcatgaagggctaaacacgttacgcttgccgaatacgccacaggtaactttacggattagtgtgggggttgcgccgctgaatccacaaatgagtcactatcgcgagtggttgaaatcggcagatttggcgctctacaaagcaaagaaagccggacgtaaccgcaccgaagtggcggcctga

SEQ ID NO: 962 - protein, 371 aa, Escherichia coli
MFPKIMNDENFFKKAAAHGEEPPLTPQNEHQRSGLRFARRVRLPRAVGLAGMFLPIASTLVSHPSPGWWWLLLVGWAFVWPHLAWQIASRAVDPLSREIYNLKTDAVLAGMWVGVMGVNALPSTAMLMIMCLNLMGAGGPRLFVAGLVLMVVSCLVTLELTGITVSFNSAPLEWWLSLPIIVIYPLLFGWVSYQTATKLAEHKRRLQVMSTRDGMTGVYNRRHWETMLRNEFDNCRRHNRDATLLIIDIDHFKSINDTWGHDVGDEAIVALTRQLQITLRGSDVIGRFGGDEFAVIMSGTPAESAITAMLRVHEGLNTLRLPNTPQVTLRISVGVAPLNPQMSHYREWLKSADLALYKAKKAGRNRTEVAA

SEQ ID NO: 963 - DNA, 810 bp, Escherichia coli
atggaaaagaaaatcggttttattggctgcggcaatatgggaaaagccattctcggcggtctgattgccagcggtcaggtgcttccagggcaaatctgggtatataccccctccccggataaagtcaccgtcctgcatgaccagttcggcatcaacgccgcagaatcggcgcaagaagtagcgcaaatcgccgacatcatttttgccgccgttaaaccaggcatcatgattaaagtgcttagcgaaatcacctccagcctgaataaagactctctggtcgtttctattgctgcaggtatcacgctcgaccagcttgcccgcgcgctgggccatgaccggaaaattatccgcgccatgccgaacactcccgcgctggttaatgccgggatgacctccgtaacgccaaacgcgctggtaaccccagaagataccgctgatgtgctgaatattttccgctgctttggcgaagcggaagtgattgctgagccgatgatccacccggtggtcggtgtgagcggttcttcgccagcctacgtctttatgtttatcgaagcgatggccgacgccgccgtgctgggcgggatgccacgcgcccaggcgtataaatttgccgctcaggcggtaatgggctccgcaaaaatggtgctggaaacgggagaacatccggggacactgaaagatatggtctgctcaccgggaggcaccaccattgaggcggtacgcgtactggaagagaaaggcttccgtgccgcagtgatcgaagcgatgacgaagtgtatggaaaaatcagaaaaactcagcaaatcctga

SEQ ID NO: 964 - protein, 269 aa, Escherichia coli
MEKKIGFIGCGNMGKAILGGLIASGQVLPGQIWVYTPSPDKVTVLHDQFGINAAESAQEVAQIADIIFAAVKPGIMIKVLSEITSSLNKDSLVVSIAAGITLDQLARALGHDRKIIRAMPNTPALVNAGMTSVTPNALVTPEDTADVLNIFRCFGEAEVIAEPMIHPVVGVSGSSPAYVFMFIEAMADAAVLGGMPRAQAYKFAAQAVMGSAKMVLETGEHPGTLKDMVCSPGGTTIEAVRVLEEKGFRAAVIEAMTKCMEKSEKLSKS

SEQ ID NO: 965 - DNA, 579 bp, Escherichia coli
ttgcctcactcctgccgtgaaattcattgttttgataatcgctggcagaagcataaacagaactatgccggaaggcaaaagcgcgacacaatagaggattacccaacaaaggatgactttatgacaatttgggtggatgccgacgcgtgtcccaatgtaattaaagagattttgtatcgcgcggcggaacgtatgcagatgccgctggtactggtagcaaaccagagtttacgcgtgccgccatcgcgatttattcgtacgctgcgcgtcgcggcaggtttcgacgttgctgataacgaaattgttcggcagtgtgaagcgggcgatttggtgatcaccgcagatatacctttggctgctgaagccatcgagaaaggcgcggcggcgcttaatccgcgcggcgaacgttacacgccagcgaccattcgtgagcgcctgacgatgcgcgattttatggataccttacgtgccagtgggatccagaccggaggaccagatagtctttcacaacgtgaccgccaggcttttgctgcggagctggagaagtggtggctggaagtgcaacgtagtcgtggctaa

SEQ ID NO: 966 - protein, 192 aa, Escherichia coli
MPHSCREIHCFDNRWQKHKQNYAGRQKRDTIEDYPTKDDFMTIWVDADACPNVIKEILYRAAERMQMPLVLVANQSLRVPPSRFIRTLRVAAGFDVADNEIVRQCEAGDLVITADIPLAAEAIEKGAAALNPRGERYTPATIRERLTMRDFMDTLRASGIQTGGPDSLSQRDRQAFAAELEKWWLEVQRSRG

SEQ ID NO: 967 - DNA, 525 bp, Escherichia coli
atgacacaacctctttttctgatcgggcctcggggctgtggtaaaacaacggtcggaatggcccttgccgattcgcttaaccgtcggtttgtcgataccgacctgtggttgcaatcacagctcaatatgacggtcgcggagatcgtcgaaagggaagagtgggcgggattccgcgccagagaaacggcggcgctggaagcggtaactgcgccatccaccgttatcgctacaggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccactgagcgaagaagttcaggaagtgctggaagaacgcgatgcgctatatcgcgaagttgcgcatattatcatcgacgcaacaaacgaacccagccaggtgatttctgaaattcgcagcgctctggcacagacgatcaattgttga

SEQ ID NO: 968 - protein, 174 aa, Escherichia coli
MTQPLFLIGPRGCGKTTVGMALADSLNRRFVDTDLWLQSQLNMTVAEIVEREEWAGFRARETAALEAVTAPSTVIATGGGIILTEFNRHFMQNNGIVVYLCAPVSVLVNRLQAAPEEDLRPTLTGKPLSEEVQEVLEERDALYREVAHIIIDATNEPSQVISEIRSALAQTINC

SEQ ID NO: 969 - DNA, 192 bp, Escherichia coli
atgccaacgaaaccgccttatcctcgtgaagcatatatagtgacgattgataaaggaaagccaggacagacggtaacctggtaccaactcagagccgatcatcctaaaccagactcgttgatcagtgaacatccgaccgctcaggaagcgatggatgcgaaaaaacgctatgaggaccctgacaaagagtga

SEQ ID NO: 970 - protein, 63 aa, Escherichia coli
MPTKPPYPREAYIVTIDKGKPGQTVTWYQLRADHPKPDSLISEHPTAQEAMDAKKRYEDPDKE

SEQ ID NO: 971 - DNA, 678 bp, Escherichia coli
atgagtgcgtcgttggcgatcctgactatcggcattgtacctatgcaggaagttttgccgctcctgacagaatacattgacgaagataatatttcccatcatagcctgctggggaagttaagccgcgaagaagtgatggcggagtacgcgccagaagcaggcgaagacacaattctcacattattaaatgacaaccatctggcccatgtttcgcgtcgcaaagtggagcgagacctgcaaggtgtggttgaagtgctcgataatcagggttacgacgtcattatattaatgagtacagcaaacattagtagtatgaccgcgcgtaatacgatctttcttgagccgtcgcggatattgccaccgctggtttcctctattgttgaagatcatcaggtgggggttatcgtaccggttgaggagttgctgaccgttcaggcgcaaaaatggcaaattttgcagaaaccgccagtattttcattgggtaaccccattcatgattcggaacaaaaaatcattgatgccgggaaagaattactggcaaaaggtgcagatgtcatcatgctggattgtttgggatttaaccagcgtcatcgcgatttactgcaaaaacagctcgatgttcctgtcttgctctctaacgtattgattgcacggctggctgcggaattactgatgtaa

SEQ ID NO: 972 - protein, 225 aa, Escherichia coli
MSASLAILTIGIVPMQEVLPLLTEYIDEDNISHHSLLGKLSREEVMAEYAPEAGEDTILTLLNDNHLAHVSRRKVERDLQGVVEVLDNQGYDVIILMSTANISSMTARNTIFLEPSRILPPLVSSIVEDHQVGVIVPVEELLTVQAQKWQILQKPPVFSLGNPIHDSEQKIIDAGKELLAKGADVIMLDCLGFNQRHRDLLQKQLDVPVLLSNVLIARLAAELLM

SEQ ID NO: 973 - DNA, 285 bp, Escherichia coli
atgcttcaaagtaatgagtacttttccggcaaagtgaaatcgatcggcttttccagcagcagcactggtcgcgccagcgtgggtgttatggttgaaggtgaatacaccttcagcaccgctgagcctgaagagatgacggtaatcagtggcgcgctgaatgtgttactgcctgacgcgaccgactggcaagtgtatgaagccggttcggtgtttaatgttcccggtcacagcgagtttcatctgcaagttgccgaacccacctcttatctgtgccgctatctgtaa

SEQ ID NO: 974 - protein, 94 aa, Escherichia coli
MLQSNEYFSGKVKSIGFSSSSTGRASVGVMVEGEYTFSTAEPEEMTVISGALNVLLPDATDWQVYEAGSVFNVPGHSEFHLQVAEPTSYLCRYL

SEQ ID NO: 975 - DNA, 156 bp, Escherichia coli
gtgcgttgtgcaatgccgtttggcgcaaatgatcattgcgactttgcagcaatgcacgccaccattcatcatctgatttatcttttatcgtcgccagttccgcaacaatatctggagatcttcgctgatatttatatcaaccttgatgaattatga

SEQ ID NO: 976 - protein, 51 aa, Escherichia coli
MRCAMPFGANDHCDFAAMHATIHHLIYLLSSPVPQQYLEIFADIYINLDEL

SEQ ID NO: 977 - DNA, 258 bp, Escherichia coli
ttgcgccaaacggcattgcacaacgcacataccccggtgttgttgttaacgacattgactgagcctcaggagcggtcgctggctattaataattcacagctggctgccgatgtgaaaacggcgtggttaaaagaggagccatcattactcttatttgtcgaacaacccgatctttcgctgttacgtgatttagtgaaaaccggggcaacgcgaaaaattcgcagtgaagcgcgtcaccggcttgaggaaaaacaatga

SEQ ID NO: 978 - protein, 85 aa, Escherichia coli
MRQTALHNAHTPVLLLTTLTEPQERSLAINNSQLAADVKTAWLKEEPSLLLFVEQPDLSLLRDLVKTGATRKIRSEARHRLEEKQ

SEQ ID NO: 979 - DNA, 984 bp, Escherichia coli
ttggcaatgcaaggccgccgacaattcgttatcatgcccgctaaatttaacgacaaggccgtggaaattatcatgctgtggttcaaaaatttaatggtttaccgtcttagccgcgagatttcgctgcgtgcagaagagatggaaaaacagctagcctcgatggcatttaccccatgcggcagccaggacatggcgaagatgggctgggtacctccgatgggatcgcacagcgatgcgttaacgcacgttgccaatggtcaaattgttatctgtgcgcgcaaagaagaaaaaatcctcccgtccccggtgattaaacaggcgctggaagcgaaaatcgccaaactggaagcagaacaggcgcgtaagctgaagaaaaccgaaaaagattcgctgaaagacgaagtgctgcactctctgctgccgcgtgctttcagccgttttagccagacaatgatgtggatcgacacggttaacggtttgattatggtggactgcgccagcgccaaaaaagcggaagatacgctggcactgctgcgtaaaagcctggggtcgttaccggttgtaccattgagcatggaaaacccgattgaactgacgctgaccgaatgggtacgttccggcagcgcggcacagggcttccagctgcttgatgaagccgagctgaaatcgttgctggaagatggcggcgtgatccgcgcgaagaaacaagatctgaccagcgaagagatcaccaaccacattgaagccggaaaagtggtgactaaactggcgcttgactggcagcagcgcattcagtttgtgatgtgcgacgatggttcgctcaagcgtctgaagttctgcgacgagctgcgcgatcaaaacgaagatatcgaccgtgaagatttcgcccagcgctttgatgccgatttcatcctgatgactggtgaactggcagcgttaattcaaaacctgattgaaggattaggtggcgaagcacaacgttaa

SEQ ID NO: 980 - protein, 327 aa, Escherichia coli
MAMQGRRQFVIMPAKFNDKAVEIIMLWFKNLMVYRLSREISLRAEEMEKQLASMAFTPCGSQDMAKMGWVPPMGSHSDALTHVANGQIVICARKEEKILPSPVIKQALEAKIAKLEAEQARKLKKTEKDSLKDEVLHSLLPRAFSRFSQTMMWIDTVNGLIMVDCASAKKAEDTLALLRKSLGSLPVVPLSMENPIELTLTEWVRSGSAAQGFQLLDEAELKSLLEDGGVIRAKKQDLTSEEITNHIEAGKVVTKLALDWQQRIQFVMCDDGSLKRLKFCDELRDQNEDIDREDFAQRFDADFILMTGELAALIQNLIEGLGGEAQR

SEQ ID NO: 981 - DNA, 909 bp, Escherichia coli
gtgcgtataggtatcgatttaggcggcaccaaaactgaagtgattgcattgggcgatgcaggggagcagttgtaccgccatcgtctgcccacgccgcgtgatgattaccggcagactattgaaacgatcgccacgttggttgatatggcggagcaggcaacagggcagcgcggaacggtaggtatgggcattccaggttcgatttcgccctacaccggcgtggtgaagaatgccaattcaacctggctcaacggtcagccattcgataaagacttaagcgcgcggttgcagcgggaagtgcggctggcaaatgacgccaactgtctggcggtttcagaagcggtagatggcgcggcagcgggagcgcagacggtatttgccgtgattatcggcacgggatgcggcgcgggcgtggcattcaatgggcgggcgcatatcggcggcaatggcacggcaggcgagtggggacacaatccgctaccgtggatggacgaagacgaactgcgttatcgcgaggaagtcccttgttattgcggtaaacaaggttgtattgaaacctttatttcaggcacgggattcgcgacggattatcgtcgtttgagcggacatgcgctgaaaggcagtgaaattatccgcctggttgaagaaagcgatccggtagcggaactggcattgcgtcgctacgagctgcggctggcaaaatcgctggcacatgtcgtgaatattctcgatccggatgtgattgtcctgggcggcggaatgagcaatgtagaccgtttatatcaaacggttccacagttgattaaacaatttgtcttcggcggagaatgtgaaacgccggtacgcaaggcgaaacatggtgattcgagcggcgtacgcggcgctgcatggttatggccacaagagtaa

SEQ ID NO: 982 - protein, 302 aa, Escherichia coli
MRIGIDLGGTKTEVIALGDAGEQLYRHRLPTPRDDYRQTIETIATLVDMAEQATGQRGTVGMGIPGSISPYTGVVKNANSTWLNGQPFDKDLSARLQREVRLANDANCLAVSEAVDGAAAGAQTVFAVIIGTGCGAGVAFNGRAHIGGNGTAGEWGHNPLPWMDEDELRYREEVPCYCGKQGCIETFISGTGFATDYRRLSGHALKGSEIIRLVEESDPVAELALRRYELRLAKSLAHVVNILDPDVIVLGGGMSNVDRLYQTVPQLIKQFVFGGECETPVRKAKHGDSSGVRGAAWLWPQE

SEQ ID NO: 983 - DNA, 1269 bp, Escherichia coli
ttggcctcgctggtcgttatcctgcaatctatcactttattggctacggtgattggtagccgttctggtggttgtgatggtggtatgaaaaaagttattttatctttggctctgggcacgtttggtttggggatggccgaatttggcattatgggcgtgctcacggagctggcgcataacgtaggaatttcgattcctgccgccgggcatatgatctcgtattatgcgctgggggtggtggtcggtgcgcctataatcgcgcttttttccagccgctactcactcaaacatatcttgttgtttctggtggcgttgtgcgtcattggcaacgccatgttcacgctctcttcgtcttacctgatgctcgccattggtcggctggtttccggctttccgcatggtgcattttttggcgtcggcgcgatcgtgttatcaaaaattatcaaacccggcaaagtcaccgccgccgtggcagggatggtttccgggatgacagtcgccaatttgctgggcattccactgggaacgtatttaagtcaggaatttagctggcgctacacctttttgttgatcgctgtttttaatattgcggtgatggcatcggtctatttttgggtgccggatattcgcgacgaggcgaaaggaaaactacgcgaacaatttcactttttacgcagccctgccccgtggttaattttcgccgctacgatgtttggcaacgcaggtgtgtttgcctggttcagctacgtaaagccatacatgatgtttatttccggtttttcggaaacggcgatgacctttattatgatgttagttgggctagggatggtgctggggaatatgctaagtggcaggatttcaggacgttattcaccactgcgcattgcagcagtgactgactttatcattgtactggcactgctgatgctctttttcttcggcggtatgaaaacaacgtcgcttatttttgcttttatttgttgcgcgggattatttgccctatcagcacctctacaaatattattactgcaaaatgccaaaggcggagagttattaggtgccgcaggtgggcaaatagcgtttaacctcggtagcgccgtcggcgcatattgcggtggtatgatgctgacgctggggctggcatataattacgtggcgctgcccgccgccctgctttcgtttgctgcgatgtcgtcgttgctgctgtatggtcgctataagcgccagcaagcggcggatagttcggtgctggcgaaaccactggggtag

SEQ ID NO: 984 - protein, 422 aa, Escherichia coli
MASLVVILQSITLLATVIGSRSGGCDGGMKKVILSLALGTFGLGMAEFGIMGVLTELAHNVGISIPAAGHMISYYALGVVVGAPIIALFSSRYSLKHILLFLVALCVIGNAMFTLSSSYLMLAIGRLVSGFPHGAFFGVGAIVLSKIIKPGKVTAAVAGMVSGMTVANLLGIPLGTYLSQEFSWRYTFLLIAVFNIAVMASVYFWVPDIRDEAKGKLREQFHFLRSPAPWLIFAATMFGNAGVFAWFSYVKPYMMFISGFSETAMTFIMMLVGLGMVLGNMLSGRISGRYSPLRIAAVTDFIIVLALLMLFFFGGMKTTSLIFAFICCAGLFALSAPLQILLLQNAKGGELLGAAGGQIAFNLGSAVGAYCGGMMLTLGLAYNYVALPAALLSFAAMSSLLLYGRYKRQQAADSSVLAKPLG

SEQ ID NO: 985 - DNA, 3144 bp, Escherichia coli
atgaaaattctcagcctgcgcctgaaaaacctgaactcattaaaaggcgaatggaagattgatttcacccgcgagccgttcgccagcaacgggctgtttgctattaccggcccaaccggtgcggggaaaaccaccctgctggacgccatttgtctggcgctgtatcacgaaaccccgcgcctctctaacgtttcacaatcgcaaaatgatctcatgacccgcgataccgccgaatgtctggcggaagtggagtttgaagtcaaaggtgaagcgtatcgcgcgttctggagccagaatcgggcgcgtaaccagccggacggtaatttgcaggtgccacgcgtagagctggcgcgctgtgcagacggcaaaattctcgccgacaaagtgaaagataagctggaactgacggcgacgttaaccggactggattacgggcgcttcacccgttcgatgctgctttcgcaggggcaatttgctgccttcctgaatgccaaacccaaagaacgcgcagaattgctcgaggagttaaccggcactgaaatctacgggcaaatctcggcgatggtttttgagcagcacaaatcggcccgcacagagctggagaagctgcaagcgcaggccagcggcgtcgcgttgctcacgccagaacaagtgcaatcgctgacagcgagtttgcaggtacttactgacgaagaaaaacagttaattaccgcgcagcagcaagaacaacaatcgctaaactggttaacgcgtctggacgaattgcagcaagaaggcagccgccgtcaacaggccttgcaacaggcgttagccgaagaagaaaaagcgcaacctcaactggcggcgctcagtctggcacaaccggcacgaaatcttcgtccgcactgggaacgcatcgcagaatacagcacggcgctggcgcatactcgccagcagattgaagaagtaaatactcgcttacagagcacaatggcgcttcgtgcgagcattcgccaccacgcggcgaagcagtcagcagaattacagcagcagcaacaaagcctgaatgcctggttacaggaacacgaccgcttacgtcagtggaacaacgaactggcgggttggcgtgcgcagttctcccaacaaaccagcgatcgcgagcatctgcggcaatggcagcaacagttaactcatgctgagcaaaaacttaatgcacttgcggcgatcacgttgacgttaaccgccgatgaagttgctagcgccctggcgcaacatgctgagcaacgcccactgcgtcagcgcctggtcgcactgcatgggcagattgttccccaacaaaaacgtctggcgcagttacaggtcgctatccagaatgtcactctggaacagacgcaacgtaatgccgcacttaacgaaatgcgccatcgttataaagaaaaaacgcaacaacttgccgatgtgaaaaccatttgcgagcaggaaactcgcattaaaacgctggaagcccagcgcgcgcagttacaagcgggtcagccttgtccactttgtggttccaccagccacccggcggtcgaggcgtatcaggcgctggaaccgggcgttaatcaggcccggctattaacgctggaaaaagaagtgaaaaagctcggcgaagaaggtgcgacgctacgtgggcaactggacgccttaacaaagcaacttcagcgtgatgaaaacgaagcgcaaagcctccgacaagatgagcaagcacttactcaacaatggcaagccgtcacggccagcctcaatatcaccttgcagccacaggacgatattcaaccgtggctagatgcacaagatgagcacgaacgccagctgcggttactcagccaacggcatgaattacaagggcagattgccgcgcataatcagcaaattatccagtatcaacagcaaattgaacaacgccagcagcagctcttaacggcattggcgggttatgcactgacattgccacaggaagatgaagaagagagctggttggcgacgcgtcagcaagaagcgcagagctggcagcatcgccagaacgaattaaccgcgctgcaaaaccgtattcagcaactgacgccgattctggaaacgttgccgcaaagtgatgaactcccgcacagcgaagaaactgtggcgctggaaaactggcggcaggttcatgaacaatgtctcgcattacacagccagcagcagacgttacagcaacaggatgttctggcggcgcaaagtctgcaaaaagcccaggcgcagtttgacaccgcgctacaggcgagcgtctttgacgatcagcaggcgttccttgcggcgctaatggatgaacaaacactaacgcagctggaacagctcaagcagaatctggaaaaccagcgccgtcaggcgcaaacgctggtcactcagacagcagaaacgctgacacagcatcagcaacaccgacctggcgggttgtctctcactgtgacggtggagcagattcagcaagagttagcgcaaactcaccaaaagttgcgtgaaaacaccacgagtcaaggcgagattcgccagcagctgaagcaggatgcagataaccgtcagcaacaacaaaccttaatgcagcaaattgctcaaatgacgcagcaggttgaggactggggatatctgaattcgctaataggttccaaagagggcgataaattccgcaagtttgcccaagggctgacgctggataatttagtccatctcgctaatcagcaactcacccggctacacgggcgctatctgttacagcgcaaagccagcgaagcgctggaagttgaggttgttgatacctggcaggctgatgcggtacgcgatacccgtaccctttccggcggcgaaagtttcctcgtcagtctggcgctggcactggcgctttcagatctggtcagccataaaacgcgtattgactcgctgttccttgatgaaggttttggcacactggatagcgaaacgctggataccgcccttgatgcgttggatgccctgaatgccagtggcaaaaccatcggggtgattagccacgttgaggcgatgaaagagcgtattccggtgcagatcaaagtgaagaagatcaatggactgggctacagcaaactggaaagtgcgtttgcaatgaaataa

SEQ ID NO: 986 - protein, 1047 aa, Escherichia coli
MKILSLRLKNLNSLKGEWKIDFTREPFASNGLFAITGPTGAGKTTLLDAICLALYHETPRLSNVSQSQNDLMTRDTAECLAEVEFEVKGEAYRAFWSQNRARNQPDGNLQVPRVELARCADGKILADKVKDKLELTATLTGLDYGRFTRSMLLSQGQFAAFLNAKPKERAELLEELTGTEIYGQISAMVFEQHKSARTELEKLQAQASGVALLTPEQVQSLTASLQVLTDEEKQLITAQQQEQQSLNWLTRLDELQQEGSRRQQALQQALAEEEKAQPQLAALSLAQPARNLRPHWERIAEYSTALAHTRQQIEEVNTRLQSTMALRASIRHHAAKQSAELQQQQQSLNAWLQEHDRLRQWNNELAGWRAQFSQQTSDREHLRQWQQQLTHAEQKLNALAAITLTLTADEVASALAQHAEQRPLRQRLVALHGQIVPQQKRLAQLQVAIQNVTLEQTQRNAALNEMRHRYKEKTQQLADVKTICEQETRIKTLEAQRAQLQAGQPCPLCGSTSHPAVEAYQALEPGVNQARLLTLEKEVKKLGEEGATLRGQLDALTKQLQRDENEAQSLRQDEQALTQQWQAVTASLNITLQPQDDIQPWLDAQDEHERQLRLLSQRHELQGQIAAHNQQIIQYQQQIEQRQQQLLTALAGYALTLPQEDEEESWLATRQQEAQSWQHRQNELTALQNRIQQLTPILETLPQSDELPHSEETVALENWRQVHEQCLALHSQQQTLQQQDVLAAQSLQKAQAQFDTALQASVFDDQQAFLAALMDEQTLTQLEQLKQNLENQRRQAQTLVTQTAETLTQHQQHRPGGLSLTVTVEQIQQELAQTHQKLRENTTSQGEIRQQLKQDADNRQQQQTLMQQIAQMTQQVEDWGYLNSLIGSKEGDKFRKFAQGLTLDNLVHLANQQLTRLHGRYLLQRKASEALEVEVVDTWQADAVRDTRTLSGGESFLVSLALALALSDLVSHKTRIDSLFLDEGFGTLDSETLDTALDALDALNASGKTIGVISHVEAMKERIPVQIKVKKINGLGYSKLESAFAMK

SEQ ID NO: 987 - DNA, 1203 bp, Escherichia coli
atgcgcatccttcacacctcagactggcatctcggccagaacttctacagtaaaagccgcgaagccgaacatcaggcttttcttgactggctgctggagacagcacaagcccatcaggtggatgcgattattgttgccggtgatgttttcgataccggctcgccgcccagttacgcccgcacgttatacaaccgttttgttgtcaatttacagcaaactggctgtcatctggtggtactggcaggaaaccatgactcggtcgccacgctgaatgaatcgcgcgatatcatggcgttcctcaatactaccgtggtcgccagcgccggacatgcgccgcaaatattgccccgtcgcgacgggacgccaggcgcggtgctgtgtcccataccttttttacgcccgcgtgacattattaccagccaggcggggcttaacggtattgaaaaacagcagcatttgctggcggctattactgattattatcaacaacattatgccgatgcctgcaaactgcgcggcgctcagcctctgcccatcatcaccactggacatttaacgaccgtgggtgccagtaaaagtgacgccgtgcgtgacatttatattggcacgctggacgcgtttccggcacaaaactttccaccagccgactacatcgcgctcgggcatattcaccgcgcgcagattattggcggcatggaacatgttcgctattgcggttcccccataccactgagttttgatgaatgcggtaagagtaaatatgtccatctggtgacattttcaaacggcaaattagagagcgtggaaaacctgaacgtaccggtaacgcaacccatggcggtgctgaaaggcgatctggcgtcgattaccgcacagctggaacagtggcgcgatatatcacaggagccgcctgtctggctggatatcgaaatcactactgatgagtatctgcatgatattcagcgcaaaatccaggcattaaccgaatcattgcctgtcgaagttttgctggtacgccggagtcgtgaacagcgcgagcgtgtgttagccagccaacagcgtgaaaccctcagcgaactcagcgtcgaagaggtgttcaatcgccgtctggcactggaagaactggatgaatcacagcagcaacgtctgcagcatcttttcgccacgacgttgcatagcctcgccggagaacacgaagcatga

SEQ ID NO: 988 - protein, 400 aa, Escherichia coli
MRILHTSDWHLGQNFYSKSREAEHQAFLDWLLETAQAHQVDAIIVAGDVFDTGSPPSYARTLYNRFVVNLQQTGCHLVVLAGNHDSVATLNESRDIMAFLNTTVVASAGHAPQILPRRDGTPGAVLCPIPFLRPRDIITSQAGLNGIEKQQHLLAAITDYYQQHYADACKLRGAQPLPIITTGHLTTVGASKSDAVRDIYIGTLDAFPAQNFPPADYIALGHIHRAQIIGGMEHVRYCGSPIPLSFDECGKSKYVHLVTFSNGKLESVENLNVPVTQPMAVLKGDLASITAQLEQWRDISQEPPVWLDIEITTDEYLHDIQRKIQALTESLPVEVLLVRRSREQRERVLASQQRETLSELSVEEVFNRRLALEELDESQQQRLQHLFATTLHSLAGEHEA

SEQ ID NO: 989 - DNA, 132 bp, Escherichia coli
gtgaaggatgcgcataacggttccctggcgaaaaagcatgggcgcgattatacccaaacagatgtgccatttgcttttttctgcgccacggaaatcaataacctgaagatatgtgcgacgagcttttcataa

SEQ ID NO: 990 - protein, 43 aa, Escherichia coli
MKDAHNGSLAKKHGRDYTQTDVPFAFFCATEINNLKICATSFS

SEQ ID NO: 991 - DNA, 690 bp, Escherichia coli
atggcgagacgtattctggtcgtagaagatgaagctccaattcgcgaaatggtctgcttcgtgctcgaacaaaatggctttcagccggtcgaagcggaagattatgacagtgctgtgaatcaactgaatgaaccctggccggatttaattctccttgactggatgttacctggcggctccggtatccagttcatcaaacacctcaagcgcgagtcgatgacccgggatattccagtggtgatgttgaccgccagaggggaagaagaagatcgcgtgcgcggccttgaaaccggtgcggatgactatatcaccaagccgttttctccgaaggagctggtggcgcgaatcaaagcggtaatgcgccgtatttcgccaatggcggtggaagaggtgatcgagatgcaggggctaagtctggacccgacatctcaccgggtgatggcgggcgaagaaccgctggagatggggccgacagaatttaaactgctgcacttttttatgacgcatcctgagcgcgtgtacagtcgcgagcaactgttaaatcacgtatggggaaccaacgtgtatgtggaagatcgtacggtcgatgtccacattcgtcgcctgcgtaaagcactggagcccggcgggcatgaccgcatggtgcagaccgtgcgcggtacagggtatcgtttttcaacccgcttttaa

SEQ ID NO: 992 - protein, 229 aa, Escherichia coli
MARRILVVEDEAPIREMVCFVLEQNGFQPVEAEDYDSAVNQLNEPWPDLILLDWMLPGGSGIQFIKHLKRESMTRDIPVVMLTARGEEEDRVRGLETGADDYITKPFSPKELVARIKAVMRRISPMAVEEVIEMQGLSLDPTSHRVMAGEEPLEMGPTEFKLLHFFMTHPERVYSREQLLNHVWGTNVYVEDRTVDVHIRRLRKALEPGGHDRMVQTVRGTGYRFSTRF

SEQ ID NO: 993 - DNA, 1296 bp, Escherichia coli
gtgctggaacggctgtcgtggaaaaggctggtgctggagctgctactttgctgcctcccggctttcatcctgggtgcattttttggttacctgccctggtttttgctggcatcggtaacaggactgcttatctggcatttctggaatttattgcgcctttcatggtggctgtgggtggatcgtagtatgaccccgccaccggggcgtggtagctgggaaccgctactatacggcttacaccagatgcagctgcgaaataaaaaacgccgccgtgaactgggcaatctgattaaacgctttcgtagcggcgcggagtcgctgcccgacgcggtggtgctgaccacggaagagggcggtattttctggtgcaacggtctggcgcaacagattcttggcttgcgctggccggaagataacgggcagaacatccttaacttgctgcgttacccggagtttacgcaatatctgaaaacgcgtgatttctctcgcccgctcaatctggtgctcaataccgggcggcatctggagattcgcgtcatgccttatacccacaaacagttgctgatggtggcgcgagatgtcacgcaaatgcatcaactggaaggggcgcggcgtaacttttttgccaacgtgagccatgagttacgtacgccattgaccgtgttacagggttacctggagatgatggatgagcaaccgctggaaggcgcggtacgtgaaaaagcgttgcacaccatgcgcgagcagacccagcggatggaagggttggtgaagcaattgctgacgctgtcgaaaatagaagccgcaccgacgcatttgctcaatgaaaaggttgatgtgccgatgatgctgcgcgtcgttgagcgcgaggctcagactctgagtcagaaaaaacagacatttacctttgagatagataacggcctcaaggtgtcaggcaacgaagatcagctacgcagtgcgatttcgaacctggtctataacgccgtgaatcatacgccggaaggcacgcatatcaccgtacgctggcagcgagtgccgcacggtgccgaatttagtgttgaagataacggaccgggcattgcaccggagcatattccgcgcctgaccgagcgtttttatcgcgttgataaagcgcgttcccggcaaaccggcggtagcggattagggttagcgatcgtgaaacatgcggtgaatcatcacgaaagtcgcctgaatattgagagtacagtaggaaaaggtacacgtttcagttttgttatcccggaacgtttaattgccaaaaacagcgattaa

SEQ ID NO: 994 - protein, 431 aa, Escherichia coli
MLERLSWKRLVLELLLCCLPAFILGAFFGYLPWFLLASVTGLLIWHFWNLLRLSWWLWVDRSMTPPPGRGSWEPLLYGLHQMQLRNKKRRRELGNLIKRFRSGAESLPDAVVLTTEEGGIFWCNGLAQQILGLRWPEDNGQNILNLLRYPEFTQYLKTRDFSRPLNLVLNTGRHLEIRVMPYTHKQLLMVARDVTQMHQLEGARRNFFANVSHELRTPLTVLQGYLEMMDEQPLEGAVREKALHTMREQTQRMEGLVKQLLTLSKIEAAPTHLLNEKVDVPMMLRVVEREAQTLSQKKQTFTFEIDNGLKVSGNEDQLRSAISNLVYNAVNHTPEGTHITVRWQRVPHGAEFSVEDNGPGIAPEHIPRLTERFYRVDKARSRQTGGSGLGLAIVKHAVNHHESRLNIESTVGKGTRFSFVIPERLIAKNSD

SEQ ID NO: 995 - DNA, 111 bp, Escherichia coli
atggctaatcatgcgaacaaaaaatcaccaaccgttgtaaaatctaacgcccgtatttcgactgcaaagaaaataagccagcatcggctggcttatggcaataaaagatga

SEQ ID NO: 996 - protein, 36 aa, Escherichia coli
MANHANKKSPTVVKSNARISTAKKISQHRLAYGNKR

SEQ ID NO: 997 - DNA, 150 bp, Escherichia coli
gtgccaatccctggggatgatacagcggtatatttaaacaattttagcgggaaatactcccaaccaggcgcggcgaagaatagtttttcgatttaccgcgtgaatgcagtcagtatgacagcacctgaagcgcaatttaaacgcttataa

SEQ ID NO: 998 - protein, 49 aa, Escherichia coli
MPIPGDDTAVYLNNFSGKYSQPGAAKNSFSIYRVNAVSMTAPEAQFKRL

SEQ ID NO: 999 - DNA, 1320 bp, Escherichia coli
atgacccatcaattaagatcgcgcgatatcatcgctctgggctttatgacatttgcgttgttcgtcggcgcaggtaacattattttccctccaatggtcggcttgcaggcaggcgaacacgtctggactgcggcattcggcttcctcattactgccgttggcctaccggtattaacggtagtggcgctggcaaaagttggcggcggtgttgacagtctcagcacgccaattggtaaagtcgctggcgtactgctggcaacagtttgttacctggcggtggggccgcttttcgctacgccgcgtacagctaccgtttcttttgaagtggggattgcgccgctgacgggtgattccgcgctgccgctgtttatttacagcctggtctatttcgctatcgttattctggtttcgctctatccgggcaagctgctggataccgtgggcaacttccttgcgccgctgaaaattatcgcgctggtcatcctgtctgttgccgcaattatctggccggcgggttctatcagcacggcgactgaggcttatcaaaacgctgcgttttctaacggcttcgtcaacggctatctgaccatggatacgctgggcgcaatggtgtttggtatcgttattgttaacgcggcgcgttctcgtggcgttaccgaagcgcgtctgctgacccgttataccgtctgggctggcctgatggcgggtgttggtctgactctgctgtacctggcgctgttccgtctgggttcagacagcgcgtcgctggtcgatcagtctgcaaacggtgcggcgatcctgcatgcttacgttcagcatacctttggcggcggcggtagcttcctgctggcggcgttaatcttcatcgcctgcctggtcacggcggttggcctgacctgtgcttgtgcagaattcttcgcccagtacgtaccgctctcttatcgtacgctggtgtttatcctcggcggcttctcgatggtggtgtctaacctcggcttgagccagctgattcagatctctgtaccggtgctgaccgccatttatccgccgtgtatcgcactggttgtattaagttttacacgctcatggtggcataattcgtcccgcgtgattgctccgccgatgtttatcagcctgctttttggtattctcgacgggatcaaggcatctgcattcagcgatatcttaccgtcctgggcgcagcgtttaccgctggccgaacaaggtctggcgtggttaatgccaacagtggtgatggtggttctggccattatctgggatcgtgcggcaggtcgtcaggtgacctccagcgctcactaa

SEQ ID NO: 1000 - protein, 439 aa, Escherichia coli
MTHQLRSRDIIALGFMTFALFVGAGNIIFPPMVGLQAGEHVWTAAFGFLITAVGLPVLTVVALAKVGGGVDSLSTPIGKVAGVLLATVCYLAVGPLFATPRTATVSFEVGIAPLTGDSALPLFIYSLVYFAIVILVSLYPGKLLDTVGNFLAPLKIIALVILSVAAIIWPAGSISTATEAYQNAAFSNGFVNGYLTMDTLGAMVFGIVIVNAARSRGVTEARLLTRYTVWAGLMAGVGLTLLYLALFRLGSDSASLVDQSANGAAILHAYVQHTFGGGGSFLLAALIFIACLVTAVGLTCACAEFFAQYVPLSYRTLVFILGGFSMVVSNLGLSQLIQISVPVLTAIYPPCIALVVLSFTRSWWHNSSRVIAPPMFISLLFGILDGIKASAFSDILPSWAQRLPLAEQGLAWLMPTVVMVVLAIIWDRAAGRQVTSSAH

SEQ ID NO: 1001 - DNA, 1377 bp, Escherichia coli
ttgatggaaagtaagaacaagctaaagcgtgggctaagtacccgacacatacgctttatggcactgggttcagcaattggcaccgggctgttttacggttcggcagatgccatcaaaatggccggtccaagcgtgttgttggcctatattatcggtggtatcgcggcgtatatcattatgcgtgcgctgggggaaatgtcggtacataacccggcagccagctctttctcgcgttatgcgcaggaaaacctcggcccgctggcaggttacattaccggctggacctactgctttgaaatccttattgtcgccatcgccgatgtgaccgcttttggtatctatatgggtgtctggttcccgacggtgccgcactggatttgggtactgagtgtggtgctgatcatttgcgccgtaaacctgatgagcgtgaaggtattcggtgagctggagttctggttctcgttctttaaagtcgccactatcatcatcatgattgtcgccggtttcggcatcatcatctgggggattggcaacggcgggcaaccgaccggtattcataacctgtggagcaacggcggcttcttcagtaacggctggcttggtatggtgatgtcgttgcaaatggtgatgtttgcttacggtgggatcgaaattatcgggattaccgccggtgaagcgaaagatcctgagaaatcgattccgcgtgcgattaactccgtgccgatgcgtattctggtgttctacgtcggtacgctgttcgtcattatgtctatctacccgtggaatcaggttggcactgccggtagcccgtttgtgctgacgttccagcatatgggcattacctttgccgccagcattcttaactttgttgtgctgaccgcttcgctgtcggcaattaacagtgacgtatttggtgtaggccgtatgctccacggtatggcagagcagggcagcgcgccaaaaattttcagcaaaacctcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtgtgggtgtggattatgatcctgctgtcgcaaatcgccttccgtcgccgtttgccgccagaagaagttaaggcgctgaaatttaaagtgccgggtggggtagcaacgaccatcggcggtttgattttcctgctctttattatcgggttgattggttatcacccggatacgcgtatctcgctgtatgtcggtttcgcgtggattgttgtgctgttgattggctggatgtttaagcgccgccacgatcgtcagctggctgaaaaccagtaa

SEQ ID NO: 1002 - protein, 458 aa, Escherichia coli
MMESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 1003 - DNA, 1815 bp, Escherichia coli
atgttaaatgcatggcatctgccggtgcccccatttgttaaacaaagcaaagatcaactgctcattacactgtggctgacgggcgaagacccaccgcagcgcattatgctgcgtacagaacacgataacgaagaaatgtcagtaccgatgcataagcagcgcagtcagccgcagcctggcgtcaccgcatggcgggcggcgatcgagctctcctgcggacaacctcggcggcgttatagtttcaaattgctgtggcacgatcgccagcgttggtttacaccgcaaggcttcagccgaatgccgccagcacgactggagcagtttgccattgatgtaccggatatcggcccacaatgggctgcggatcagattttttatcagatcttccctgatcgtttcgcccgtaatcttcctcgtgaagctgaacaggatcatgtctattaccatcacgcagccggacaagagatcatattgcgtgactgggatgaaccggtcacggcgcaggctggcggatcaacgttctatggcggcgatctggacgggataagtgaaaaactgccgtatctgaaaaaacttggcgtgacggcgctgtatctcaatccggtgtttaaagctcccagcgtgcataaatacgataccgaggattatcgccatgtcgatccgcagtttggcggtgatggggcgttgctgcgtttgcgacacaatacgcagcagctgggaatgcgactggtgctggacggcgtgtttaaccacagtggcgattcccatgcctggtttgacaggcacaatcgtggcacggggggagcttgtcacaaccccgaatcaccctggcgtgactggtactcgtttagtgatgatggcacggcgctcgactggctgggctatgccagcttgccgaagctggattatcagtcggaaagtctggtgaatgaaatttatcgcggggaagacagtattgtccgccactggctgaaagcgccgtggaatatggacggctggcggctggatgtggtgcatatgctgggggaagcgggtggggcgcgcaataatttgcagcacgttgccgggatcaccgaagcggcgaaagaaacccagccggatgcgtatattgtcggcgaacattttggcgatgcacggcaatggttacaggccgatgtggaagatgccgccatgaactatcgcggcttcacattcccgttgtggggatttcttgccaacaccgatatctcttacgatccgcagcaaattgacgcccaaacctgtatggtctggatggataattaccgcgcagggctttctcatcaacaacaattacgtatgtttaatcagctcgacagccacgatactgcgcgatttaaaacgctgctcggtcgggatgttgcgcgcctgcccctggcggtggtctggctgttcacctggcctggtgtaccgtgcatttattacggtgatgaagtgggactggatggcaaaaacgatccgttttgccgtaagccgttcccctggcaggtggaaaagcaggattcggcgttattcgcgctgtaccagcgaatgattgcgctgcgtaagaaaagtcaggcgttgcgtcgtggcggctgtcaggtgctgtatgcggaagataacgtggtggtatttgtccgcgtgctgaatcagcagcgtgtactggtggcaatcaaccgtggcgaagcctgtgaagtggtgctacccgcgtcaccgttgcttaatgtcgcgcaatggcaacgcaaagaaggtcacgggcaactgacggacgggattctggctttgcctgccatttcggctacggtgtggatgaattaa

SEQ ID NO: 1004 - protein, 604 aa, Escherichia coli
MLNAWHLPVPPFVKQSKDQLLITLWLTGEDPPQRIMLRTEHDNEEMSVPMHKQRSQPQPGVTAWRAAIELSCGQPRRRYSFKLLWHDRQRWFTPQGFSRMPPARLEQFAIDVPDIGPQWAADQIFYQIFPDRFARNLPREAEQDHVYYHHAAGQEIILRDWDEPVTAQAGGSTFYGGDLDGISEKLPYLKKLGVTALYLNPVFKAPSVHKYDTEDYRHVDPQFGGDGALLRLRHNTQQLGMRLVLDGVFNHSGDSHAWFDRHNRGTGGACHNPESPWRDWYSFSDDGTALDWLGYASLPKLDYQSESLVNEIYRGEDSIVRHWLKAPWNMDGWRLDVVHMLGEAGGARNNLQHVAGITEAAKETQPDAYIVGEHFGDARQWLQADVEDAAMNYRGFTFPLWGFLANTDISYDPQQIDAQTCMVWMDNYRAGLSHQQQLRMFNQLDSHDTARFKTLLGRDVARLPLAVVWLFTWPGVPCIYYGDEVGLDGKNDPFCRKPFPWQVEKQDSALFALYQRMIALRKKSQALRRGGCQVLYAEDNVVVFVRVLNQQRVLVAINRGEACEVVLPASPLLNVAQWQRKEGHGQLTDGILALPAISATVWMN

SEQ ID NO: 1005 - DNA, 639 bp, Escherichia coli
gtgactggggtgagtgaaggcagccaacgaagaggcagtttgaaggatgaagtgtatatgaattttttagctcacctgcatttagcccatctcgcggaaagctcgctttccggcaatttactggctgatttcgtacgcggaaatcctgaagaaagttttccgcccgacgtcgtggctggtattcatatgcatcggcgaatcgacgtattaaccgacaatctgccggaagtccgcgaagcgcgggagtggtttcgtaatgaaacgcgccgtgtcgcgcctattacgctggatgtgatgtgggatcactttctgtcccgccactggtcgcagctgtcgcccgattttccgctacaggaatttacctgttatgcccgggagcaagtgatgactattcttccagactcaccgccacgctttatcaatctgaacaactacttatggtcagagcagtggttggtgcgctatcgcgatatggatttcatccagagcgtgttaaacggcatggcaagccgtcgcccacgtctggatgccctgcgtgactcctggtacgatttagacgcccattacgatgctctcgaaacccgcttctggcagttttatccgcggatgatggagcaggcgtcacgcaaggcgttataa

SEQ ID NO: 1006 - protein, 212 aa, Escherichia coli
MTGVSEGSQRRGSLKDEVYMNFLAHLHLAHLAESSLSGNLLADFVRGNPEESFPPDVVAGIHMHRRIDVLTDNLPEVREAREWFRNETRRVAPITLDVMWDHFLSRHWSQLSPDFPLQEFTCYAREQVMTILPDSPPRFINLNNYLWSEQWLVRYRDMDFIQSVLNGMASRRPRLDALRDSWYDLDAHYDALETRFWQFYPRMMEQASRKAL

SEQ ID NO: 1007 - DNA, 1071 bp, Escherichia coli
atgcgcgttaccgatttctcttttgaattgcccgaatccctgattgcccactatcccatgcctgaacgcagtagctgtcgtttactgtcgctggacgggccgacgggcgcgctgacgcacggtactttcaccgatttactcgataagctcaaccccggcgatcttctggtttttaataatacccgcgtgatcccggcgcgcctgtttgggcgtaaagccagcggcggcaagattgaagtgctggttgagcggatgctcgacgaaaaacgcattcttgcgcatattcgcgcctcgaaagcgccaaaacctggcgcagaactgctgctgggcgatgacgaaagtattaacgcaacgatgaccgcgcgccacggcgcactgtttgaagtcgaatttaatgatgatcgtttggtactggatatcctcaacagcatcggccatataccgctgccgccgtatatcgaccgtccggacgaagacgctgaccgcgaactttatcaaacagtttatagcgaaaaaccgggcgcggttgcagctccgaccgctggtctgcattttgacgagcctttgctggaaaaattacgcgccaaaggcgtggagatggcgtttgtgacgttgcacgttggtgcgggcaccttccagccggtgcgcgtcgacaccattgaagatcacatcatgcactcggaatacgctgaagtgccgcaggatgtggtagacgcggtactggcggcgaaagcgcgcggtaaccgggtgattgcggttggtaccacctcagtacgttcgctggaaagtgcggctcaggcagcgaaaaacgatctcattgaaccgttctttgacgatacccaaatctttatctatccgggcttccagtacaaagtggtcgatgcgctggtgacgaacttccaccttccggaatcgacgctgattatgctggtttcggcatttgctggttatcaacacaccatgaatgcctataaagcggcggtagaagagaaatatcgcttttttagttacggtgatgcgatgtttatcacgtacaatccgcaggcaattaatgagcgcgttggggagtaa

SEQ ID NO: 1008 - protein, 356 aa, Escherichia coli
MRVTDFSFELPESLIAHYPMPERSSCRLLSLDGPTGALTHGTFTDLLDKLNPGDLLVFNNTRVIPARLFGRKASGGKIEVLVERMLDEKRILAHIRASKAPKPGAELLLGDDESINATMTARHGALFEVEFNDDRLVLDILNSIGHIPLPPYIDRPDEDADRELYQTVYSEKPGAVAAPTAGLHFDEPLLEKLRAKGVEMAFVTLHVGAGTFQPVRVDTIEDHIMHSEYAEVPQDVVDAVLAAKARGNRVIAVGTTSVRSLESAAQAAKNDLIEPFFDDTQIFIYPGFQYKVVDALVTNFHLPESTLIMLVSAFAGYQHTMNAYKAAVEEKYRFFSYGDAMFITYNPQAINERVGE

SEQ ID NO: 1009 - DNA, 1128 bp, Escherichia coli
atgaaatttgaactggacaccaccgacggtcgcgcacgccgtggccgcctggtctttgatcgtggcgtagtggaaacgccttgttttatgcctgttggcacttacggcaccgtaaaagggatgacgccggaagaagttgaagccactggcgcgcaaattatcctcggcaacaccttccacctgtggctgcgcccgggccaggaaatcatgaaactgcacggcgatctgcacgattttatgcagtggaaaggaccaatccttaccgactccggcggcttccaggtcttcagccttggtgatattcgtaaaatcaccgaacagggcgttcacttccgcaacccgatcaacggcgacccgattttcctcgacccggaaaagtcgatggagattcagtacgatcttggttcggatatcgtcatgatctttgatgagtgtacgccgtatcctgctgactgggattacgcaaaacgctccatggagatgtctctgcgttgggcgaagcgtagccgtgagcgttttgacagtctcggaaacaaaaatgcgctgtttggtatcattcagggcagtgtttacgaagatttacgtgatatttctgttaaaggtctggtagatatcggttttgatggctacgctgtcggcggtctggctgtgggtgagccgaaagcagatatgcaccgcattctggagcatgtatgcccgcaaattccggcagacaaaccgcgttacctgatgggcgttggtaaaccagaagacctggttgagggcgtacgtcgcggtatcgatatgtttgactgcgtaatgccaacccgcaacgcccgaaatggtcatttgttcgtgaccgatggcgtggtgaaaatccgcaatgcgaagtataagagcgatactggcccactcgatcctgagtgtgattgctacacctgtcgcaattattcacgcgcttacttgcatcatctcgaccgttgcaacgaaatattaggcgcgcgactcaacaccattcataaccttcgttactaccagcgtttgatggcgggtttacgcaaggctattgaagagggtaaattagagagcttcgtaactgatttttaccagcgtcaggggcgagaagtaccacctttgaacgttgattaa

SEQ ID NO: 1010 - protein, 375 aa, Escherichia coli
MKFELDTTDGRARRGRLVFDRGVVETPCFMPVGTYGTVKGMTPEEVEATGAQIILGNTFHLWLRPGQEIMKLHGDLHDFMQWKGPILTDSGGFQVFSLGDIRKITEQGVHFRNPINGDPIFLDPEKSMEIQYDLGSDIVMIFDECTPYPADWDYAKRSMEMSLRWAKRSRERFDSLGNKNALFGIIQGSVYEDLRDISVKGLVDIGFDGYAVGGLAVGEPKADMHRILEHVCPQIPADKPRYLMGVGKPEDLVEGVRRGIDMFDCVMPTRNARNGHLFVTDGVVKIRNAKYKSDTGPLDPECDCYTCRNYSRAYLHHLDRCNEILGARLNTIHNLRYYQRLMAGLRKAIEEGKLESFVTDFYQRQGREVPPLNVD

SEQ ID NO: 1011 - DNA, 363 bp, Escherichia coli
ttgattaatattaataatgagggaaatttaatgagcttttttatttctgatgcggtagcggcaacgggtgcaccggcgcaaggtagcccgatgtctttgattttgatgctggtggtattcggtctgattttctatttcatgatcctgcgtccacagcagaagcgcaccaaagaacacaaaaagctgatggactccatcgctaaaggtgatgaagtgctgacgaacggtggcctggtcggtcgcgtaaccaaagtagcggaaaacggctacattgctatcgcactgaatgacaccactgaagtagttattaaacgtgacttcgtagctgccgttctgccgaaaggcaccatgaaggcgctgtaa

SEQ ID NO: 1012 - protein, 120 aa, Escherichia coli
MININNEGNLMSFFISDAVAATGAPAQGSPMSLILMLVVFGLIFYFMILRPQQKRTKEHKKLMDSIAKGDEVLTNGGLVGRVTKVAENGYIAIALNDTTEVVIKRDFVAAVLPKGTMKAL

SEQ ID NO: 1013 - DNA, 1815 bp, Escherichia coli
atgctgatcgtggtgattgtcatcggtctgctgtatgcgcttcccaacctgtttggtgaggatccggctgttcagatcactggtgcgcgcggagtcgccgccagtgagcaaacgctgatccaggtccagaaaacgttacaagaagaaaaaataactgctaagtctgtggcactggaagagggcgctattcttgcgcgcttcgactccactgacacccagctgcgcgctcgtgaagcattaatgggcgttatgggtgacaaatacgtcgtggcgcttaaccttgccccggcaacgccgcgctggctggcagctattcatgctgagccgatgaagctcggccttgacctgcgtggcggcgttcacttcctgatggaagtggatatggacaccgcgcttggcaaactccaggaacaaaatatcgatagcctgcgcagcgacctgcgtgaaaagggcatcccgtataccaccgttcgtaaagaaaacaactacggcctgagcatcactttccgcgatgctaaagctcgtgatgaagccattgcgtatctgagcaagcgccatccggatctggtgattagcagccagggcagcaaccagctgcgtgcggtaatgagcgatgctcgtctgagtgaagcgcgtgaatatgcggtgcagcagaacatcaatatcctgcgtaaccgtgtaaaccaacttggcgtggcggagccggtggttcagcgtcagggtgctgaccgtatcgttgttgaactgccaggtattcaggacactgcgcgtgcgaaagagattctgggtgcgacggcaacgctggaattccgtctggtaaacaccaacgttgatcaggccgctgcggcatccggtcgcgtaccgggcgactctgaagtgaaacagacccgcgaaggtcagccggttgtgctgtacaaacgcgtaattctgaccggtgaccatatcaccgactccacttccagccaggacgaatacaaccagccgcaggttaacatctcgctcgatagcgcgggtggtaacatcatgtctaacttcaccaaggacaacatcggcaaaccgatggcaaccctatttgtggagtacaaagacagcggtaagaaagatgcaaacggtcgtgcggttctggtgaaacaggaagaggtgattaatatcgccaacatccagtctcgtctgggtaacagcttccgtattactggcatcaataacccaagcgaagcgcgtcagctttcactgctgctgcgtgccggtgcgttgatcgcgccgattcagattgttgaagaacgtaccattggcccaaccctgggtatgcagaacattgagcaggggctggaggcttgccttgccggtctgctggtttctattctgttcatgatcatcttctataagaagtttggtctgattgcgaccagtgctctgattgccaacttgatcttgattgtcggtattatgtcgctgttgccaggcgcaacgctgagtatgccaggtatcgcgggtatcgtcttaacccttgcggtagcggtcgatgcgaacgtactgatcaacgaacgtattaaagaagagttgagcaacggacgtactgttcaacaggcaattgatgaaggttatcgtggcgcattcagttccatcttcgatgcgaacatcaccacgctgattaaagtcatcatcctgtatgcagtgggtaccggggcaattaaagggttcgcgattactaccggtatcggtgtggcgacgtcgatgtttaccgcgattgtcggtacgcgtgccatcgtaaacctgctatatggcggcaagcgcgtcaagaagctgtcaatctga

SEQ ID NO: 1014 - protein, 604 aa, Escherichia coli
MLIVVIVIGLLYALPNLFGEDPAVQITGARGVAASEQTLIQVQKTLQEEKITAKSVALEEGAILARFDSTDTQLRAREALMGVMGDKYVVALNLAPATPRWLAAIHAEPMKLGLDLRGGVHFLMEVDMDTALGKLQEQNIDSLRSDLREKGIPYTTVRKENNYGLSITFRDAKARDEAIAYLSKRHPDLVISSQGSNQLRAVMSDARLSEAREYAVQQNINILRNRVNQLGVAEPVVQRQGADRIVVELPGIQDTARAKEILGATATLEFRLVNTNVDQAAAASGRVPGDSEVKQTREGQPVVLYKRVILTGDHITDSTSSQDEYNQPQVNISLDSAGGNIMSNFTKDNIGKPMATLFVEYKDSGKKDANGRAVLVKQEEVINIANIQSRLGNSFRITGINNPSEARQLSLLLRAGALIAPIQIVEERTIGPTLGMQNIEQGLEACLAGLLVSILFMIIFYKKFGLIATSALIANLILIVGIMSLLPGATLSMPGIAGIVLTLAVAVDANVLINERIKEELSNGRTVQQAIDEGYRGAFSSIFDANITTLIKVIILYAVGTGAIKGFAITTGIGVATSMFTAIVGTRAIVNLLYGGKRVKKLSI

SEQ ID NO: 1015 - DNA, 972 bp, Escherichia coli
gtggcacaggaatatactgttgaacaactaaaccacggccgtaaagtctatgactttatgcgctgggactactgggctttcggcatctctggtctgctgttaatcgccgctatcgttattatgggcgtgcgcggctttaactgggggctggattttaccggtggtacggttattgaaattacgctcgaaaaaccggctgaaattgacgtaatgcgtgatgcattgcaaaaagccggttttgaagagccgatgctgcaaaactttggtagcagccacgacatcatggtccgtatgccgcctgctgaaggcgaaaccggcggtcaggtgttgggcagccaggttctgaaggtgattaacgaatccaccaatcagaatgcggcagtgaagcgtattgagttcgtcggtccgagcgtgggggcagaccttgcgcaaaccggtgcgatggcgttgatggcggcgctgctgtctatcctcgtgtacgtaggtttccgctttgagtggcgactggcggcaggggttgttattgcgctggcgcacgacgttatcattacgctgggtattttgtcgttattccatatcgagattgacctgaccattgtggcatcattgatgtcggttatcggttactcgcttaacgacagtatcgtggtatcggaccgtattcgtgaaaacttccgcaagatccgtcgcggtacgccttacgaaatctttaacgtgtccttgacccagacgctgcaccgtaccttgatcacatccggtactaccttgatggttatcctgatgctgtacctcttcggtggtccggtactggaaggcttctcgctgaccatgcttatcggtgtttccatcggtactgcatcttccatctatgtggcatctgcgctggctctgaaactgggtatgaagcgcgaacacatgttgcagcagaaagtggaaaaagaaggggcggatcagccgtcaattctgccttaa

SEQ ID NO: 1016 - protein, 323 aa, Escherichia coli
MAQEYTVEQLNHGRKVYDFMRWDYWAFGISGLLLIAAIVIMGVRGFNWGLDFTGGTVIEITLEKPAEIDVMRDALQKAGFEEPMLQNFGSSHDIMVRMPPAEGETGGQVLGSQVLKVINESTNQNAAVKRIEFVGPSVGADLAQTGAMALMAALLSILVYVGFRFEWRLAAGVVIALAHDVIITLGILSLFHIEIDLTIVASLMSVIGYSLNDSIVVSDRIRENFRKIRRGTPYEIFNVSLTQTLHRTLITSGTTLMVILMLYLFGGPVLEGFSLTMLIGVSIGTASSIYVASALALKLGMKREHMLQQKVEKEGADQPSILP

SEQ ID NO: 1017 - DNA, 417 bp, Escherichia coli
gtgattgcgaaaatccccgcatcttgggaaactgcgcgtaaccctacatttcatccaggtaactttttcatggctatcatcccaaaaaactatgcgcggttagaaagcgactatcgcgaaaaagcattaaaaatctatccgtgggtctgcggtcgctgttcccgcgagtttgtttattccaacctgcgtgaacttaccgttcaccacattgatcacgaccatactaataacccggaagatggcagtaactgggaattactttgtctctattgccacgatcatgagcattcgaaatacaccgaagcggatcagtatggtacgaccgttatcgcaggggaagatgcgcagaaagatgtcggtgaagcgaagtacaacccattcgctgatttgaaagcgatgatgaacaagaagaagtga

SEQ ID NO: 1018 - protein, 138 aa, Escherichia coli
MIAKIPASWETARNPTFHPGNFFMAIIPKNYARLESDYREKALKIYPWVCGRCSREFVYSNLRELTVHHIDHDHTNNPEDGSNWELLCLYCHDHEHSKYTEADQYGTTVIAGEDAQKDVGEAKYNPFADLKAMMNKKK

SEQ ID NO: 1019 - DNA, 933 bp, Escherichia coli
ttgcgcctttttcactcccgcaagggattttcaaacagtggcatacatatgaaaaaaacattactggcagccggtgcggtactggcgctctcttcgtcttttactgtcaacgcagctgaaaacgacaaaccgcagtatctttccgactggtggcaccagagcgttaacgttgtcggaagctatcacacccgtttcggaccgcagctccgcaacgatacctaccttgagtacgaagcattcgctaaaaaagactggttcgacttctatggttatgcggatgcgccggtattcttcggcggtaactccgatgcaaaaggtatctggaaccacggttctccgctgtttatggaaatcgaaccgcgtttctccattgacaagctgaccaatactgaccttagcttcggtccgttcaaagagtggtacttcgcgaacaactacatttacgacatgggtcgtaataaagatggccgccagagcacctggtacatgggtctgggtaccgacatcgatactggtctgccgatgagcctgtccatgaacgtctatgcgaaataccagtggcagaactacggcgcagcgaacgaaaacgagtgggacggttaccgtttcaaagtgaagtactttgtgccgattaccgatctgtggggcggccagttgagctacatcggcttcaccaacttcgactggggttccgacctgggcgatgacagcggttatgcgaacaacggtattaaaacacgtaccaataactctattgcgtccagccatattctggcgctgaattacgatcactggcactactctgtcgttgcccgttactggcataacggtggtcagtggaatgacgatgcagaactgaacttcggcaacggcaacttcaacgttcgctctaccggctggggtggttatctggtagtaggttacaacttctaa

SEQ ID NO: 1020 - protein, 310 aa, Escherichia coli
MRLFHSRKGFSNSGIHMKKTLLAAGAVLALSSSFTVNAAENDKPQYLSDWWHQSVNVVGSYHTRFGPQLRNDTYLEYEAFAKKDWFDFYGYADAPVFFGGNSDAKGIWNHGSPLFMEIEPRFSIDKLTNTDLSFGPFKEWYFANNYIYDMGRNKDGRQSTWYMGLGTDIDTGLPMSLSMNVYAKYQWQNYGAANENEWDGYRFKVKYFVPITDLWGGQLSYIGFTNFDWGSDLGDDSGYANNGIKTRTNNSIASSHILALNYDHWHYSVVARYWHNGGQWNDDAELNFGNGNFNVRSTGWGGYLVVGYNF

SEQ ID NO: 1021 - DNA, 600 bp, Escherichia coli
atgctttcactgcttttaccctctaccattaggctaattgcgacgagaaagggacgacctatgaatactaacgtttttcgactgctcctgctgggaagcctgttcagccttagcgcctgtgtgcagcaaagtgaagtgcgacagatgaaacacagcgtcagcacgctgaaccaggagatgacgcagctcaataaagaaacggtcaaaatcactcagcaaaacaggctgaatgcaaaatccagcagtggggtttaccttctgcctggagcaaaaacaccagcaagactggaaagccagatcggtactttacgtatgtcgctggtgaatattacgcctgatacagatggcaccaccctgacgctacgtattcagggcgaatctaatgaccctttacccgcattcagcggaaccgttgaatatgggcaaattcagggaacaatagacaactttcaggaaatcaatgtgcagaatcaattgattaacgcacctgccagcgtcctcgcccccagcgatgttgatattccgttacagttaaagggtatgtctgtggatcagttaggctttgtacgtatccacgacattcaacctgttatgcagtaa

SEQ ID NO: 1022 - protein, 199 aa, Escherichia coli
MLSLLLPSTIRLIATRKGRPMNTNVFRLLLLGSLFSLSACVQQSEVRQMKHSVSTLNQEMTQLNKETVKITQQNRLNAKSSSGVYLLPGAKTPARLESQIGTLRMSLVNITPDTDGTTLTLRIQGESNDPLPAFSGTVEYGQIQGTIDNFQEINVQNQLINAPASVLAPSDVDIPLQLKGMSVDQLGFVRIHDIQPVMQ

SEQ ID NO: 1023 - DNA, 450 bp, Escherichia coli
atgcattgcccattctgtttcgccgtggacactaaggtaattgactctcgtctcgtgggcgagggttcatccgtacgccgccgtcggcagtgtctggtgtgtaatgaacgtttcaccacctttgaagtggcggagctggttatgccgcgtgttgtaaaaagcaacgacgtgcgtgaaccgtttaatgaagagaaattacgtagcggaatgctgcgggcgctggaaaaacgtccggtgagttccgatgacgtcgaaatggcaatcaatcatataaaatcgcagctgcgcgccaccggtgagcgcgaagtgccgagcaagatgattggcaatctggtgatggagcaattgaaaaagctcgataaagtcgcctatatccgttttgcctctgtctaccgcagtttcgaagatatcaaagaatttggcgaagagatcgcgcgcctggaggactaa

SEQ ID NO: 1024 - protein, 149 aa, Escherichia coli
MHCPFCFAVDTKVIDSRLVGEGSSVRRRRQCLVCNERFTTFEVAELVMPRVVKSNDVREPFNEEKLRSGMLRALEKRPVSSDDVEMAINHIKSQLRATGEREVPSKMIGNLVMEQLKKLDKVAYIRFASVYRSFEDIKEFGEEIARLED

SEQ ID NO: 1025 - DNA, 1086 bp, Escherichia coli
atggcgcgggcgctaaagctggcgcaacgaggacgttttaccacgcatcccaacccgaatgtcgggtgcgtcattgtcaaagatggcgaaattgtcggtgaaggttaccatcaacgcgcgggtgaaccgcatgccgaggtacaggcgttgcgcatggccggcgaaaaagccaaaggcgcaacggcgtatgtcacactcgaaccctgtagccatcatggtcgtacgccaccgtgttgtgatgcattaattgctgcgggcgtggcgcgcgtggttgctgcaatgcaagaccccaatccgcaggtcgctggacgtggactttaccgtttgcaacaggctggcattgacgtcagccacgggctgatgatgagtgaagctgagcaattgaataaaggctttctcaagcggatgcgcaccggctttccttatattcagttaaaacttggcgcatcgcttgatggtcgcacggcgatggcgagtggcgaaagccagtggatcacttcacctcaggcgcgacgcgacgtacaacgactgcgcgcgcaaagtcatgccattttaaccagcagcgccacggtgctggcggatgatccagccttaacagtgcgttggtctgaactggatgaacaaactcaggggctctacccgcaacaaaatctccgtcagccagtacgtattgtgattgatagccaaaatcgcgtgacgccggaacatcgcattgtgcagcagcccggcgaaacctggttcgcgcgtacgcaggaagattctcgtgagtggccggaaacggtgcgtaccttgctgattccagagcataaaggtcacctggatctggttgtactaatgatgcaactgggtaaacagcagattaacagcatctgggtggaagcggggccaacgctcgctggcgcattgctacaggcgggtttagtcgatgagctgattgtctatatcgcacctaaactattaggcaacgacgcccgtggattatgcacgctgccagggcttgagaaattagccgacgctccccaatttaaattcaaagagatacgtcatgtaggcccggatgtttgcctgcatttagtgggtgcatga

SEQ ID NO: 1026 - protein, 361 aa, Escherichia coli
MARALKLAQRGRFTTHPNPNVGCVIVKDGEIVGEGYHQRAGEPHAEVQALRMAGEKAKGATAYVTLEPCSHHGRTPPCCDALIAAGVARVVAAMQDPNPQVAGRGLYRLQQAGIDVSHGLMMSEAEQLNKGFLKRMRTGFPYIQLKLGASLDGRTAMASGESQWITSPQARRDVQRLRAQSHAILTSSATVLADDPALTVRWSELDEQTQGLYPQQNLRQPVRIVIDSQNRVTPEHRIVQQPGETWFARTQEDSREWPETVRTLLIPEHKGHLDLVVLMMQLGKQQINSIWVEAGPTLAGALLQAGLVDELIVYIAPKLLGNDARGLCTLPGLEKLADAPQFKFKEIRHVGPDVCLHLVGA

SEQ ID NO: 1027 - DNA, 567 bp, Escherichia coli
gtgcatgatctcccggctcgaaagggaagcagcgcacgaaatattatgctaaaatccgcccccctgcggggccatactcgaacccgaaggaagaaaatgaacattattgaagctaacgttgctaccccggacgctcgcgtcgccatcaccatcgcgcgtttcaacaactttatcaatgacagcctgctggaaggtgcaattgacgcactgaaacgtatcggtcaggtaaaagatgaaaacattaccattgtttgggtgccaggtgcctatgagctgccgctggcggcgggtgcactggctaaaaccggtaaatacgacgcggtgattgcgctgggtacggttattcgtggtggcactgcccactttgaatatgtcgctggtggtgcaagcaacggcctggcgcatgttgcccaggacagcgaaattccggttgcttttggtgttctgaccactgaaagcattgaacaagcgatcgaacgtgctggcaccaaagctggcaacaaaggtgcagaagctgcactgaccgcgcttgaaatgattaatgtattgaaagccatcaaggcctga

SEQ ID NO: 1028 - protein, 188 aa, Escherichia coli
MHDLPARKGSSARNIMLKSAPLRGHTRTRRKKMNIIEANVATPDARVAITIARFNNFINDSLLEGAIDALKRIGQVKDENITIVWVPGAYELPLAAGALAKTGKYDAVIALGTVIRGGTAHFEYVAGGASNGLAHVAQDSEIPVAFGVLTTESIEQAIERAGTKAGNKGAEAALTALEMINVLKAIKA

SEQ ID NO: 1029 - DNA, 420 bp, Escherichia coli
gtgaaacctgctgctcgtcgccgcgctcgtgagtgtgccgtccaggcgctctactcctggcagttgtcccagaacgacatcgctgatgttgaataccagttcctggctgaacaggatgtaaaagacgttgacgtcctgtacttccgtgagctgctggccggggtggcgactaacaccgcatacctcgacggactgatgaagccgtacctgtcccgtctgctggaagaactgggccaggtagaaaaagcagtactgcgcattgcgctgtacgagctgtctaaacgtagcgatgtgccatacaaagtggccattaacgaagcgatcgaactggcgaaatcgttcggcgcagaagacagccataagttcgtcaacggcgtactcgataaagcagcacctgtgattcgccctaacaaaaagtaa

SEQ ID NO: 1030 - protein, 139 aa, Escherichia coli
MKPAARRRARECAVQALYSWQLSQNDIADVEYQFLAEQDVKDVDVLYFRELLAGVATNTAYLDGLMKPYLSRLLEELGQVEKAVLRIALYELSKRSDVPYKVAINEAIELAKSFGAEDSHKFVNGVLDKAAPVIRPNKK

SEQ ID NO: 1031 - DNA, 978 bp, Escherichia coli
atggcatgtggcgagttctccctgattgcccgttattttgaccgtgtaagaagttctcgtcttgatgtcgaactgggcatcggcgacgattgcgctcttctcaatatccccgagaaacagaccctggcgatcagcactgatacgctggtggcgggcaaccacttcctccctgatatcgatcctgctgatctggcttataaagcactggcggtgaacctaagcgatctggcagcgatgggggccgatccggcctggctgacgctggcattaaccttaccggacgtagacgaagcgtggcttgagtccttcagcgacagcttgtttgatcttctcaattattacgatatgcaactcattggcggcgataccacgcgtgggccattatcaatgacgttgggtatccacggctttgttccgatgggacgagccttaacgcgctctggggcgaaaccgggtgactggatctatgtgaccggtacaccgggcgatagcgctgccgggctggcgattttgcaaaaccgtttgcaggttgccgatgctaaagatgcggactacttgatcaaacgtcatctccgtccgtcgccgcgtattttacaggggcaggcactgcgcgatctggcaaattcagctatcgatctctctgacggtctgatttccgatctcgggcatatcgtgaaagccagcgactgcggcgcacgtattgacctggcattgctgccgttttctgatgcgctttctcgccatgttgaaccggaacaggcgctgcgctgggcgctctctggcggtgaagattacgagttgtgtttcacggtgccggaactgaaccgtggcgcgctggatgtggctctcggacacctgggcgtaccgtttacctgtatcgggcaaatgaccgccgatatcgaagggctttgttttattcgtgacggcgaacctgtcacgttagactggaaaggatatgaccattttgccacgccataa

SEQ ID NO: 1032 - protein, 325 aa, Escherichia coli
MACGEFSLIARYFDRVRSSRLDVELGIGDDCALLNIPEKQTLAISTDTLVAGNHFLPDIDPADLAYKALAVNLSDLAAMGADPAWLTLALTLPDVDEAWLESFSDSLFDLLNYYDMQLIGGDTTRGPLSMTLGIHGFVPMGRALTRSGAKPGDWIYVTGTPGDSAAGLAILQNRLQVADAKDADYLIKRHLRPSPRILQGQALRDLANSAIDLSDGLISDLGHIVKASDCGARIDLALLPFSDALSRHVEPEQALRWALSGGEDYELCFTVPELNRGALDVALGHLGVPFTCIGQMTADIEGLCFIRDGEPVTLDWKGYDHFATP

SEQ ID NO: 1033 - DNA, 510 bp, Escherichia coli
ttgccacgccataaagatgtcgcgaaaagtcgcctgaaaatgagtaatccgtggcatctgcttgctgtcggattcggaagtggattaagcccgatcgttcctggcacgatggggtcgctggcggcgattcccttctggtatctgatgacttttttgccctggcagctctattcgctggtggtaatgctggggatctgtatcggcgtctatctttgtcatcaaacggcgaaagacatgggcgtgcacgatcacggcagtattgtctgggacgaatttattggtatgtggattacgctcatggcgctgccgaccaatgactggcagtgggttaccgccggatttgtgattttccgtattctggatatgtggaagccgtggccgatccgctggtttgatcgcaatgtacatggcggcatggggatcatgattgacgatattgtcgccggggtgatctccgctggcatcctgtattttatcggtcatcactggccgctgggtattctgtcgtag

SEQ ID NO: 1034 - protein, 169 aa, Escherichia coli
MPRHKDVAKSRLKMSNPWHLLAVGFGSGLSPIVPGTMGSLAAIPFWYLMTFLPWQLYSLVVMLGICIGVYLCHQTAKDMGVHDHGSIVWDEFIGMWITLMALPTNDWQWVTAGFVIFRILDMWKPWPIRWFDRNVHGGMGIMIDDIVAGVISAGILYFIGHHWPLGILS

SEQ ID NO: 1035 - DNA, 975 bp, Escherichia coli
atgcaatacaaccccttaggaaaaaccgaccttcgtgtttcccgactttgcctcggctgtatgacctttggcgagccagatcgcggtaatcacgcatggacactgccggaagagagcagccgtcccatcattaaacgtgcgctggaaggcggcataaatttctttgacaccgccaatagctattccgatggcagcagcgaagagatcgtcggtcgcgcactgcgggatttcgcccgtcgtgaagacgtggtcgttgcgaccaaagtgttccatcgcgttggtgatttaccggaaggattatcccgtgcacaaattttgcgctctatcgacgacagcctgcgccgtctcggcatggattatgtcgatatcctgcaaattcatcgctgggattacaacacgccgatcgaagagacgctggaagccctgaacgacgtggtaaaagccgggaaagcgcgttatatcggcgcgtcatccatgcacgcttcgcagtttgctcaagcactggaactacaaaaacagcacggctgggcgcagtttgtcagtatgcaggatcactacaatctgatttatcgtgaagaagagcgcgagatgctgccgctgtgttatcaggaaggcgtagcggtgattccatggagcccgctggcgcggggccgtctgacgcgtccttggggagaaaccaccgcacggctggtgtcggatgaagtggggaaaaatctctaccaagaaagcaatgaaaatgacgcacaaattgtagaacgcttaacgggcgtcagtgaagaacttggtgcaacgcgagcacaagttgcgctggcctggttgttgagtaaaccgggcattgccgcaccgattatcggaacttctcgggaggaacagcttgatgaactgctaaacgcggtggatatcaccttgaagccggaacagatcgccgagctggaaacgccgtataaaccgcatccggtcgtaggatttaaatag

SEQ ID NO: 1036 - protein, 324 aa, Escherichia coli
MQYNPLGKTDLRVSRLCLGCMTFGEPDRGNHAWTLPEESSRPIIKRALEGGINFFDTANSYSDGSSEEIVGRALRDFARREDVVVATKVFHRVGDLPEGLSRAQILRSIDDSLRRLGMDYVDILQIHRWDYNTPIEETLEALNDVVKAGKARYIGASSMHASQFAQALELQKQHGWAQFVSMQDHYNLIYREEEREMLPLCYQEGVAVIPWSPLARGRLTRPWGETTARLVSDEVGKNLYQESNENDAQIVERLTGVSEELGATRAQVALAWLLSKPGIAAPIIGTSREEQLDELLNAVDITLKPEQIAELETPYKPHPVVGFK

SEQ ID NO: 1037 - DNA, 1797 bp, Escherichia coli
ttgccgaaagagagtttaccgaaactctgcgacgaactgcgccgctatttactcgacagcgtgagccgttccagcgggcacttcgcctccgggctgggcacggtcgaactgaccgtggcgctgcactatgtctacaataccccgtttgaccagttaatctgggatgtggggcatcaggcttatccgcataaaattttgaccgggcgccgcgacaaaatcggcaccatccgtcagaaaggtggcctgcacccgttcccgtggcgcggcgaaagcgaatatgacgtattaagcgtcgggcattcatcaacctccatcagtgccggaattgggatcgcagttgctgccgagaaagaaggcaaaaatcgccgcaccgtctgtgtcattggcgatggcgcgattactgctggcatggcgtttgaagcgatgaatcacgcgggcgatatccgtcctgatatgctggtggttctcaacgacaatgaaatgtcgatttccgaaaatgttggcgcgctcaacaaccatctggcgcagctgctttccggtaagctttactcttcactgcgcgaaggcggaaaaaaagttttctctggcgtgccacccattaaagagctgctcaaacgtaccgaagaacatattaaaggcatggtagtgcctggcacgttgtttgaagagctgggctttaactacatcggcccggtggacggtcacgatgtgctggggcttatcaccacgcttaagaacatgcgcgacctgaaaggcccgcagttcctgcatatcatgaccaaaaaaggtcgtggttatgaaccggcagaaaaagacccaatcaccttccacgccgtgcctaaatttgatccctccagcggttgtctgccgaaaagtagcggcggtttaccaagctattcaaaaatctttggcgactggttgtgcgaaaccgcagcgaaagataacaagctgatggcgattactccggcgatgcgtgaaggttccggcatggtcgagttttcacgtaaattcccggatcgctacttcgacgtggcaattgccgagcaacacgcagtgacctttgctgcgggtctggcgattggaggctacaaacccattgttgcgatctactccaccttcctgcaacgcgcctatgatcaggtgctgcatgacgtggcgattcaaaagcttccggtcctgttcgccatcgaccgtgcgggcattgttggtgctgacggtcaaacccaccagggcgcttttgatctctcttacctgcgctgcataccggaaatggtcattatgaccccgagcgatgaaaacgaatgtcgccagatgctctataccggctatcactataacgatggcccgtccgcggtgcgctacccgcgcggcaacgcagttggcgtggaactgacgccactggaaaaactgccaattggcaaaggcattgtgaagcgtcgtggtgagaaactggcgatccttaactttggtacgctgatgccagaagcggcgaaagtcgctgaatcgctgaacgctacgctggtcgatatgcgtttcgtgaaaccgcttgatgaagcgttaattctggaaatggccgccagccatgaagcgctggtcaccgtagaagaaaacgccattatgggcggcgcaggtagcggcgtgaacgaagtgctgatggcccatcgtaaaccagtacccgtgctgaacattggcctgcctgacttctttattccacaaggaactcaggaagaaatgcgcgccgaactcggcctcgatgccgccggtatggaagccaaaatcaaggcctggctggcataa

SEQ ID NO: 1038 - protein, 598 aa, Escherichia coli
MPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVVLNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLAILNFGTLMPEAAKVAESLNATLVDMRFVKPLDEALILEMAASHEALVTVEENAIMGGAGSGVNEVLMAHRKPVPVLNIGLPDFFIPQGTQEEMRAELGLDAAGMEAKIKAWLA

SEQ ID NO: 1039 - DNA, 900 bp, Escherichia coli
atggactttccgcagcaactcgaagcctgcgttaagcaggccaaccaggcgctgagccgttttatcgccccactgccctttcagaacactcccgtggtcgaaaccatgcagtatggcgcattattaggtggtaagcgcctgcgacctttcctggtttatgccactggtcatatgttcggcgttagcacaaacacactggacgcacccgctgccgccgtagagtgtatccacgcttactcattaattcatgatgatttaccggcgatggatgatgacgatctgcgtcgcggtttgccgacctgccatgtgaagtttggcgaagcaaacgcgattctcgctggcgatgctttacaaacgctggcgttctcgattttaagcgatgcagatatgccggaagtgtcggatcgcgacagaatttcgatgatttctgaactggcgagcgccagcggtattgccggaatgtgcggtggtcaggcattagatttagacgcggaaggcaaacgcgtacctctggacgcgcttgagcgtatacatcgtcataaaactggcgcattgattcgcgccgccgttcgccttggtgcattaagcgccggagataaagggcgtcgtgctctgccagtactcgacaagtacgcagagagcatcggccttgccttccaggttcaggatgacatcctggatgtggtaggagatactgcaacgttgggaaaacgccagggtgccgatcagcaacttggtaaaagtacctaccctgcacttctgggtcttgagcaagcccggaagaaagcccgggatctgatcgacgatgcccgtcagtcgctgaaacaactggctgaacagtcactcgatacctcggcactggaagcgctagcggactacatcatccagcgtaataaataa

SEQ ID NO: 1040 - protein, 299 aa, Escherichia coli
MDFPQQLEACVKQANQALSRFIAPLPFQNTPVVETMQYGALLGGKRLRPFLVYATGHMFGVSTNTLDAPAAAVECIHAYSLIHDDLPAMDDDDLRRGLPTCHVKFGEANAILAGDALQTLAFSILSDADMPEVSDRDRISMISELASASGIAGMCGGQALDLDAEGKRVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 1041 - DNA, 243 bp, Escherichia coli
atgccgaagaaaaatgaggctcccgccagctttgaaaaggcgctgagcgagctggaacagattgtaacccgtctggaaagtggcgacctgccgctggaagaggcgctgaacgagttcgaacgcggcgtgcagctggcacgtcaggggcaggccaaattacaacaagccgaacagcgcgtacaaattctgctgtctgacaatgaagacgcctctctaaccccttttacaccggacaatgagtaa

SEQ ID NO: 1042 - protein, 80 aa, Escherichia coli
MPKKNEAPASFEKALSELEQIVTRLESGDLPLEEALNEFERGVQLARQGQAKLQQAEQRVQILLSDNEDASLTPFTPDNE

SEQ ID NO: 1043 - DNA, 93 bp, Escherichia coli
gtgcgcagcaaagcgatgttagtggtatacttccgcgcctggatgcagccgcaggtgtgggctgctgtatttttccctatacaagtcgcttaa

SEQ ID NO: 1044 - protein, 30 aa, Escherichia coli
MRSKAMLVVYFRAWMQPQVWAAVFFPIQVA

SEQ ID NO: 1045 - DNA, 1449 bp, Escherichia coli
atgaagtttatcattaaattgttcccggaaatcaccatcaaaagccaatctgtgcgcttgcgctttataaaaatccttaccgggaacattcgtaacgttttaaagcactatgatgagacgctcgctgtcgtccgtcactgggataacatcgaagttcgcgcaaaagatgaaaaccagcgtctggctattcgcgacgccctgacccgtattccgggtatccaccatattctcgaagtcgaagacgtgccgtttaccgacatgcacgatattttcgagaaagcgttggttcaatatcgcgatcagctggaaggcaaaaccttctgcgtacgcgtgaagcgccgcggcaaacatgattttagctcgattgatgtggaacgttacgtcggcggcggtttaaatcagcatattgaatccgcgcgcgtgaagctgaccaatccggaagtgactgtccatctggaagtggaagacgatcgtctgctgctgattaaaggccgctacgaaggtattggcggtttcccgatcggcacccaggaagatgtgttgtcgctcatttccggtggtttcgactccggtgtttccagttatatgttgatgcgtcgcggctgccgcgtgcattactgcttctttaacctcggcggcgcggcgcatgaaattggcgtacgtcaggtggcgcattatctgtggaaccgctttggcagctcccaccgcgtgcgttttgtcgctattaattttgaaccggtcgtcggggaaattctcgagaaaatcgacgacggtcagatgggcgttatcctcaagcgtatgatggtgcgtgccgcgtccaaagtggcagaacgttacggcgtacaggcgctggttaccggtgaagcgctcggccaggtgtccagccagacgctgaccaacctacgcctgattgataacgtctccgatacgctgatcctgcgtccgctgatctcttacgacaaagagcacatcatcaacctggctcgccagattggcaccgaagactttgcccgcacgatgccggaatattgcggcgtgatttccaaaagcccgacggtgaaagcggttaaatcgaagattgaagcggaagaagagaagttcgacttcagcattctcgataaagtggtggaggaagcgaataacgttgatatccgcgaaatcgcccagcagaccgagcaggaagtggtggaagtggaaaccgtcaatggcttcggcccgaacgacgtgatcctcgatatccgttctatcgatgaacaggaagataagccactgaaagtcgaagggattgatgtggtttctctgccgttctataaactgagcaccaaatttggcgatctcgaccagagcaaaacctggctgttgtggtgtgagcgcggggtgatgagccgcctgcaggcgctctatctgcgcgagcagggctttaacaatgtgaaggtgtatcgcccgtaa

SEQ ID NO: 1046 - protein, 482 aa, Escherichia coli
MKFIIKLFPEITIKSQSVRLRFIKILTGNIRNVLKHYDETLAVVRHWDNIEVRAKDENQRLAIRDALTRIPGIHHILEVEDVPFTDMHDIFEKALVQYRDQLEGKTFCVRVKRRGKHDFSSIDVERYVGGGLNQHIESARVKLTNPEVTVHLEVEDDRLLLIKGRYEGIGGFPIGTQEDVLSLISGGFDSGVSSYMLMRRGCRVHYCFFNLGGAAHEIGVRQVAHYLWNRFGSSHRVRFVAINFEPVVGEILEKIDDGQMGVILKRMMVRAASKVAERYGVQALVTGEALGQVSSQTLTNLRLIDNVSDTLILRPLISYDKEHIINLARQIGTEDFARTMPEYCGVISKSPTVKAVKSKIEAEEEKFDFSILDKVVEEANNVDIREIAQQTEQEVVEVETVNGFGPNDVILDIRSIDEQEDKPLKVEGIDVVSLPFYKLSTKFGDLDQSKTWLLWCERGVMSRLQALYLREQGFNNVKVYRP

SEQ ID NO: 1047 - DNA, 591 bp, Escherichia coli
atgagcgcatcggcactggtttgcctcgcccctggtagtgaagagactgaagccgtcaccactatcgacctcttggttcgcggcggtatcaaagtcaccactgccagcgtcgccagcgatggtaacctggcgattacctgctcgcgcggcgtgaagctgctggcggatgcgccgctggttgaagtggctgatggcgaatatgacgtgattgtgctgcctggtggcatcaaaggcgcagagtgttttcgcgatagcaccctgctggttgaaaccgttaaacagttccaccgttccgggcgtatcgtcgcggctatttgcgccgcgccagccaccgtgctggtcccgcacgatatcttcccgattggcaatatgaccggcttcccgacgctgaaagacaaaatacccgccgaacaatggcaggacaagcgcgtcgtctgggatgcacgggtaaaattgctgaccagccaggggccaggtacagctatcgactttggtctgaaaattatcgacctgctggttgggcgcgagaaagcccatgaagtggcatcacaactggtgatggcggcagggatttataattattacgagtag

SEQ ID NO: 1048 - protein, 196 aa, Escherichia coli
MSASALVCLAPGSEETEAVTTIDLLVRGGIKVTTASVASDGNLAITCSRGVKLLADAPLVEVADGEYDVIVLPGGIKGAECFRDSTLLVETVKQFHRSGRIVAAICAAPATVLVPHDIFPIGNMTGFPTLKDKIPAEQWQDKRVVWDARVKLLTSQGPGTAIDFGLKIIDLLVGREKAHEVASQLVMAAGIYNYYE

SEQ ID NO: 1049 - DNA, 912 bp, Escherichia coli
atgaaaattaccgtattgggatgcggtgccttagggcaattatggcttacagcactttgtaaacagggtcacgaagttcagggctggctgcgcgtaccgcaaccttattgtagcgtgaatctggttgagacagatggttcgatatttaacgagtctctgaccgccaacgatcccgattttctcgccaccagcgatctgctcctggtgacgctgaaagcatggcaggtttccgatgccgtcaaaagcctcgcgtccacactgcctgtaaccacgccaatactgttaattcacaacggcatgggcaccatcgaagagttgcaaaacattcagcagccattactgatgggcaccaccacccatgccgctcgccgcgacggcaatgtcattattcatgtggcaaacggtatcacgcatattggtccggcacggcaacaggacggcgattacagttatctggcggatattttgcaaaccgtattgcctgacgtcgcgtggcataacaatattcgcgccgagctgtggcgcaagctggcagtcaactgtgtgattaatccactgaccgccacctggaattgcccgaatggtgaattacgtcatcatccgcaagaaattatgcagatatgcgaagaagtcgcggcagtgatcgaacgcgaagggcatcatacttcagcagaagatttgcgtgattacgtgatgcaggtgattgatgccacagcggaaaatatctcgtcgatgttgcaggatatccgcgcgctgcgccacaccgaaatcgactatatcaatggttttctcttacgccgcgcccgcgcgcatgggattgccgtaccggaaaacacccgcctgtttgaaatggtaaaaagaaaggagagtgaatatgagcgcatcggcactggtttgcctcgcccctggtag

SEQ ID NO: 1050 - protein, 303 aa, Escherichia coli
MKITVLGCGALGQLWLTALCKQGHEVQGWLRVPQPYCSVNLVETDGSIFNESLTANDPDFLATSDLLLVTLKAWQVSDAVKSLASTLPVTTPILLIHNGMGTIEELQNIQQPLLMGTTTHAARRDGNVIIHVANGITHIGPARQQDGDYSYLADILQTVLPDVAWHNNIRAELWRKLAVNCVINPLTATWNCPNGELRHHPQEIMQICEEVAAVIEREGHHTSAEDLRDYVMQVIDATAENISSMLQDIRALRHTEIDYINGFLLRRARAHGIAVPENTRLFEMVKRKESEYERIGTGLPRPW

SEQ ID NO: 1051 - DNA, 660 bp, Escherichia coli
ttgttcctcctcacccgcaaccactccgggtgttcaataaggctatcccttaattgtgcatgctgttgcgactatgcacaattaagggatacgtcctggtgcgggactgtcggttatttaactttgcgggtattatgcttcgcatcaaaaatgaagggagaggaaaagatgccatctttcgatattgtctctgaagttgatcttcaggaagcacgtaacgcggtcgataacgcgagccgcgaagtggagtcccgttttgacttccgtaatgttgaagcttcatttgagctgaatgacgccagcaaaaccatcaaagtgttgagcgagtccgacttccaggtcaatcagttgctggatattctgcgtgccaagctgctgaagcgcggcattgaaggcagttcactggatgtaccggaaaatatcgttcatagcggtaaaacctggtttgtggaagcgaaactgaaacagggcattgagagcgcgactcagaagaaaatcgtcaaaatgatcaaagacagcaaactgaaagtgcaggcgcaaattcagggcgatgagatccgcgtaacgggtaaatctcgtgatgatttacaggctgtcatggcgatggtacgtggtggcgatctcggtcagccgttccagttcaaaaacttccgcgattaa

SEQ ID NO: 1052 - protein, 219 aa, Escherichia coli
MFLLTRNHSGCSIRLSLNCACCCDYAQLRDTSWCGTVGYLTLRVLCFASKMKGEEKMPSFDIVSEVDLQEARNAVDNASREVESRFDFRNVEASFELNDASKTIKVLSESDFQVNQLLDILRAKLLKRGIEGSSLDVPENIVHSGKTWFVEAKLKQGIESATQKKIVKMIKDSKLKVQAQIQGDEIRVTGKSRDDLQAVMAMVRGGDLGQPFQFKNFRD

SEQ ID NO: 1053 - DNA, 1563 bp, Escherichia coli
ttgattttatggtgccggactcgcatacgctgctggctgctgtgtggtaacacaacctctcagttaaaaaggtgctacggcaccttttttcttagcattagaatcatatccctctcgaaatatttactaaaaaatccgcatgtttaccccattcgtttgccgctttacactagtcgcgaatttaaaacagaggtggtaatgaacgattataaaatgacgccaggtgagcggcgcgcgacctggggtttagggaccgtattttcattacgcatgctgggcatgttcatggttctgccggttctgaccacgtacggcatggctctgcaaggtgccagcgaagcattaatcggtattgccattggtatttatggtctgactcaggccgtttttcagattccgtttggcctgctttcagaccgcattggtcgcaaaccattaattgtcggtgggctggcggtgtttgccgccggtagcgttatcgctgcgctctctgactccatctggggaattattctgggccgggcgctacaaggctccggtgcgattgccgctgccgttatggcgctgctttccgatctcacgcgcgaacaaaaccgcaccaaagcgatggcgtttatcggcgtgagctttggcattacctttgccattgcgatggtgcttggcccgatcatcactcacaaacttgggctgcacgtgctgttctggatgatcgctattctggcaacaaccggcattgcgttgaccatttgggttgtgcccaacagtagcactcacgtacttaatcgtgagtccggaatggtgaaaggcagtttcagtaaagtgctggcggaaccgcggctgctgaaactcaactttggcattatgtgtctgcatattttgctgatgtcgacctttgttgccctgcccggacagctggctgatgcggggttcccggcggctgaacactggaaggtctacctggcaacgatgttaatcgcctttggctcggtcgtgcctttcattatctacgctgaagttaagcgcaaaatgaagcaagtctttgtcttttgcgtcgggttgatcgtggtcgcggaaattgtgttgtggaacgcacaaacgcagttctggcaactggtggtcggcgtgcagcttttctttgtggcgtttaatttgatggaagcccttctgccttcacttatcagtaaagaatcgccagcaggttacaaaggtacggcgatgggtgtttactccaccagccagtttcttggcgtggcgattggcggttcgctgggcggctggattgacggcatgtttgacggtcagggcgtatttctcgctggcgcaatgctggccgcagtgtggctggcagtcgccagtaccatgaaagaaccgccgtatgtcagcagcttgcgcattgaaatcccggcgaacattgccgcaaacgaggcgttaaaagtgcgtttgctggaaactgaaggcatcaaagaagtgttgattgcagaagaagaacattcagcttatgtgaaaatcgacagcaaagtgacgaatcgctttgaggttgaacaggcaattcgccaggcataa

SEQ ID NO: 1054 - protein, 520 aa, Escherichia coli
MILWCRTRIRCWLLCGNTTSQLKRCYGTFFLSIRIISLSKYLLKNPHVYPIRLPLYTSREFKTEVVMNDYKMTPGERRATWGLGTVFSLRMLGMFMVLPVLTTYGMALQGASEALIGIAIGIYGLTQAVFQIPFGLLSDRIGRKPLIVGGLAVFAAGSVIAALSDSIWGIILGRALQGSGAIAAAVMALLSDLTREQNRTKAMAFIGVSFGITFAIAMVLGPIITHKLGLHVLFWMIAILATTGIALTIWVVPNSSTHVLNRESGMVKGSFSKVLAEPRLLKLNFGIMCLHILLMSTFVALPGQLADAGFPAAEHWKVYLATMLIAFGSVVPFIIYAEVKRKMKQVFVFCVGLIVVAEIVLWNAQTQFWQLVVGVQLFFVAFNLMEALLPSLISKESPAGYKGTAMGVYSTSQFLGVAIGGSLGGWIDGMFDGQGVFLAGAMLAAVWLAVASTMKEPPYVSSLRIEIPANIAANEALKVRLLETEGIKEVLIAEEEHSAYVKIDSKVTNRFEVEQAIRQA

SEQ ID NO: 1055 - DNA, 891 bp, Escherichia coli
atgatatttaagcaatacctgcaagtaacgaaaccaggcatcatctttggcaacctgatctcggtgattgggggattcttgctggcctcaaagggcagcattgattatcccctgtttatctacacgctggttggggtgtcactggttgtggcgtcgggttgtgtgtttaacaactacatcgacagggatatcgaccgaaagatggaaaggacgaagaatcgggtgctggtgaaaggcctgatctctcctgctgtctcgctggtgtacgccaccttgctgggtattgctggctttatgctgctgtggtttggcgcgaatccgctggcctgctggctgggggtgatgggctttgtggtttatgtcggcgtttatagcctgtacatgaaacgtcattctgtctacggcacattgattggttcgctctccggcgctgcgcctccggtgatcggttactgtgcggtaaccggcgagttcgatagcggcgcagcgatcctgctggctatcttcagcctgtggcagatgcctcactcttatgccatagccattttccgctttaaggattatcaggcggcaaacattccggtactgccggtggtgaaaggcatttcggtggcgaagaatcacatcacgctgtatatcatcgcctttgccgttgccacgctgatgctctctcttggcggctacgctgggtataaatatctggtggtcgccgctgcggtgagcgtctggtggttaggcatggctctgcgcggctataaagttgctgatgacagaatctgggcgcgcaagctgttcggtttctctatcatcgccatcactgccctctcggtgatgatgtccgttgattttatggtgccggactcgcatacgctgctggctgctgtgtggtaa

SEQ ID NO: 1056 - protein, 296 aa, Escherichia coli
MIFKQYLQVTKPGIIFGNLISVIGGFLLASKGSIDYPLFIYTLVGVSLVVASGCVFNNYIDRDIDRKMERTKNRVLVKGLISPAVSLVYATLLGIAGFMLLWFGANPLACWLGVMGFVVYVGVYSLYMKRHSVYGTLIGSLSGAAPPVIGYCAVTGEFDSGAAILLAIFSLWQMPHSYAIAIFRFKDYQAANIPVLPVVKGISVAKNHITLYIIAFAVATLMLSLGGYAGYKYLVVAAAVSVWWLGMALRGYKVADDRIWARKLFGFSIIAITALSVMMSVDFMVPDSHTLLAAVW

SEQ ID NO: 1057 - DNA, 330 bp, Escherichia coli
atgagtcattctaacgcaagcagcggcgcatcccatggcagcgtaaagacctacatgacaggctttatcctgtcgataatcctgacggtaattccgttctggatggtgatgacaggggctgcctctccggccgtaattctgggaacaatcctggcaatggcagtggtacagattctggtgcatctggtgtgcttcctgcacatgaataccaaatcagatgaaggctggaatatgacggcatttgtcttcaccgtgctaatcatcgccatcctggttgtgggctccatttggattatgtggaacctcaactacaacatgatgatgcactaa

SEQ ID NO: 1058 - protein, 109 aa, Escherichia coli
MSHSNASSGASHGSVKTYMTGFILSIILTVIPFWMVMTGAASPAVILGTILAMAVVQILVHLVCFLHMNTKSDEGWNMTAFVFTVLIIAILVVGSIWIMWNLNYNMMMH

SEQ ID NO: 1059 - DNA, 615 bp, Escherichia coli
atggcaactgatactttgacgcacgcgactgcccacgcgcacgaacacgggcaccacgatgcaggcggaaccaaaatcttcggattttggatctacctgatgagcgactgcattctgttctctatcttgtttgctacctatgccgttctggtgaacggcaccgcaggtgggccgacaggtaaggacattttcgaactgccgttcgttctggttgaaactttcttgctgttgttcagctccatcacctacggcatggcggctatcgccatgtacaaaaacaacaaaagccaggttgtctcctggctggcgttgacatggttgtttggtgccggatttatcgggatggaaatctatgaattccatcacctgattgttaacggcatgggtccggatcgcagcggcttcctgtcagcattctttgcgctggtcggcacgcacggtctgcacgtcacttccggtcttatctggatggcggtgctgatggtgcaaatcgcccgtcgcggcctgaccagcactaaccgtacccgcatcatgtgcctgagcctgttctggcacttcctggatgtggtttggatctgtgtgttcactgttgtttatctgatgggggcgatgtaa

SEQ ID NO: 1060 - protein, 204 aa, Escherichia coli
MATDTLTHATAHAHEHGHHDAGGTKIFGFWIYLMSDCILFSILFATYAVLVNGTAGGPTGKDIFELPFVLVETFLLLFSSITYGMAAIAMYKNNKSQVVSWLALTWLFGAGFIGMEIYEFHHLIVNGMGPDRSGFLSAFFALVGTHGLHVTSGLIWMAVLMVQIARRGLTSTNRTRIMCLSLFWHFLDVVWICVFTVVYLMGAM

SEQ ID NO: 1061 - DNA, 1992 bp, Escherichia coli
atgttcggaaaattatcacttgatgcagtcccgttccatgaacctatcgtcatggttacgatcgctggcattattttgggaggtctggcgctcgttggcctgatcacttacttcggtaagtggacctacctgtggaaagagtggctgacctccgtcgaccataaacgcctcggtatcatgtatatcatcgtggcgattgtgatgttgctgcgtggttttgctgacgccattatgatgcgtagccagcaggcccttgcctcggcgggcgaagcgggcttcctgccacctcaccactacgatcagatcttcaccgcgcacggcgtgattatgatcttcttcgtggcgatgcctttcgttatcggtctgatgaacctggtggttccgctgcagatcggcgcgcgtgacgttgcgttcccgttcctcaacaacttaagcttctggtttaccgttgttggtgtgattctggttaacgtttctctcggcgtgggcgaatttgcgcagaccggctggctggcctatccaccgctatcgggaatagagtacagtccgggagtcggtgtcgattactggatatggagtctccagctatccggtataggtacgacgcttaccggtatcaacttcttcgttaccattctaaagatgcgcgcaccgggcatgaccatgttcaagatgccagtatttacctgggcatcactgtgcgcgaacgtactgattattgcttccttcccaattctgacggttaccgtcgcgttgttgaccctggatcgctatctgggcacccatttctttaccaacgatatgggtggcaacatgatgatgtatatcaacctgatttgggcctggggccacccggaagtttacatcttgatcctgcctgtattcggtgtgttctccgaaattgcggcaaccttctcgcgtaaacgtctgtttggttatacctcgctggtatgggcaaccgtctgtatcaccgtgctgtcgttcatcgtctggctgcaccacttctttacgatgggtgcgggcgcgaacgtaaacgccttctttggtatcaccacgatgattatcgccatcccgaccggggtgaagatcttcaactggctgttcaccatgtatcagggccgcatcgtgttccattctgcgatgctgtggaccatcggttttatcgtcaccttctcggtgggcgggatgactggcgtgctgctggcagtaccgggcgcggacttcgttctgcataacagcctgttcctgattgcgcacttccataacgtgatcatcggcggcgtggtcttcggctgcttcgcagggatgacctactggtggcctaaagcgttcggtttcaaactgaacgaaacctggggtaaacgcgcgttctggttctggatcatcggcttcttcgttgcctttatgccactgtatgcgctgggcttcatgggcatgacccgtcgtttgagccagcagattgacccgcagttccacaccatgctgatgattgcagccagcggtgcggtactgattgcgctgggtattctctgcctcgttattcagatgtacgtttctattcgtgaccgcgaccagaaccgtgacctgactggcgacccgtggggtggccgtacgctggagtgggcaacctcttccccgcctccgttctataactttgccgttgtgccgcacgttcacgaacgtgatgcattctgggaaatgaaagagaaaggcgaagcgtacaaaaagcctgaccactatgaagaaattcatatgccaaaaaacagcggtgccggtatcgtcattgcggctttctccaccatcttcggtttcgccatgatctggcatatctggtggctggcgattgttggcttcgcaggcatgatcatcacctggatcgtgaaaagcttcgacgaggacgtggattactacgtgccggtggcagaaatcgaaaaactggaaaaccagcatttcgatgagattactaaggcagggctgaaaaatggcaactga

SEQ ID NO: 1062 - protein, 663 aa, Escherichia coli
MFGKLSLDAVPFHEPIVMVTIAGIILGGLALVGLITYFGKWTYLWKEWLTSVDHKRLGIMYIIVAIVMLLRGFADAIMMRSQQALASAGEAGFLPPHHYDQIFTAHGVIMIFFVAMPFVIGLMNLVVPLQIGARDVAFPFLNNLSFWFTVVGVILVNVSLGVGEFAQTGWLAYPPLSGIEYSPGVGVDYWIWSLQLSGIGTTLTGINFFVTILKMRAPGMTMFKMPVFTWASLCANVLIIASFPILTVTVALLTLDRYLGTHFFTNDMGGNMMMYINLIWAWGHPEVYILILPVFGVFSEIAATFSRKRLFGYTSLVWATVCITVLSFIVWLHHFFTMGAGANVNAFFGITTMIIAIPTGVKIFNWLFTMYQGRIVFHSAMLWTIGFIVTFSVGGMTGVLLAVPGADFVLHNSLFLIAHFHNVIIGGVVFGCFAGMTYWWPKAFGFKLNETWGKRAFWFWIIGFFVAFMPLYALGFMGMTRRLSQQIDPQFHTMLMIAASGAVLIALGILCLVIQMYVSIRDRDQNRDLTGDPWGGRTLEWATSSPPPFYNFAVVPHVHERDAFWEMKEKGEAYKKPDHYEEIHMPKNSGAGIVIAAFSTIFGFAMIWHIWWLAIVGFAGMIITWIVKSFDEDVDYYVPVAEIEKLENQHFDEITKAGLKNGN

SEQ ID NO: 1063 - DNA, 948 bp, Escherichia coli
atgagactcaggaaatacaataaaagtttgggatggttgtcattatttgcaggcactgtattgctcagtggctgtaattctgcgctgttagatcccaaaggacagattggtctggagcaacgttcactgatactgacggcatttggcctgatgttgattgtcgttattcccgcaatcttgatggctgttggtttcgcctggaagtaccgtgcgagcaataaagatgctaagtacagcccgaactggtcacactccaataaagtggaagctgtggtctggacggtacctatcttaatcatcatcttccttgcggtactgacctggaaaaccactcacgctcttgagcctagcaagccgctggcacacgacgagaagcccattaccatcgaagtggtttccatggactggaaatggttcttcatctacccggaacagggcattgcagccgtgaatgaaatcgctttcccggcgaacactccggtgtacttcaaagtgacctccaactccgtgatgaactccttcttcattccgcgtctgggtagccagatttatgccatggccggtatgcagactcgcctgcatctgatcgccaacgaacccggtacttatgacggtatctccgccagctacagcggcccgggcttctcaggcatgaagttcaaagctattgcaacaccggatcgcgccgcattcgaccaatgggtcgcaaaagcgaaacagtcgccgaacaccatgtctgacatggctacgttcgaaaaactggccgcgcctagcgaatacaaccaggtggaatatttctccaacgtgaaaccagacttgtttgccgatgtgattaacaagtttatggctcacggtaagagcatggacatgacccagccagaaggtgagcacagcgcacatgaaggtatggaaggcatggacatgagccacgcggaatccgcccattaa

SEQ ID NO: 1064 - protein, 315 aa, Escherichia coli
MRLRKYNKSLGWLSLFAGTVLLSGCNSALLDPKGQIGLEQRSLILTAFGLMLIVVIPAILMAVGFAWKYRASNKDAKYSPNWSHSNKVEAVVWTVPILIIIFLAVLTWKTTHALEPSKPLAHDEKPITIEVVSMDWKWFFIYPEQGIAAVNEIAFPANTPVYFKVTSNSVMNSFFIPRLGSQIYAMAGMQTRLHLIANEPGTYDGISASYSGPGFSGMKFKAIATPDRAAFDQWVAKAKQSPNTMSDMATFEKLAAPSEYNQVEYFSNVKPDLFADVINKFMAHGKSMDMTQPEGEHSAHEGMEGMDMSHAESAH

SEQ ID NO: 1065 - DNA, 591 bp, Escherichia coli
  n 9, 10, 11, 12, 13: n is any nucleotide
atggaatgnnnnngtgcatctaacgccggttactggctgctgtcgattactgataagcatctctacagcatgggtgcagccgtctttttcgaaaacctctgtggcgggatgggtacatcagcctttgtcgcgctgttaatgacgctgtgtaataagtcattttccgctactcaatttgccctgctctcagcgctttctgctgtagggcgagtttatgtcggccccgtggcgggttggtttgttgaagcacatggctggtcgacattctatctattctccgtcgccgctgccgtaccagggcttattttgctgctggtttgccgccagacgcttgaatatacacgagtaaatggcaactttatctcccgtaccgaatatcctgcaggttatgcctttgccatgtggacactggcggcgggtatcagcctgttggccgtgtggttactgctgttgacaatggacgcgctggatttgacgcacttctctttcctgcctgcgctgctggaagtcggggttttagtcgccctttctggcgttgtgcttggtggtttgctggattatctggcgctacgaaaaacacatctgacgtaa

SEQ ID NO: 1066 - protein, 196 aa, Escherichia coli
  Xaa 3, 4, 5: Xaa is any amino acid
MEXXXASNAGYWLLSITDKHLYSMGAAVFFENLCGGMGTSAFVALLMTLCNKSFSATQFALLSALSAVGRVYVGPVAGWFVEAHGWSTFYLFSVAAAVPGLILLLVCRQTLEYTRVNGNFISRTEYPAGYAFAMWTLAAGISLLAVWLLLLTMDALDLTHFSFLPALLEVGVLVALSGVVLGGLLDYLALRKTHLT

SEQ ID NO: 1067 - DNA, 417 bp, Escherichia coli
  n 399, 400, 401, 402, 403: n is any nucleotide
atgtccagtcaatatttacgtatttttcaacagccgcgttcagccatattgctgatcctgggttttgcttccgggctaccgctcgccctgacgtccggcaccttacaggcctggatgacggtcgagaatatcgatctcaaaaccattggtttcttctctctggtaggccaggcttacgtttttaaattcctctggtcaccactgatggaccgctacacgcccccatttttcgggcggcggcgcggttggctgctcgccacgcaaattctgttattagtcgccattgcggcgatgggttttctcgaaccaggcacccagctccgctggatggcggcactggcggtggtgatcgctttttgctctgcctcccaggatattgtcttcgatgcgtggaaaacnnnnncattcattcattaa

SEQ ID NO: 1068 - protein, 138 aa, Escherichia coli
  Xaa 134, 135: Xaa is any amino acid
MSSQYLRIFQQPRSAILLILGFASGLPLALTSGTLQAWMTVENIDLKTIGFFSLVGQAYVFKFLWSPLMDRYTPPFFGRRRGWLLATQILLLVAIAAMGFLEPGTQLRWMAALAVVIAFCSASQDIVFDAWKTXXFIH

SEQ ID NO: 1069 - DNA, 681 bp, Escherichia coli
atgatgaatttacatgccttacccacttcccctcgccgtaggcaatgttatgatggcgggaatttttaccaaacacgcttaagagtctctgagagcccgaacatgttcaaaaaaatcctcttcccgttagttgctctgtttatgcttgcaggatgcgcaaaaccgccaacaactattgaagtttccccgacgattacactgccacagcaggatccaagcctgatgggcgtcaccgtaagcattaatggtgccgatcagcgtaccgatcaggcgctggcaaaagtcacccgcgataatcaaatcgttaccctgaccgcctcccgcgatctgcgtttcctgctgcaagaagtgctggaaaaacagatgaccgcccgtggatacatggttggtccgaatggcccagttaatctgcaaatcatcgttagccaactgtatgctgacgtgtcccagggcaatgtgcgctacaacatcgcgaccaaagcggatatcgccatcatcgctaccgcgcagaatggcaacaaaatgaccaaaaactatcgtgccagctacaacgttgaaggtgcgttccaggcctccaacaaaaatatcgccgatgcggttaacagtgtgctgaccgataccatcgctgatatgtctcaggacaccagcatccacgaattcatcaagcagaacgcgcgttaa

SEQ ID NO: 1070 - protein, 226 aa, Escherichia coli
MMNLHALPTSPRRRQCYDGGNFYQTRLRVSESPNMFKKILFPLVALFMLAGCAKPPTTIEVSPTITLPQQDPSLMGVTVSINGADQRTDQALAKVTRDNQIVTLTASRDLRFLLQEVLEKQMTARGYMVGPNGPVNLQIIVSQLYADVSQGNVRYNIATKADIAIIATAQNGNKMTKNYRASYNVEGAFQASNKNIADAVNSVLTDTIADMSQDTSIHEFIKQNAR

SEQ ID NO: 1071 - DNA, 351 bp, Escherichia coli
atgacatctcagcgttgtcggaggagatatttcatgatgatacgtgagcggatagaagaaaaattaagggcggcgttccaacccgtattcctcgaagtagtggatgaaagctatcgtcacaatgtcccagccggctctgaaagccattttaaagttgtgctggtcagcgatcgttttacgggtgaacgttttctgaatcgtcatcgaatgatttacagtactttagcggaggaactctctactaccgttcatgcgctggctctgcatacttacactattaaggagtgggaagggttgcaggacaccgtctttgcctctcctccctgtcgtggagcaggaagcatcgcgtaa

SEQ ID NO: 1072 - protein, 116 aa, Escherichia coli
MTSQRCRRRYFMMIRERIEEKLRAAFQPVFLEVVDESYRHNVPAGSESHFKVVLVSDRFTGERFLNRHRMIYSTLAEELSTTVHALALHTYTIKEWEGLQDTVFASPPCRGAGSIA

SEQ ID NO: 1073 - DNA, 264 bp, Escherichia coli
gtgggaagggttgcaggacaccgtctttgcctctcctccctgtcgtggagcaggaagcatcgcgtaaaaacgcatttgcaactgtcggcgcttttccagtatgttgctaaagattttatgaaaaacggcctgcgggccgttttgttttgtctggattttgcgctttttgcccagcattcagacgaaaatcgcccgggaattgtgaaaaaatacgcgacagcgcgcaataaccgttctcgactcataaaagtgatgccgctataa

SEQ ID NO: 1074 - protein, 87 aa, Escherichia coli
MGRVAGHRLCLSSLSWSRKHRVKTHLQLSALFQYVAKDFMKNGLRAVLFCLDFALFAQHSDENRPGIVKKYATARNNRSRLIKVMPL

SEQ ID NO: 1075 - DNA, 180 bp, Escherichia coli
  n 161, 162, 163, 164, 165: n is any nucleotide
atgcaagtttcagttgaaaccactcaaggccttggccgccgtgtaacgattactatcgctgctgacagcatcgagaccgctgttaaaagcgagctggtcaacgttgcgaaaaaagtacgtattgacggcttccgcaaaggcaaagtgccaatgaatatcgnnnnncattccattcattaa

SEQ ID NO: 1076 - protein, 59 aa, Escherichia coli
  Xaa 54, 55: Xaa is any amino acid
MQVSVETTQGLGRRVTITIAADSIETAVKSELVNVAKKVRIDGFRKGKVPMNIXXHSIH

SEQ ID NO: 1077 - DNA, 1083 bp, Escherichia coli
  n 1057, 1058, 1059, 1060, 1061: n is any nucleotide
atgctacgtaaattacgcctgctagttcatcagctcgttgaaagtggtttctttttcagtcactttcgctttcgccagtacagcttcaacagcctgttcttccagagcaacattgcgcatgttgtccatcagttctttgtttttgctgtagaactcgataacttctttcggatcttcgtacgcagaagccatctcttcgatcaggcctttcacgcgctcttcgtcagctttcagctcgttggtgcggataacttcgcccagcagcaggccaacaactacgcggcgtttagcctgttcttcgaacagttcgcgcggcagttccagagcttgtttttcgttgccaccgaaacgctgtgcagcctggcgacgcagaacgtcgatttcgctgtcgatcagcgcagccggtacgtcgatgtcgttagcttttaccagaccttcaatcgcctgagacttaacgcggttacggatggcgctcttcagctcgcgctccatgtttttacgcacttcagcgcgcagaccttctacggaaccatcttcaacgccgaaacgtttgatgaattctgcagtcagttccggcagttcacgctcttcaactttcttcaggttgatagcgaatttcgctgctttacccttcaggttttctgcgtggtactcttccgggaaggtcacgtcgatggtgaactcttcgccagctttgtggcctttgataccgtcttcaaagcccgggatcatgcgaccctgacccatcgccagtacgaaatcagacgctttaccgccttcgaactcttcgccgtcaacagaaccggtgaagtcgatggtcacacggtcttctgcttcaacagcgccgtctttttctttccaggttgcctgctgtttacgcagagtatccagcatgccgtcaacgtcagcatcggtcacttcaacgatcggtttttcaacttcgatcgcttccagaccctgcagttcaacttccggataaacttcaaactctacagagtaggtgaagtcttcacccagcttgtattcgcccggaacataggtcggtgcgccagccggnnnnncattcattcattaattaattaa

SEQ ID NO: 1078 - protein, 360 aa, Escherichia coli
  Xaa 353, 354: Xaa is any amino acid
MLRKLRLLVHQLVESGFFFSHFRFRQYSFNSLFFQSNIAHVVHQFFVFAVELDNFFRIFVRRSHLFDQAFHALFVSFQLVGADNFAQQQANNYAAFSLFFEQFARQFQSLFFVATETLCSLATQNVDFAVDQRSRYVDVVSFYQTFNRLRLNAVTDGALQLALHVFTHFSAQTFYGTIFNAETFDEFCSQFRQFTLFNFLQVDSEFRCFTLQVFCVVLFREGHVDGELFASFVAFDTVFKARDHATLTHRQYEIRRFTAFELFAVNRTGEVDGHTVFCFNSAVFFFPGCLLFTQSIQHAVNVSIGHFNDRFFNFDRFQTLQFNFRINFKLYRVGEVFTQLVFARNIGRCASRXXIHSLIN

SEQ ID NO: 1079 - DNA, 1047 bp, Escherichia coli
  n 8, 9, 10, 11, 12: n is any nucleotide
atgaatgnnnnnccggctggcgcaccgacctatgttccgggcgaatacaagctgggtgaagacttcacctactctgtagagtttgaagtttatccggaagttgaactgcagggtctggaagcgatcgaagttgaaaaaccgatcgttgaagtgaccgatgctgacgttgacggcatgctggatactctgcgtaaacagcaggcaacctggaaagaaaaagacggcgctgttgaagcagaagaccgtgtgaccatcgacttcaccggttctgttgacggcgaagagttcgaaggcggtaaagcgtctgatttcgtactggcgatgggtcagggtcgcatgatcccgggctttgaagacggtatcaaaggccacaaagctggcgaagagttcaccatcgacgtgaccttcccggaagagtaccacgcagaaaacctgaagggtaaagcagcgaaattcgctatcaacctgaagaaagttgaagagcgtgaactgccggaactgactgcagaattcatcaaacgtttcggcgttgaagatggttccgtagaaggtctgcgcgctgaagtgcgtaaaaacatggagcgcgagctgaagagcgccatccgtaaccgcgttaagtctcaggcgattgaaggtctggtaaaagctaacgacatcgacgtaccggctgcgctgatcgacagcgaaatcgacgttctgcgtcgccaggctgcacagcgtttcggtggcaacgaaaaacaagctctggaactgccgcgcgaactgttcgaagaacaggctaaacgccgcgtagttgttggcctgctgctgggcgaagttatccgcaccaacgagctgaaagctgacgaagagcgcgtgaaaggcctgatcgaagagatggcttctgcgtacgaagatccgaaagaagttatcgagttctacagcaaaaacaaagaactgatggacaacatgcgcaatgttgctctggaagaacaggctgttgaagctgtactggcgaaagcgaaagtgactgaaaaagaaaccactttcaacgagctgatgaactag

SEQ ID NO: 1080 - protein, 348 aa, Escherichia coli
  Xaa 3, 4: Xaa is any amino acid
MNXXPAGAPTYVPGEYKLGEDFTYSVEFEVYPEVELQGLEAIEVEKPIVEVTDADVDGMLDTLRKQQATWKEKDGAVEAEDRVTIDFTGSVDGEEFEGGKASDFVLAMGQGRMIPGFEDGIKGHKAGEEFTIDVTFPEEYHAENLKGKAAKFAINLKKVEERELPELTAEFIKRFGVEDGSVEGLRAEVRKNMERELKSAIRNRVKSQAIEGLVKANDIDVPAALIDSEIDVLRRQAAQRFGGNEKQALELPRELFEEQAKRRVVVGLLLGEVIRTNELKADEERVKGLIEEMASAYEDPKEVIEFYSKNKELMDNMRNVALEEQAVEAVLAKAKVTEKETTFNELMN

SEQ ID NO: 1081 - DNA, 624 bp, Escherichia coli
atgtcatacagcggcgaacgagataactttgcaccccatatggcgctggtgccgatggtcattgaacagacctcacgaggtgagcgctcttttgatatctattctcgtctacttaaggaacgcgtcatttttctgactggccaggttgaagatcacatggctaacctgattgtggcgcagatgctgttcctggaagcagaaaacccagaaaaagatatctatctgtacattaactctccaggcggggtgattactgccgggatgtctatctatgacaccatgcagtttatcaagcctgatgtcagcaccatctgtatgggccaggcggcctcgatgggtgctttcttgctgactgcaggggcaaaaggtaaacgtttctgcctgccgaattcgcgcgtgatgattcaccagccgttgggcggctaccagggccaggcgaccgatatcgaaattcatgcccgtgaaattctgaaagttaaagggcgcatgaatgaacttatggcgcttcatacgggtcaatcattagaacagattgaacgtgataccgagcgcgatcgcttcctttctgcccctgaagcggtggaatacggtctggtcgattcgattctgacccatcgtaattga

SEQ ID NO: 1082 - protein, 207 aa, Escherichia coli
MSYSGERDNFAPHMALVPMVIEQTSRGERSFDIYSRLLKERVIFLTGQVEDHMANLIVAQMLFLEAENPEKDIYLYINSPGGVITAGMSIYDTMQFIKPDVSTICMGQAASMGAFLLTAGAKGKRFCLPNSRVMIHQPLGGYQGQATDIEIHAREILKVKGRMNELMALHTGQSLEQIERDTERDRFLSAPEAVEYGLVDSILTHRN

SEQ ID NO: 1083 - DNA, 1275 bp, Escherichia coli
atgacagataaacgcaaagatggctcaggcaaattgctgtattgctctttttgcggcaaaagccagcatgaagtgcgcaagctgattgccggtccatccgtgtatatctgcgacgaatgtgttgatttatgtaacgacatcattcgcgaagagattaaagaagttgcaccgcatcgtgaacgcagtgcgctaccgacgccgcatgaaattcgcaaccacctggacgattacgttatcggtcaggaacaggcgaaaaaagtgctggcggtcgcggtatacaaccactacaaacgtctgcgcaacggagataccagcaatggcgtcgagttgggcaaaagtaacattctgctgatcggtccgaccggttccggtaaaacgctactggccgaaacgctggcgcgcctgctggacgttccgttcaccatggctgacgcaaccacgctgaccgaagccggttatgtgggcgaagacgttgaaaacatcattcagaagctgttgcagaagtgcgattacgacgtacagaaagcgcagcgcgggattgtctacatcgatgaaatcgacaagatttctcgtaagtcagacaacccgtccattacccgagacgtttccggtgaaggcgtacagcaggcactgttgaaactgatcgaaggtacggtagctgctgttccgccgcaaggtgggcgtaaacatccgcagcaggaattcttgcaggttgatacctctaagatcctgtttatctgtggcggtgcgtttgccggtctggataaagtgatttcccatcgtgtagaaaccggctccggtattggttttggcgcgacggtaaaagcgaagtccgacaaagcaagcgaaggcgagctgctggcgcaggttgaaccggaagatctgatcaagtttggtctgatccctgagttcattggtcgtctgccggttgtcgcaacgttgaatgaactgagcgaagaagctctgattcagatcctcaaagagccgaaaaacgccctgaccaagcagtatcaggcgctgtttaatctggaaggcgtggatctggaattccgtgacgaggcgctggatgctatcgctaagaaagcgatggcgcgtaaaaccggcgcccgtggcctgcgttccatcgtagaagccgcactgctcgataccatgtacgatctgccgtccatggaagatgtcgaaaaagtggttatcgacgagtcggtaattgatggtcaaagcaaaccgttgctgatttatggtaagccggaagcgcaacaggcatctggtgaataa

SEQ ID NO: 1084 - protein, 424 aa, Escherichia coli
MTDKRKDGSGKLLYCSFCGKSQHEVRKLIAGPSVYICDECVDLCNDIIREEIKEVAPHRERSALPTPHEIRNHLDDYVIGQEQAKKVLAVAVYNHYKRLRNGDTSNGVELGKSNILLIGPTGSGKTLLAETLARLLDVPFTMADATTLTEAGYVGEDVENIIQKLLQKCDYDVQKAQRGIVYIDEIDKISRKSDNPSITRDVSGEGVQQALLKLIEGTVAAVPPQGGRKHPQQEFLQVDTSKILFICGGAFAGLDKVISHRVETGSGIGFGATVKAKSDKASEGELLAQVEPEDLIKFGLIPEFIGRLPVVATLNELSEEALIQILKEPKNALTKQYQALFNLEGVDLEFRDEALDAIAKKAMARKTGARGLRSIVEAALLDTMYDLPSMEDVEKVVIDESVIDGQSKPLLIYGKPEAQQASGE

SEQ ID NO: 1085 - DNA, 2355 bp, Escherichia coli
atgaatcctgagcgttctgaacgcattgaaatccccgtattgccgctgcgcgatgtggtggtttatccgcacatggtcatccccttatttgtcgggcgggaaaaatccatccgttgtctggaagcggcgatggaccatgataaaaaaattatgctggtcgcgcagaaagaagcttcaacggatgagccgggtgtaaacgatcttttcaccgtcgggaccgtggcctctatattgcagatgctgaaactgcctgacggcaccgtcaaagtgctggtcgaggggttacagcgcgcgcgtatttctgcgctctctgacaatggcgaacacttttctgcgaaggcggagtatctggagtcgccgaccattgatgagcgggaacaggaagtgctggtgcgtactgcaatcagccagttcgaaggctacatcaagctaaacaaaaaaatcccaccagaagtgctgacgtcgctgaatagcatcgacgatccggcgcgtctggcggataccattgctgcacatatgccgctgaaactggctgacaaacagtccgttctggagatgtccgacgttaacgaacgtctggaatatctgatggcaatgatggaatcggaaatcgatctgctgcaggttgagaaacgcattcgcaaccgcgttaaaaagcagatggagaaatcccagcgtgagtactatctgaacgagcaaatgaaagctattcagaaagaactcggtgaaatggacgacgcgccggacgaaaacgaagccctgaagcgcaaaatcgacgcggcgaagatgccgaaagaggcaaaagagaaagcggaagcagagctgcagaagctgaaaatgatgtctccgatgtcggcagaagcgaccgtagtgcgtggatatatcgactggatggtacaggtgccgtggaatgcgcgtagcaaggtcaaaaaagacctgcgtcaggcgcaggaaatccttgataccgaccattatggtctggagcgcgtgaaagatcgtatccttgagtatcttgcggttcaaagccgtgtcaacaaaatcaagggaccgatcctctgcctggtagggccgccgggggtaggtaaaacctccctgggtcagtccatcgccaaagccaccgggcgtaaatatgtccgtatggcgctgggcggcgtgcgtgatgaagcggaaatccgtggtcaccgccgtacttacatcggttctatgccgggtaaactgatccagaaaatggcgaaagtgggcgtgaaaaacccgctgttcctgctcgatgagatcgacaaaatgtcttctgacatgcgtggcgatccggcctccgcactgcttgaagtgctggatccagagcagaacgtagcgttcagcgaccactacctggaagtggattacgatctcagcgacgtaatgtttgtcgctacgtcgaactccatgaacattccggcaccgctgctggatcgtatggaagtgattcgcctctccggttataccgaagatgaaaaactgaacatcgccaaacgtcacctgctgccgaagcagattgaacgtaatgcactgaaaaaaggtgagctgaccgtcgacgatagcgccattatcggcattattcgttactacacccgtgaggcgggcgtgcgtggtctggagcgtgaaatctccaaactgtgtcgcaaagcggttaagcagttactgctcgataagtcattaaaacatatcgaaattaacggagataacctgcatgactacctcggtgttcagcgtttcgactatgggcgcgcggataacgaaaaccgtgtcggccaggtaaccggtctggcgtggacggaagtgggcggtgacttgctgaccattgaaaccgcgtgcgttccggggaaaggtaaactgacctataccggttcgctcggcgaagtgatgcaggagtctattcaggcggcgttaacggtggttcgtgcgcgtgcggaaaaactggggatcaaccctgatttttacgaaaaacgtgacatccacgtccacgtaccggaaggtgcgacgccgaaagatggtccgagtgccggtattgccatgtgcaccgcgctggtttcttgcctgaccggtaacccggttcgtgccgatgtggcaatgaccggtgagatcactctgcgtggtcaggtactgccgatcggtggtttgaaagaaaaactactggcagcgcatcgcggcgggattaaaacagtgttaattccgttcgaaaataaacgcgatctggaagagattcctgacaacgtaattgccgatctggacattcatcctgtgaagcgcattgaggaagttctgactctggcgctacaaaatgaaccgtctggcatgcaggttgtgactgcaaaatag

SEQ ID NO: 1086 - protein, 784 aa, Escherichia coli
MNPERSERIEIPVLPLRDVVVYPHMVIPLFVGREKSIRCLEAAMDHDKKIMLVAQKEASTDEPGVNDLFTVGTVASILQMLKLPDGTVKVLVEGLQRARISALSDNGEHFSAKAEYLESPTIDEREQEVLVRTAISQFEGYIKLNKKIPPEVLTSLNSIDDPARLADTIAAHMPLKLADKQSVLEMSDVNERLEYLMAMMESEIDLLQVEKRIRNRVKKQMEKSQREYYLNEQMKAIQKELGEMDDAPDENEALKRKIDAAKMPKEAKEKAEAELQKLKMMSPMSAEATVVRGYIDWMVQVPWNARSKVKKDLRQAQEILDTDHYGLERVKDRILEYLAVQSRVNKIKGPILCLVGPPGVGKTSLGQSIAKATGRKYVRMALGGVRDEAEIRGHRRTYIGSMPGKLIQKMAKVGVKNPLFLLDEIDKMSSDMRGDPASALLEVLDPEQNVAFSDHYLEVDYDLSDVMFVATSNSMNIPAPLLDRMEVIRLSGYTEDEKLNIAKRHLLPKQIERNALKKGELTVDDSAIIGIIRYYTREAGVRGLEREISKLCRKAVKQLLLDKSLKHIEINGDNLHDYLGVQRFDYGRADNENRVGQVTGLAWTEVGGDLLTIETACVPGKGKLTYTGSLGEVMQESIQAALTVVRARAEKLGINPDFYEKRDIHVHVPEGATPKDGPSAGIAMCTALVSCLTGNPVRADVAMTGEITLRGQVLPIGGLKEKLLAAHRGGIKTVLIPFENKRDLEEIPDNVIADLDIHPVKRIEEVLTLALQNEPSGMQVVTAK

SEQ ID NO: 1087 - DNA, 273 bp, Escherichia coli
gtgaataaatctcaattgatcgacaagattgctgcaggggctgatatctctaaagctgcggctggccgtgcgttagatgctattattgcttccgtaactgaatctctgaaagaaggggatgatgtagcactggtaggttttggtacttttgccgttaaagagcgtgctgcccgtactggccgcaacccgcagaccggtaaagagatcaccatcgctgctgctaaagtaccgagcttccgtgcaggtaaagcactgaaagacgcggtaaactaa

SEQ ID NO: 1088 - protein, 90 aa, Escherichia coli
MNKSQLIDKIAAGADISKAAAGRALDAIIASVTESLKEGDDVALVGFGTFAVKERAARTGRNPQTGKEITIAAAKVPSFRAGKALKDAVN

SEQ ID NO: 1089 - DNA, 1872 bp, Escherichia coli
atgatggacagcttacgcacggctgcaaacagtctcgtgctcaagattattttcggtatcattatcgtgtcgttcatattgaccggcgtgagtggttacctgattggcggaggcaataactacgccgcaaaagtgaatgaccaggaaatcagccgtgggcaattcgagaacgccttcaacagcgagcgtaatcgcatgcagcaacagctgggcgatcaatactccgagctggcagcgaacgaaggctatatgaaaaccctgcgtcaacaggtgctgaatcgtctgatcgacgaggcgcttctggatcagtacgctcgtgagctgaaactgggtatcagcgatgagcaggttaaacaggcgattttcgcgaccccagccttccaggttgacggcaaatttgataacagccgctataacggtatcctcaaccagatggggatgaccgccgatcagtacgcccaggcgctgcgtaaccagctcactacccaacagctgattaacggcgttgccggtaccgattttatgctgaaaggtgaaaccgacgagctggcggcactggtagctcaacaacgcgtggtgcgtgaagcgactatcgatgttaacgcgctggcggcgaagcagcctgtgaccgaacaggaaattgccagctactacgaacaaaacaaaaacaatttcatgacgccggaacaattccgcgtgagttacatcaagctggatgccgcgacgatgcagcaaccggttagcgatgcggatatccagagctactacgatcagcatcaggatcaattcacccagccgcagcgtacccgttacagcatcatccagaccaaaactgaagatgaagcgaaagcggtacttgatgagctgaataagggcggtgattttgctgcattagccaaagaaaaatctgccgatattatctctgcccgcaacggcggtgatatgggttggttagaagatgccactatcccggacgaactgaaaaatgctggtctgaaagaaaaaggccaactgtctggtgttatcaaatcttcggtcggtttcctgattgtgcgtctggacgacattcagccagcgaaagtgaaatcgttagacgaagtacgtgacgacattgcggcgaaagtgaaacacgaaaaagccctcgatgcgtactacgcgctgcagcagaaagtgagcgatgcggcaagcaacgacaccgagtctctggccggtgcagagcaagctgccggcgttaaagccactcagacgggttggttcagcaaagataacctgccggaagagttgaacttcaagccagttgccgacgctatcttcaacggcggtctggtaggtgaaaacggcgcgccgggcatcaactctgacatcatcaccgtagacggcgaccgcgcattcgtgctgcgcatcagcgagcacaaaccggaagcggtgaaaccgttggcagatgttcaggaacaagttaaggcactggttcagcacaacaaagctgaacaacaggcgaaagtggatgctgagaaactgctggttgatttgaaagccggcaaaggtgcggaagctatgcaggctgccggtctgaaatttggcgagccgaaaaccttaagccgttccggtcgtgacccgattagccaggctgcgtttgcactgccactgccagcgaaagacaaaccgagctacggtatggcgaccgatatgcaaggtaatgtggttctgctggcgctggatgaagtgaaacaaggttcaatgccggaagatcagaaaaaagcgatggtgcagggtatcacccagaacaacgcacaaatcgtctttgaagctctgatgagtaacctgcgtaaagaggcgaaaatcaaaattggcgatgcgctggaacagcaataa

SEQ ID NO: 1090 - protein, 623 aa, Escherichia coli
MMDSLRTAANSLVLKIIFGIIIVSFILTGVSGYLIGGGNNYAAKVNDQEISRGQFENAFNSERNRMQQQLGDQYSELAANEGYMKTLRQQVLNRLIDEALLDQYARELKLGISDEQVKQAIFATPAFQVDGKFDNSRYNGILNQMGMTADQYAQALRNQLTTQQLINGVAGTDFMLKGETDELAALVAQQRVVREATIDVNALAAKQPVTEQEIASYYEQNKNNFMTPEQFRVSYIKLDAATMQQPVSDADIQSYYDQHQDQFTQPQRTRYSIIQTKTEDEAKAVLDELNKGGDFAALAKEKSADIISARNGGDMGWLEDATIPDELKNAGLKEKGQLSGVIKSSVGFLIVRLDDIQPAKVKSLDEVRDDIAAKVKHEKALDAYYALQQKVSDAASNDTESLAGAEQAAGVKATQTGWFSKDNLPEELNFKPVADAIFNGGLVGENGAPGINSDIITVDGDRAFVLRISEHKPEAVKPLADVQEQVKALVQHNKAEQQAKVDAEKLLVDLKAGKGAEAMQAAGLKFGEPKTLSRSGRDPISQAAFALPLPAKDKPSYGMATDMQGNVVLLALDEVKQGSMPEDQKKAMVQGITQNNAQIVFEALMSNLRKEAKIKIGDALEQQ

SEQ ID NO: 1091 - DNA, 372 bp, Escherichia coli
atgaaacacggaattaaagcactgctcattaccctgtccctggcctgtgccggaatgtctcatagcgcgctggcggcagcttctgtggcgaaaccgacaacagtagaaaccaaagcggaagctcctgcagcacaaagtaaagcagcagtaccggcgaaagccagtgacgaagaaggcacccgggtcagcattaataatgccagcgcggaagagttagcccgcgcgatgaatggcgttggcctgaagaaagcgcaggcgattgtcagttatcgcgaagagtacggtccgtttaaaacggtggaggatctaaagcaggtgccggggatgggcaattcgctggtggaacgtaatctggcggtattaaccctgtaa

SEQ ID NO: 1092 - protein, 123 aa, Escherichia coli
MKHGIKALLITLSLACAGMSHSALAAASVAKPTTVETKAEAPAAQSKAAVPAKASDEEGTRVSINNASAEELARAMNGVGLKKAQAIVSYREEYGPFKTVEDLKQVPGMGNSLVERNLAVLTL

SEQ ID NO: 1093 - DNA, 399 bp, Escherichia coli
atgcaaacacaaatcaaagttcgtggatatcatctcgacgtttaccagcacgtaaacaacgcccgctaccttgaatttctcgaagaagcccgctggcatgggttggaaaatagcgacagttttcactggatgacggcccataacatcgctttcgtcgtggtcaatatcaatattaactatcgccgcccggcggtattaagcgacctgttaaccattaccagtcagttgcagcaattaaacggtaaaagtggcatcttaagccaggtcattacactggagccggaaggacaggtggtagcggatgcgcttattacgtttgtttgtattgatcttaaaacgcagaaagcattagctctggaaggggaattgcgcgaaaagctggagcagatggttaagtaa

SEQ ID NO: 1094 - protein, 132 aa, Escherichia coli
MQTQIKVRGYHLDVYQHVNNARYLEFLEEARWHGLENSDSFHWMTAHNIAFVVVNININYRRPAVLSDLLTITSQLQQLNGKSGILSQVITLEPEGQVVADALITFVCIDLKTQKALALEGELREKLEQMVK

SEQ ID NO: 1095 - DNA, 696 bp, Escherichia coli
atgaaacgtgctgtcgttgtgttcagtggaggccaggattccaccacctgtctggtgcaggcattacaacaatatgatgaagtccattgcgtgacgttcgattacggtcaacgccatcgcgcagaaatcgacgtggcacgcgaactggcgctgaaactgggggcacgcgcgcataaggtgcttgatgtaacgctgctcaacgagctggcggtcagcagcctgacgcgtgacagcattccggtgcctgattatgaacctgaagccgatggtatcccgaatacgtttgtcccagggcgtaatattttgttcctgacactggcggcaatatatgcgtatcaggtaaaagcagaagccgtaattaccggcgtctgcgaaacggatttctccggctacccggattgccgcgatgagtttgtgaaagcactaaaccatgccgtcagtttgggcatggcgaaagatattcgttttgaaacgccgctgatgtggattgataaagcggaaacctgggcgctggcagattattacggcaagctggatttagtccgtaacgaaacgctgacctgttataacggcattaaaggcgacggttgcggtcattgtgcggcgtgtaatttacgtgccaacggtttgaatcattatctggccgataaaccgacggtgatggcagcgatgaagcagaaaaccgggttgaagtaa

SEQ ID NO: 1096 - protein, 231 aa, Escherichia coli
MKRAVVVFSGGQDSTTCLVQALQQYDEVHCVTFDYGQRHRAEIDVARELALKLGARAHKVLDVTLLNELAVSSLTRDSIPVPDYEPEADGIPNTFVPGRNILFLTLAAIYAYQVKAEAVITGVCETDFSGYPDCRDEFVKALNHAVSLGMAKDIRFETPLMWIDKAETWALADYYGKLDLVRNETLTCYNGIKGDGCGHCAACNLRANGLNHYLADKPTVMAAMKQKTGLK

SEQ ID NO: 1097 - DNA, 1716 bp, Escherichia coli
ttgttccgggtttatatgcgactgctcaaccgtcttaaccagtatcaacgtctgtggcaaccttccgccggaaagccgcaaaccgtcaccgtcagcgaactggccgaacgctgtttttgcagcgaacgccatgttcgtacgctgttgcgtcaggcacaggaggcgggatggctggagtggcaggcgcagtcaggacgcggaaagcgcggacaattacgctttctggtcacgccagaatcgctacgcaatgcgatgatggaacaggcgctggaaaccggaaagcagcaagatgtgctggagctggcgcaactggccccaggtgagctgcgcactctgttacagccgtttatgggcggacaatggcaaaacgatacgcccacgttgcgtattccctactatcgcccgctcgaaccgctacaaccgggctttttgcccggccgtgccgagcagcatctggccgggcagatattttccggcctgacccgcttcgataataatactcagcgcccgattggcgatttagcacatcactgggaaacctctactgacgggttacgctgggatttttatcttcgctcaaccttacactggcataacggcgatgcagtaaaagcctcccacttacaccagcggttattgatgctgttacaactgccagcactggatcaattatttattagcgtgaagcgtattgaagtcacccatccgcagtgtctgaccttctttttacatcgccccgattactggcttgcgcaccgactggcgagctattgcagccatctggcgcatccgcaattcccactgatcggcacaggtccttttcgcttaacacaattcacagcggaactggtgcgcctggagagccatgattattaccatttacgtcatccgctgcttaaagcggttgagtactggataactccgccgcttttcgaaaaagatatgggaaccagttgtcggcatcccgtgcaaatcaccattggcaaaccggaggagctgcaacgggtcagccaggtcagtagcggcatcagtttaggtttttgctatttaacattgcgcaaaagtctccgactgtccctctggcaggcgcgaaaagtaatctccattattcatcaatccggtttattacaaacgttagaagtcggagaaaacctgatcactgccagtcatgcattactgccaggctggactattccgcattggcaagtaccggatgaagttaaactaccgaaaaccttgacgctggtttatcacctaccgatagaacttcataccatggcagaacgcctacaggcgacactggcagcggaaggctgtgaactcacaattatttttcataacgcaaaaaactgggacgacacgaccctactggcacacgcagacctcatgatgggcgacagattaattggcgaagcaccggaatataccctggagcaatggctgcgttgcgatccactgtggccacatgttttcgacgctccagcatatgcacatttgcaatcgacactggacgcagtgcaagtaatgcctgatgaggaaaaccgatttaatgccctgaaagcggtttttagccagttaatggcagatgcgacgctgacgccgctgttcaactatcactatcgcattagcgcccctcccggcgtgaacggtgtgcgactgacaccgcgcggctggtttgaatttaccgaagcctggcttcccgcgccgtcgcaatga

SEQ ID NO: 1098 - protein, 571 aa, Escherichia coli
MFRVYMRLLNRLNQYQRLWQPSAGKPQTVTVSELAERCFCSERHVRTLLRQAQEAGWLEWQAQSGRGKRGQLRFLVTPESLRNAMMEQALETGKQQDVLELAQLAPGELRTLLQPFMGGQWQNDTPTLRIPYYRPLEPLQPGFLPGRAEQHLAGQIFSGLTRFDNNTQRPIGDLAHHWETSTDGLRWDFYLRSTLHWHNGDAVKASHLHQRLLMLLQLPALDQLFISVKRIEVTHPQCLTFFLHRPDYWLAHRLASYCSHLAHPQFPLIGTGPFRLTQFTAELVRLESHDYYHLRHPLLKAVEYWITPPLFEKDMGTSCRHPVQITIGKPEELQRVSQVSSGISLGFCYLTLRKSLRLSLWQARKVISIIHQSGLLQTLEVGENLITASHALLPGWTIPHWQVPDEVKLPKTLTLVYHLPIELHTMAERLQATLAAEGCELTIIFHNAKNWDDTTLLAHADLMMGDRLIGEAPEYTLEQWLRCDPLWPHVFDAPAYAHLQSTLDAVQVMPDEENRFNALKAVFSQLMADATLTPLFNYHYRISAPPGVNGVRLTPRGWFEFTEAWLPAPSQ

SEQ ID NO: 1099 - DNA, 819 bp, Escherichia coli
atggctcgtctggcagcatttgatatggatggcactttattgatgcctgaccatcatttaggtgagaaaaccctctctactttggcgcgactgcgtgaacgcgacattaccctcacttttgccacggggcgtcatgcgctggagatgcagcatattctcggggcgctatcgctggatgcatatttgattactggcaacggaacgcgcgtgcattctctggaaggtgaacttttacatcgtgatgatttacctgcggatgtcgcggagctggtgctgtatcagcaatgggatacccgagcaagcatgcatatcttcaatgacgatggttggtttaccgggaaagagatccctgcgttgttgcaggcatttgtctatagcggttttcgttatcagataatcgatgtcaaaaaaatgccactcggcagcgtcaccaagatctgcttctgtggcgatcacgacgatcttacacgcttgcagatccagctatacgaagcattaggcgagcgtgcacatttatgtttttccgccacggattgcctcgaagtgctgccggtgggctgcaataaaggcgctgcattgacggtgctgacccaacatttaggtttatcgttacgcgattgcatggcctttggtgatgcgatgaacgatcgcgaaatgttaggcagcgtcggtagcggatttattatgggcaatgcgatgccgcaactgcgcgcggagctcccgcatttaccggtgattggacattgccgaaatcaggctgtctctcactatttgacgcactggctggactatccacatctaccttattcccccgaataa

SEQ ID NO: 1100 - protein, 272 aa, Escherichia coli
MARLAAFDMDGTLLMPDHHLGEKTLSTLARLRERDITLTFATGRHALEMQHILGALSLDAYLITGNGTRVHSLEGELLHRDDLPADVAELVLYQQWDTRASMHIFNDDGWFTGKEIPALLQAFVYSGFRYQIIDVKKMPLGSVTKICFCGDHDDLTRLQIQLYEALGERAHLCFSATDCLEVLPVGCNKGAALTVLTQHLGLSLRDCMAFGDAMNDREMLGSVGSGFIMGNAMPQLRAELPHLPVIGHCRNQAVSHYLTHWLDYPHLPYSPE

SEQ ID NO: 1101 - DNA, 567 bp, Escherichia coli
ttgaatttgtcattttgtgccgtggtgcttaaaccgcacagaataaattgtcgcgatttcacctttaaaatagaattaaaagagaaaaaaattctctgtggaagggctatgttagataaaattgaccgtaagctgctggccttgctacagcaggattgcaccctctctttgcaggcactggctgaagccgttaatctgacaaccaccccctgctggaagcgtctgaaacggctggaggacgacggtattcttatcggcaaagtcgccctgctggatccggaaaaaataggcctcggcctgaccgcctttgtgctgataaaaacgcaacatcacagcagcgaatggtattgccgctttgtcacggtggttaccgaaatgccagaagtgctggggttctggcgcatggctggtgaatacgattatctgatgcgcgtccaggttgccgacatgaaacgctacgacgagttttataagcgtctggtaaacagtgtaccggggctgtcggacgtcacttccagtttcgcgatggaacagattaaatacaccacttctttacccatcgaataa

SEQ ID NO: 1102 - protein, 188 aa, Escherichia coli
MNLSFCAVVLKPHRINCRDFTFKIELKEKKILCGRAMLDKIDRKLLALLQQDCTLSLQALAEAVNLTTTPCWKRLKRLEDDGILIGKVALLDPEKIGLGLTAFVLIKTQHHSSEWYCRFVTVVTEMPEVLGFWRMAGEYDYLMRVQVADMKRYDEFYKRLVNSVPGLSDVTSSFAMEQIKYTTSLPIE

SEQ ID NO: 1103 - DNA, 1773 bp, Escherichia coli
gtgcgattatttgctcaattaagctggtatttccgtcgggaatggcgtcgctatctcggggctgtcgccttgcttgtcattatcgcgatgctgcaactggttccgccaaaagtggttggtattgttgttgatggcgtgacagaacaacactttactaccgggcagatcctgatgtggatcgccaccatggtgctgattgccgttgtggtttatctcctgcgttacgtctggcgcgtattgctgtttggtgcgtcttatcaactggctgttgaactgcgtgaagattattaccgccagctaagccggcagcatcctgagttttacctgcgtcatcgcacgggtgacctcatggctcgtgcgaccaatgacgtcgatcgcgtcgtgtttgccgccggagaaggggtgctgacgctggtggattcactggtaatgggctgcgctgtgttgattatgatgtctacgcaaattagctggcagttgaccttatttgccctgttgccgatgccagtgatggcgatcatgatcaagcgcaacggcgatgccttgcatgaacgctttaagctggcacaggcggcgttttccagtcttaatgaccgcacccaggaaagcctcaccagtattcgcatgatcaaagcctttggtctggaagatcgtcagtcggcgttatttgccgcggatgccgaagataccggcaaaaaaaacatgcgggtggcgcgtattgatgctcgtttcgacccgaccatctatatcgcgattggtatggcgaacttgctggcgattggcggcggtagttggatggtggtacagggcagtttaacgctgggccagctcaccagttttataatgtatttaggtctgatgatttggccaatgctggcgctggcatggatgtttaacattgtggaacgtggcagcgcggcgtatagccgaattcgtaccatgctggccgaagcgccagtcgttattgatggtagtgataaggtgccagaaggtcgtggtgaactggatgtgaatattcgccagtttacgtatccgcagactgaccatcctgcgctggaaaacgtcaatttcgccctgaaacccggtcagatggtaggtatttgcgggccgactggttccggcaaaagtaccctgttgtcgctcattcagcgtcatttcgacgtcagcgagggtgatatccgttttcatgatattcctctgacgaagttacaactcgatagctggcgtagccgtctggcggtggtcagccagacaccattccttttttccgacaccgtggcgaacaacatcgcgttgggttgcccgaatgccatccagcaagagattgaacacgtagcgcggttagccagcgtacatgacgatattttgcgtctgccgcaaggttacgacacagaagtgggcgagcgcggcgtgatgctttctggcggacaaaaacagcgtatctccattgctcgagcgttattagtcaacgcggaaatcctcatccttgatgatgcgctttcagcggtggacggacgtacagagcaccagatcctgcataacctgcgtcagtgggggcagggaagaacggtaatcatcagtgcccatcgcctttctgcactgacggaagccagtgaaattattgtgatgcagcacgggcatatcggccagcgtggcaatcatgatgtgctggtacaacaaagcggctggtatcgcgatatgtatcgctatcaacaactggaggcggcgctcgacgacgctccggaaattcgcgaggaggccatcgatgcgtag

SEQ ID NO: 1104 - protein, 590 aa, Escherichia coli
MRLFAQLSWYFRREWRRYLGAVALLVIIAMLQLVPPKVVGIVVDGVTEQHFTTGQILMWIATMVLIAVVVYLLRYVWRVLLFGASYQLAVELREDYYRQLSRQHPEFYLRHRTGDLMARATNDVDRVVFAAGEGVLTLVDSLVMGCAVLIMMSTQISWQLTLFALLPMPVMAIMIKRNGDALHERFKLAQAAFSSLNDRTQESLTSIRMIKAFGLEDRQSALFAADAEDTGKKNMRVARIDARFDPTIYIAIGMANLLAIGGGSWMVVQGSLTLGQLTSFIMYLGLMIWPMLALAWMFNIVERGSAAYSRIRTMLAEAPVVIDGSDKVPEGRGELDVNIRQFTYPQTDHPALENVNFALKPGQMVGICGPTGSGKSTLLSLIQRHFDVSEGDIRFHDIPLTKLQLDSWRSRLAVVSQTPFLFSDTVANNIALGCPNAIQQEIEHVARLASVHDDILRLPQGYDTEVGERGVMLSGGQKQRISIARALLVNAEILILDDALSAVDGRTEHQILHNLRQWGQGRTVIISAHRLSALTEASEIIVMQHGHIGQRGNHDVLVQQSGWYRDMYRYQQLEAALDDAPEIREEAIDA

SEQ ID NO: 1105 - DNA, 1782 bp, Escherichia coli
atgcgtagttttagccaactgtggccgactctcaagcgcctgttagcgtacggttcaccgtggcgtaaaccgttggggattgcggtcctgatgatgtgggttgcggcggcggcagaagtcagtgggccgctgcttatcagctattttatcgacaatatggtagcgaaaaataacctgccgttgaaagtgggtgcagggctggcggcggcgtatgttgggctgcaactgtttgcagccgggctacattacgcgcagtcgctgctgtttaatcgggcggcagtaggcgtagtgcaacagttgcgtaccgacgtgatggatgctgcgttacgccagccattaagcgagtttgatacccaacccgtcgggcaggtgatttcccgcgtcactaatgacactgaagtgatccgcgatctctacgttaccgtagtggcaactgtcctgcgtagcgccgcactggtgggcgcgatgctggtggcgatgttcagcctcgactggcgaatggcgctggtggcgataatgattttcccggtggtgctggtggtaatggtgatatatcagcgttacagcacgccgattgtccgtcgtgtgcgcgcttatctggcggatatcaacgacggctttaacgaaatcatcaatggcatgagcgttatccagcagttccgtcagcaggcgcgatttggcgaacgtatgggtgaggccagtcgttcacactatatggcgaggatgcaaaccctgcgcctcgacggttttctgctgcgtccgctgctgagtctgttttcatcgctcattctttgtggcttgttgatgctgtttggcttctctgccagcggcaccattgaagtgggcgtgttgtatgcgttcatcagttatttggggcgacttaacgaacccttaatcgaactgaccacgcagcaggcgatgctgcaacaggctgttgttgctggtgagcgcgtttttgagctgatggacggaccgcgccagcaatatggcaatgatgatcgcccgttgcagagcggcaccatcgacgtcgataacgtgtcatttgcttatcgcgatgacaatctggtgctaaagaacattaatctctctgtgccttcgcgcaactttgtggcgctggtcgggcataccggcagtggcaaaagcaccctcgccagtttattgatgggctattacccgctaacggaaggtgagattcgccttgatggtcgtccattaagtacgctaagtcacagcgcgctgcgccagggcgtggcaatggtgcagcaagatccggtggtgctggcggataccttcctcgccaacgtgacgctgggacgtgatatctctgaagaacgcgtctggcaggcgctggaaatcgtgcagctggcggagctggcgcgtagcatgagtgatggtatttacacgccgcttggcgagcaggggaataatctctcagtcgggcaaaagcaactgctggcactggcgcgcgtgctggtggagacgccgcaaatcctgatccttgatgaggcaaccgccagcattgactccgggactgaacaggcgattcaacatgctctggcggcggtgcgtgaacatactacgcttgtggtgattgctcaccgcttatcgactattgttgatgccgacaccattctggtgcttcatcgtgggcaagctgtggagcagggcactcaccagcaactgctggcggcccagggacgctactggcagatgtatcaactgcaacttgcgggcgaagagctggcagccagcgtgcgtgaagaggaatcattgagcgcctga

SEQ ID NO: 1106 - protein, 593 aa, Escherichia coli
MRSFSQLWPTLKRLLAYGSPWRKPLGIAVLMMWVAAAAEVSGPLLISYFIDNMVAKNNLPLKVGAGLAAAYVGLQLFAAGLHYAQSLLFNRAAVGVVQQLRTDVMDAALRQPLSEFDTQPVGQVISRVTNDTEVIRDLYVTVVATVLRSAALVGAMLVAMFSLDWRMALVAIMIFPVVLVVMVIYQRYSTPIVRRVRAYLADINDGFNEIINGMSVIQQFRQQARFGERMGEASRSHYMARMQTLRLDGFLLRPLLSLFSSLILCGLLMLFGFSASGTIEVGVLYAFISYLGRLNEPLIELTTQQAMLQQAVVAGERVFELMDGPRQQYGNDDRPLQSGTIDVDNVSFAYRDDNLVLKNINLSVPSRNFVALVGHTGSGKSTLASLLMGYYPLTEGEIRLDGRPLSTLSHSALRQGVAMVQQDPVVLADTFLANVTLGRDISEERVWQALEIVQLAELARSMSDGIYTPLGEQGNNLSVGQKQLLALARVLVETPQILILDEATASIDSGTEQAIQHALAAVREHTTLVVIAHRLSTIVDADTILVLHRGQAVEQGTHQQLLAAQGRYWQMYQLQLAGEELAASVREEESLSA

SEQ ID NO: 1107 - DNA, 477 bp, Escherichia coli
gtgcactgtcatagtgcgttttcattttcaatcttcttaacttcctgctctctttctcgtttttcatttctggcacaccgcttgcaataccttcttcgtgtagcagaaccattaccgaattctgaccggaggggatctatgaagctggtgaccgtgataatcaaaccattcaagctggaagacgttcgtgaagcgttatcttccattggtattcagggcctgaccgtcaccgaagtgaaaggtttcgggcgtcagaaaggacatgccgagctgtaccggggggcggaatacagcgtcaactttctgccaaaagtaaaaattgatgtggcgattgctgatgaccaactcgatgaagtgatcgatatcgtcagcaaggcggcttacaccggaaaaattggcgacggcaaaatcttcgtcgctgaattgcaacgcgtcattcgtattcgtaccggcgaagccgacgaagcggcgctgtaa

SEQ ID NO: 1108 - protein, 158 aa, Escherichia coli
MHCHSAFSFSIFLTSCSLSRFSFLAHRLQYLLRVAEPLPNSDRRGSMKLVTVIIKPFKLEDVREALSSIGIQGLTVTEVKGFGRQKGHAELYRGAEYSVNFLPKVKIDVAIADDQLDEVIDIVSKAAYTGKIGDGKIFVAELQRVIRIRTGEADEAAL

SEQ ID NO: 1109 - DNA, 1287 bp, Escherichia coli
atgaagatagcgacgataaaaactgggcttgcttcactggcgatgctgccgggactggtaatggctgcacctgcggtggccgataaagccgacaatgcgtttatgatgatttgtactgcgctggtgctgtttatgaccgttccggggattgccctgttttatggagggctgattcgtggcaaaaacgtgctgtcgatgctgacgcaggtgaccgtgacgtttgcactggtctgtattctctgggtggtttacggctactcgctggcgtttggcgaaggcaacaacttcttcggcaacattaacgggttgatgctgaaaaacattgaactgacggcggtgatgggcagcatttatcagtatatccacgtggcgtttcagggatcgtttgcctgcattaccgtaggcttgatagttggggcgctggcggaacgaatccgcttctcagctgtgttgatttttgtggtggtatggctgacgctctcttacattccgattgcgcatatggtctggggcggcggtttgctggcttctcacggggcactggatttcgcgggtggcacggtggtgcatattaacgccgcaatcgccggtctggtgggcgcgtatctgataggcaaacgcgtgggcttcggtaaagaggcgtttaaaccgcacaacctgccgatggtcttcaccgggactgctattctctatatcggttggtttggctttaacgccgggtcagcgggcacggcgaatgaaatcgcggcactggcatttgtgaatactgtggtcgcaactgcggcggcaattcttggctggatcttcggtgaatgggcgctgcgtggtaagccttcactgctgggagcgtgttctggcgcgattgccggtctggtcggcgtgacgccagcctgtggttacattggggttggcggcgcgttgattatcggcgtggtagctggtctggcgggcttgtggggcgttaccatgctcaaacgcttgctgcgggtggatgatccctgcgatgtcttcggtgtgcacggcgtttgtggtattgtcggctgtatcatgaccgggatttttgccgccagctcgctgggcggcgtgggcttcgctgaaggtgtgacgatgggccatcagttgctggtacagctggaaagcatcgccattacgattgtctggtctggtgtggtggcatttatcggctacaaactggcggatttgacggttggtctgcgtgtaccggaagagcaggagcgagaagggctggacgtcaacagccacggcgagaatgcctataacgcgtaa

SEQ ID NO: 1110 - protein, 428 aa, Escherichia coli
MKIATIKTGLASLAMLPGLVMAAPAVADKADNAFMMICTALVLFMTVPGIALFYGGLIRGKNVLSMLTQVTVTFALVCILWVVYGYSLAFGEGNNFFGNINGLMLKNIELTAVMGSIYQYIHVAFQGSFACITVGLIVGALAERIRFSAVLIFVVVWLTLSYIPIAHMVWGGGLLASHGALDFAGGTVVHINAAIAGLVGAYLIGKRVGFGKEAFKPHNLPMVFTGTAILYIGWFGFNAGSAGTANEIAALAFVNTVVATAAAILGWIFGEWALRGKPSLLGACSGAIAGLVGVTPACGYIGVGGALIIGVVAGLAGLWGVTMLKRLLRVDDPCDVFGVHGVCGIVGCIMTGIFAASSLGGVGFAEGVTMGHQLLVQLESIAITIVWSGVVAFIGYKLADLTVGLRVPEEQEREGLDVNSHGENAYNA

SEQ ID NO: 1111 - DNA, 861 bp, Escherichia coli
atgagtcaggcgctaaaaaatttactgacattgttaaatctggaaaaaattgaggaaggactctttcgcggccagagtgaagatttaggtttacgccaggtatttggcggccaggtcgtgggtcaggccttgtatgctgcaaaagagaccgtccctgacgagcggctggtacattcttttcacagctactttcttcgccctggcgatagtaagaagccgattatttatgatgtcgaaacgctgcgtgacggtaacagcttcagcgcccgccgggtttctgctattcaaaacggcaaaccgattttttatatgactgcctctttccaggcaccagaagcgggtttcgaacatcaaaaaacaatgccgtccgcgccagcgcctgatggcctgccttcagaaacgcaaatcgcccaatcgctggcgcacctgctgccgccagtgctgaaagataaattcatctgcgatcgtccgctggaagtccgtccggtggagtttcataacccactgaaaggtcacgtcgcagaaccgcatcgtcaggtgtggatccgcgcaaatggtagcgtgccggatgatctgcgcgttcatcagtatctgctcggttatgcttctgatcttaatttcctgccggtagctctacagccgcacggcatcggttttctcgaaccggggattcagattgccaccattgaccattccatgtggttccatcgcccgtttaatttgaatgaatggctgctgtatagcgtggaaagcacctcggcgtccagcgcacgcggctttgtgcgcggtgagttttatacccaggacggcgtgctggttgcctcgaccgttcaggaaggggtgatgcgtaatcacaattaa

SEQ ID NO: 1112 - protein, 286 aa, Escherichia coli
MSQALKNLLTLLNLEKIEEGLFRGQSEDLGLRQVFGGQVVGQALYAAKETVPDERLVHSFHSYFLRPGDSKKPIIYDVETLRDGNSFSARRVSAIQNGKPIFYMTASFQAPEAGFEHQKTMPSAPAPDGLPSETQIAQSLAHLLPPVLKDKFICDRPLEVRPVEFHNPLKGHVAEPHRQVWIRANGSVPDDLRVHQYLLGYASDLNFLPVALQPHGIGFLEPGIQIATIDHSMWFHRPFNLNEWLLYSVESTSASSARGFVRGEFYTQDGVLVASTVQEGVMRNHN

SEQ ID NO: 1113 - DNA, 204 bp, Escherichia coli
gtgctggcgtctgaatatccgcgcttttatctgcgcaagccgccaacgcaatcgcaaccgctaaaccactggccatgtgcacgagtttcattcacttctccttattatcaatgcaccagcgggctaactttcctcgccggaagagtggttaacaaaatagtaacgtcaacaagtgtggcacacatcacgcatttctgcctgtaa

SEQ ID NO: 1114 - protein, 67 aa, Escherichia coli
MLASEYPRFYLRKPPTQSQPLNHWPCARVSFTSPYYQCTSGLTFLAGRVVNKIVTSTSVAHITHFCL

SEQ ID NO: 1115 - DNA, 375 bp, Escherichia coli
gtgctgaccgtgacactttctgacgcgtcgttagccgatgcgccgtcgaaagtgctggcgcagaaagcggtgcgtaccgaaggtaaacagtcaccattcagctttgttctgccatttaacccggcagatgttcagccgaacgcgcgtattctgttgagtgcggcgattaccgtgaatgacaaactggtatttattaccgataccgttcagccggtgatcaaccagggcggaactaaagccgacctgacattggtgccggtgcagcaaaccgccgtgccggttcaggctagcggtggcgcaacgactaccgtaccttcaacttcaccaacccaggtgaatccgtcttcggcagttccagctccaacgcaatattaa

SEQ ID NO: 1116 - protein, 124 aa, Escherichia coli
MLTVTLSDASLADAPSKVLAQKAVRTEGKQSPFSFVLPFNPADVQPNARILLSAAITVNDKLVFITDTVQPVINQGGTKADLTLVPVQQTAVPVQASGGATTTVPSTSPTQVNPSSAVPAPTQY

SEQ ID NO: 1117 - DNA, 411 bp, Escherichia coli
ttgcaacccattgcgtgccagatgctggtttcttgcgcaatgcggcttcactcgggcgtttttccagattatgctgaaaaattacctcaggaagaaaagatggaaaaagaagattcatttccccagcgcgtctggcaaatcgtagccgctattcccgaaggctatgtcaccacttacggtgatgtggcgaaactggcgggatcgccgcgcgccgcgcgccaggtaggcggtgtgttaaagcgtctccccgaaggcagcaccttgccatggcaccgggtggttaatcgccacggcaccatttcactgaccggaccggatttacagcgtcagcgacaggcattactggcagaaggtgtgatggtgtcgggaagcgggcaaatcgacttgcagctttatcgctggaactactaa

SEQ ID NO: 1118 - protein, 136 aa, Escherichia coli
MQPIACQMLVSCAMRLHSGVFPDYAEKLPQEEKMEKEDSFPQRVWQIVAAIPEGYVTTYGDVAKLAGSPRAARQVGGVLKRLPEGSTLPWHRVVNRHGTISLTGPDLQRQRQALLAEGVMVSGSGQIDLQLYRWNY

SEQ ID NO: 1119 - DNA, 354 bp, Escherichia coli
atgaagtatgttgatggttttgttgttgccgttcctgccgataaaaaggatgcctatcgggaaatggccgctaaggccgcgccattatttaaagagttcggtgcgcttcgtattgtcgaatgctgggccagcgatgtaccggatggtaaagtgaccgattttcgtatggcggtgaaagcggaagagaatgaagaggttgtctttagctggattgaatacccttcaaaagaggtccgcgacgctgctaatcaaaagatgatgtcggacccacggatgaaagagttcggcgagtccatgccgtttgacggcaagcgaatgatctatggtggattcgaatcaatcatcgacgagtag

SEQ ID NO: 1120 - protein, 117 aa, Escherichia coli
MKYVDGFVVAVPADKKDAYREMAAKAAPLFKEFGALRIVECWASDVPDGKVTDFRMAVKAEENEEVVFSWIEYPSKEVRDAANQKMMSDPRMKEFGESMPFDGKRMIYGGFESIIDE

SEQ ID NO: 1121 - DNA, 1551 bp, Escherichia coli
gtgagaacacgacatctggtcggccttatttcgggagtactgattctttcagtattgctgcctgtcggcttaagcatctggctggcccatcagcaggtagaaacatcatttattgaagagctgaatacgtattcctcccgcgtcgctattcgggccaataaggtggcgacacaagggaaagatgcgctgcaagagctggaaagatggcaaggcgctgcctgtagcgaagcccatctcatggaaatgcgtcgggtatcttacagttatcgctatattcaggaagtggtttatatcgataacaacgttccccagtgttcgtctctggagcatgaaagcccgcccgataccttccccgagccaggtaaaatttcgaaagatggttatcgtgtctggttaacatcgcataacgatttaggcattattcgttacatggtcgccatgggaacggcacattatgtcgtcatgatcgaccccgcttcctttattgatgtcattccctatagctcatggcaaattgatgccgccattattggcaatgcccataacgttgtcataaccagcagcgatgaacttgctcagggaattattaccaggctacaaaaaacacccggtgagcatatcgaaaataatggaatcatttacgatatcctgcccttaccggagatgaatatttcgatcatcacctgggcttcaacgaaaatgttgcagaaaggctggcatcggcaagtctttatttggttaccgctcgggttggtgattggcctgctggcagcgatgtttgtgctgcgtattttgcgccgtatccagtcaccgcatcatcggctgcaggatgctatcgaaaatcgtgatatttgcgtgcactatcagccgattgtctccttagccaatggcaaaattgtcggtgctgaggcactggcgcgctggccgcagacagacggtagttggttgtcaccagatagttttattccgctggcacagcaaacgggcctttctgagccattgacgctactgattataagaagcgtctttgaagatatgggcgactggctgcgtcagcatcctcagcagcatatttcgatcaatcttgaatccaccgtgctcacctcggaaaaaatcccgcaattgctgcgtgaaatgatcaatcactatcaggttaatcccagacagatcgcgcttgaactcactgaacgcgagtttgccgatccgaaaaccagcgccccgataatttctcgctaccgggaggcgggccatgaaatttatctcgatgattttggtacagggtattcaagtttaagctatttacaggatctggatgtcgacattctgaagatcgataaatctttcgttgatgcgctggaatataaaaatgtcacgccgcatatcatcaaaatggcaaaaactctgaaactgaaaatggttgcggagggaatcgaaaccagtaaacaagaagagtggctacgccagcatggcgtgcactacggtcagggctggctctacagcaaggcattaccgaaagaggatttcttacgctgggccgagcaacatttgtga

SEQ ID NO: 1122 - protein, 516 aa, Escherichia coli
MRTRHLVGLISGVLILSVLLPVGLSIWLAHQQVETSFIEELNTYSSRVAIRANKVATQGKDALQELERWQGAACSEAHLMEMRRVSYSYRYIQEVVYIDNNVPQCSSLEHESPPDTFPEPGKISKDGYRVWLTSHNDLGIIRYMVAMGTAHYVVMIDPASFIDVIPYSSWQIDAAIIGNAHNVVITSSDELAQGIITRLQKTPGEHIENNGIIYDILPLPEMNISIITWASTKMLQKGWHRQVFIWLPLGLVIGLLAAMFVLRILRRIQSPHHRLQDAIENRDICVHYQPIVSLANGKIVGAEALARWPQTDGSWLSPDSFIPLAQQTGLSEPLTLLIIRSVFEDMGDWLRQHPQQHISINLESTVLTSEKIPQLLREMINHYQVNPRQIALELTEREFADPKTSAPIISRYREAGHEIYLDDFGTGYSSLSYLQDLDVDILKIDKSFVDALEYKNVTPHIIKMAKTLKLKMVAEGIETSKQEEWLRQHGVHYGQGWLYSKALPKEDFLRWAEQHL

SEQ ID NO: 1123 - DNA, 510 bp, Escherichia coli
gtgttccctggaaagttgcagatatcacgaaggcaaacgatgaccgaaatacaacgcctgctgaccgaaacgattgagtctctgaatacccgcgaaaaacgcgacaacaaaccccgctttagtatcagttttatccgtaaacatccggggctgtttatcggtatgtacgttgctttttttgccaccctggcggtgatgttgcagtccgaaacgctttcaggctctgtctggctactggttgtattatttatcctgcttaatggtttcttctttttcgatgtctacccacgctaccgctatgaagatatcgacgtgctggatttccgcgtttgctataacggcgaatggtacaacacgcgctttgtacctgccgcgctagttgaagccatcctgaactctccgcgtgtcgcggatgttcataaagaacaactgcaaaaaatgatcgtccgtaaaggtgaactatctttttacgatatttttaccctcgctcgcgccgaatcaacatcttaa

SEQ ID NO: 1124 - protein, 169 aa, Escherichia coli
MFPGKLQISRRQTMTEIQRLLTETIESLNTREKRDNKPRFSISFIRKHPGLFIGMYVAFFATLAVMLQSETLSGSVWLLVVLFILLNGFFFFDVYPRYRYEDIDVLDFRVCYNGEWYNTRFVPAALVEAILNSPRVADVHKEQLQKMIVRKGELSFYDIFTLARAESTS

SEQ ID NO: 1125 - DNA, 531 bp, Escherichia coli
atgattgctggtgagttgtatcactcggcagatggggcgttatctcgcgatcgcctgcgagctcgtcggcttattcaccgatacaatcattccctggtggaagagcacacattacgccagcaaattcttgctgatttattcggtcaggtgacagaggcttatattgagccaacgtttcgctgtgactatggttataacatttttctcggcaataattttttcgccaacttcgattgcgtgatgcttgatgtctgccctattcgcattggtgataactgtatgttggcaccaggcgttcatatctacacggcaacacatcccatcgaccctgtagcacgtaatagcggtgctgaactggggaaacccgtcaccatcggtaataacgtctggattggcggacgtgcagtcattaaccctggtgtgaccattggtgataacgtcgtggtagcctcaggtgcagttgtcacaaaagatgtcccggacaacgttgtcgtgggcggtaatccagccagaatcattaaaaaattgtaa

SEQ ID NO: 1126 - protein, 176 aa, Escherichia coli
MIAGELYHSADGALSRDRLRARRLIHRYNHSLVEEHTLRQQILADLFGQVTEAYIEPTFRCDYGYNIFLGNNFFANFDCVMLDVCPIRIGDNCMLAPGVHIYTATHPIDPVARNSGAELGKPVTIGNNVWIGGRAVINPGVTIGDNVVVASGAVVTKDVPDNVVVGGNPARIIKKL

SEQ ID NO: 1127 - DNA, 105 bp, Escherichia coli
atgggaacgttctcttcactgacttttcgtcttactgtgttgccgcattttcagcaaccggaagtcagtaatgagcacagaaaaagaaaagatgattgctggtga

SEQ ID NO: 1128 - protein, 34 aa, Escherichia coli
MGTFSSLTFRLTVLPHFQQPEVSNEHRKRKDDCW

SEQ ID NO: 1129 - DNA, 183 bp, Escherichia coli
atgcgtttacgtcgttgtcagacaattgacacgctggagcgtgttatcgagaaaaataaatacgaattatcagataatgaactggcggtattttactcagccgcagatcaccgcctcgccgaattgaccatgaataaactgtacgacaagatcccttcctcagtatggaaatttattcgctaa

SEQ ID NO: 1130 - protein, 60 aa, Escherichia coli
MRLRRCQTIDTLERVIEKNKYELSDNELAVFYSAADHRLAELTMNKLYDKIPSSVWKFIR

SEQ ID NO: 1131 - DNA, 375 bp, Escherichia coli
atggatgaatactcacccaaaagacatgatatcgcacagcttaagtttctctgtgaaaccctgtatcatgactgccttgcaaaccttgaagaaagcaatcatggctgggttaacgacccaacctcggcgatcaacctccagttgaatgaactgattgagcatattgcgaccttcgcacttaattacaaaattaagtataatgaagacaataagctcattgagcagatcgacgaatatctggatgacacctttatgttgttcagtagttatggtattaatatgcaggatcttcagaaatggcggaagtcaggtaatcgactattccgttgttttgtcaatgcgacgaaagagaatcctgcgagtttatcttgttag

SEQ ID NO: 1132 - protein, 124 aa, Escherichia coli
MDEYSPKRHDIAQLKFLCETLYHDCLANLEESNHGWVNDPTSAINLQLNELIEHIATFALNYKIKYNEDNKLIEQIDEYLDDTFMLFSSYGINMQDLQKWRKSGNRLFRCFVNATKENPASLSC

SEQ ID NO: 1133 - DNA, 3150 bp, Escherichia coli
atgcctaatttctttatcgatcgcccgatttttgcgtgggtgatcgccattatcatcatgttggcaggggggctggcgatcctcaaactgccggtggcgcaatatcctacgattgcaccgccggcagtaacgatctccgcctcctaccctggcgctgatgcgaaaacagtgcaggacacggtgacacaggttatcgaacagaatatgaacggtatcgataacctgatgtacatgtcctctaacagtgactccacgggtaccgtgcagatcaccctgacctttgagtctggtactgatgcggatatcgcgcaggttcaggtgcagaacaaactgcagctggcgatgccgttgctgccgcaagaagttcagcagcaaggggtgagcgttgagaaatcatccagcagcttcctgatggttgtcggggttatcaacaccgatggcactatgacgcaggaggatatctctgactacgtggcagcgaatatgaaagatgccatcagccgtacgtcgggcgtgggtgacgttcagttgttcggttcacagtacgcgatgcgtatctggatgaacccgaatgaactgaacaaattccagctaacgccggttgatgtcattaccgccatcaaagcacagaacgctcaggttgcagctggtcagctcggtggtacgccgccggtgaaaggccaacagcttaacgcctctattattgctcagacgcgtctgacctctactgaagagttcggcaaaatcctgctgaaagtgaatcaggatggttcccgcgtgctactgcgtgatgtggcgaaaattgagctgggtggtgagaactacgacatcatcgcagagtttaacggccaaccggcttccggtctggggatcaagctggcgaccggtgcgaacgcgctggataccgctgcggcaatccgtgctgaactggcgaagatggaaccgttcttcccgtcgggtctgaaaattgtttacccgtatgacaccacaccgttcgtgaaaatctctattcacgaagtggtaaaaacgctggtcgaagcgatcatcctcgtgttcctggtaatgtatctgttcctgcagaacttccgcgcgacgttgattccgactattgctgtaccggtggtattgctggggacatttgccgtccttgccacctttggcttctcgataaacacactaacgatgttcgggatggtactcgccatcggcctgttggtggatgacgccatcgttgtagtagaaaacgttgagcgtgtaatggcagaagaaggtctgccaccgaaagaagctacgcgtaagtcgatggggcagattcagggcgcgctggtgggtatcgcgatggtactgtcagcggtattcgtaccgatggccttcttcggcggttcgaccggggcaatttatcgtcagttctccattaccattgtttcggcaatggcgctgtcggtactggtggcgttgatcctgactccggcactctgtgcaaccatgctgaaaccgattgccaaaggcgatcacggcgaaggtaaaaaaggcttcttcggctggtttaaccgcatgttcgagaagagcacgcaccactacaccgacagcgtaggcggtattctgcgcagtacagggcgttacctggtgctgtatctgatcatcgtggtcggcatggcctatctgttcgtgcgtctgccaagctccttcttgccagatgaagaccagggcgtatttatgaccatggttcagctgccagcaggtgcaacgcaggaacgtacgcagaaagtgctcaatgaggtaacgcattactatctgaccaaagaaaagaacaacgttgagtcggtgttcgccgttaacggcttcggctttgcgggacgtggtcagaatacaggtattgcgttcgtttccttgaaggactgggccgatcgtccgggcgaagaaaacaaagttgaagcgattaccatgcgtgcaacacgtgctttctcgcaaatcaaagatgcgatggttttcgcctttaacctgcccgcaatcgtggaactgggtaccgcaaccggctttgactttgagctgattgaccaggctggccttggtcacgaaaaactgactcaggcgcgtaaccagttgcttgcagaagcagcgaagcaccctgatatgttgaccagcgtacgtccaaacggtctggaagataccccgcagtttaagattgatatcgaccaggaaaaagcgcaggcgctgggtgtttctatcaacgacattaacaccactctgggcgctgcatggggcggtagctatgtgaacgactttatcgaccgcggtcgtgtgaagaaagtttacgtcatgtcagaagcgaaataccgtatgctgccggatgatatcggcgactggtatgttcgtgctgctgatggtcagatggtgccgttctcggcgttctcctcttctcgttgggagtacggttcgccgcgtctggaacgttacaacggcctgccatctatggaaatcttaggccaggcggcaccgggtaaaagtaccggtgaagcaatggagctgatggaacaactggcgagcaaactgcctaccggtgttggctatgactggacgggaatgtcctatcaggaacgtctctccggcaaccaggcgccttcactgtacgcgatttcgttgattgtcgtgttcctgtgtctggctgcgctgtacgagagctggtcgattccgttctccgttatgctggtcgttccgctgggggttatcggtgcgttgctggctgccaccttccgtggcctgaccaatgacgtttacttccaggtaggcctgctcacaaccattggtttgtcggcgaagaacgcgatacttatcgtcgaattcgccaaagacttgatggataaagaaggtaaaggtctgattgaagcgacgcttgatgcggtgcggatgcgtttacgcccaatcctgatgacctcgttggcgtttatcctcggcgttatgccgctggttatcagtactggtgctggttccggcgcgcagaacgcagtaggtaccggtgtaatgggcgggatggtgaccgcaacggtactggcaatcttcttcgttccggtattctttgtggtggttcgccgccgctttagccgcaagaatgaagatatcgagcacagccatactgtcgatcatcattga

SEQ ID NO: 1134 - protein, 1049 aa, Escherichia coli
MPNFFIDRPIFAWVIAIIIMLAGGLAILKLPVAQYPTIAPPAVTISASYPGADAKTVQDTVTQVIEQNMNGIDNLMYMSSNSDSTGTVQITLTFESGTDADIAQVQVQNKLQLAMPLLPQEVQQQGVSVEKSSSSFLMVVGVINTDGTMTQEDISDYVAANMKDAISRTSGVGDVQLFGSQYAMRIWMNPNELNKFQLTPVDVITAIKAQNAQVAAGQLGGTPPVKGQQLNASIIAQTRLTSTEEFGKILLKVNQDGSRVLLRDVAKIELGGENYDIIAEFNGQPASGLGIKLATGANALDTAAAIRAELAKMEPFFPSGLKIVYPYDTTPFVKISIHEVVKTLVEAIILVFLVMYLFLQNFRATLIPTIAVPVVLLGTFAVLATFGFSINTLTMFGMVLAIGLLVDDAIVVVENVERVMAEEGLPPKEATRKSMGQIQGALVGIAMVLSAVFVPMAFFGGSTGAIYRQFSITIVSAMALSVLVALILTPALCATMLKPIAKGDHGEGKKGFFGWFNRMFEKSTHHYTDSVGGILRSTGRYLVLYLIIVVGMAYLFVRLPSSFLPDEDQGVFMTMVQLPAGATQERTQKVLNEVTHYYLTKEKNNVESVFAVNGFGFAGRGQNTGIAFVSLKDWADRPGEENKVEAITMRATRAFSQIKDAMVFAFNLPAIVELGTATGFDFELIDQAGLGHEKLTQARNQLLAEAAKHPDMLTSVRPNGLEDTPQFKIDIDQEKAQALGVSINDINTTLGAAWGGSYVNDFIDRGRVKKVYVMSEAKYRMLPDDIGDWYVRAADGQMVPFSAFSSSRWEYGSPRLERYNGLPSMEILGQAAPGKSTGEAMELMEQLASKLPTGVGYDWTGMSYQERLSGNQAPSLYAISLIVVFLCLAALYESWSIPFSVMLVVPLGVIGALLAATFRGLTNDVYFQVGLLTTIGLSAKNAILIVEFAKDLMDKEGKGLIEATLDAVRMRLRPILMTSLAFILGVMPLVISTGAGSGAQNAVGTGVMGGMVTATVLAIFFVPVFFVVVRRRFSRKNEDIEHSHTVDHH

SEQ ID NO: 1135 - DNA, 1230 bp, Escherichia coli
ttgaccaatttgaaatcggacactcgaggtttacatatgaacaaaaacagagggtttacgcctctggcggtcgttctgatgctctcaggcagcttagccctaacaggatgtgacgacaaacaggcccaacaaggtggccagcagatgcccgccgttggcgtagtaacagtcaaaactgaacctctgcagatcacaaccgagcttccgggtcgcaccagtgcctaccggatcgcagaagttcgtcctcaagttagcgggattatcctgaagcgtaatttcaaagaaggtagcgacatcgaagcaggtgtctctctctatcagattgatcctgcgacctatcaggcggcatacgacagtgcgaaaggtgatctggcgaaagcccaggctgcagccaatatcgcgcaattgacggtgaatcgttatcagaaattgctcggtactcagtacatcagtaagcaagagtacgatcaggctctggctgatgcgcaacaggcgaatgctgcggtaactgcggcgaaagctgccgttgaaactgcgcgaatcaatctggcttacaccaaagtcacctctccgattagtggtcgcattggtaagtcaaacgtgacggaaggcgcattggtacagaacggtcaggcgactgcgctggcaaccgtgcagcaacttgatccgatctacgttgatgtgacccagtccagcaacgacttcctgcgcctgaaacaggaactggcgaatggcacgctgaaacaagagaacggcaaagccaaagtgtcgctgatcaccagtgacggcattaagttcccgcaggacggtacgctggaattctctgacgttaccgttgatcagaccactgggtctatcaccctacgcgctatcttcccgaacccggatcacactctgctgccaggtatgttcgtgcgtgcacgtctggaagaagggcttaatccaaacgctattttagtcccgcaacagggcgtaacccgtacgccgcgtggcgatgccaccgtactggtggttggcgcggatgacaaagtggaaacccgtccgatcgttgcaagccaggctatcggcgataagtggctggtgacagaaggtctgaaagcaggcgatcgcgtagtaataagtgggctgcagaaagtgcgtcctggtgtccaggtaaaagcacaagaagttaccgctgataataaccagcaagccgcaagcggtgctcagcctgaacagtccaagtcttaa

SEQ ID NO: 1136 - protein, 409 aa, Escherichia coli
MTNLKSDTRGLHMNKNRGFTPLAVVLMLSGSLALTGCDDKQAQQGGQQMPAVGVVTVKTEPLQITTELPGRTSAYRIAEVRPQVSGIILKRNFKEGSDIEAGVSLYQIDPATYQAAYDSAKGDLAKAQAAANIAQLTVNRYQKLLGTQYISKQEYDQALADAQQANAAVTAAKAAVETARINLAYTKVTSPISGRIGKSNVTEGALVQNGQATALATVQQLDPIYVDVTQSSNDFLRLKQELANGTLKQENGKAKVSLITSDGIKFPQDGTLEFSDVTVDQTTGSITLRAIFPNPDHTLLPGMFVRARLEEGLNPNAILVPQQGVTRTPRGDATVLVVGADDKVETRPIVASQAIGDKWLVTEGLKAGDRVVISGLQKVRPGVQVKAQEVTADNNQQAASGAQPEQSKS

SEQ ID NO: 1137 - DNA, 648 bp, Escherichia coli
atggcacgaaaaaccaaacaagaagcgcaagaaacgcgccaacacatcctcgatgtggctctacgtcttttctcacagcagggggtatcatccacctcgctgggtgagattgcaaaagcagctggcgttacgcgcggtgcaatctactggcattttaaagacaagtcggatttgttcagtgagatctgggaactgtcagaatccaatattggtgaactagagcttgagtatcaggcaaaattccctggcgatccactctcagtattaagagagatattaattcatgttcttgagtccacggtgacagaagaacggcgtcgattattgatggagattatattccacaaatgcgaatttgtcggagaaatggctgttgtgcaacaggcacaacgtaatctctgtctggaaagttatgaccgtatagaacaaacgttaaaacattgtattgaagcgaaaatgttgcctgcggatttaatgacgcgtcgcgcagcaattattatgcgcggctatatttccggcctgatggaaaactggctctttgccccgcaatcttttgatcttaaaaaagaagcccgcgattacgtcgccatcttactggagatgtatctcctgtgccccacgcttcgtaaccctgccactaacgaataa

SEQ ID NO: 1138 - protein, 215 aa, Escherichia coli
MARKTKQEAQETRQHILDVALRLFSQQGVSSTSLGEIAKAAGVTRGAIYWHFKDKSDLFSEIWELSESNIGELELEYQAKFPGDPLSVLREILIHVLESTVTEERRRLLMEIIFHKCEFVGEMAVVQQAQRNLCLESYDRIEQTLKHCIEAKMLPADLMTRRAAIIMRGYISGLMENWLFAPQSFDLKKEARDYVAILLEMYLLCPTLRNPATNE

SEQ ID NO: 1139 - DNA, 3363 bp, Escherichia coli
atgactatgttccagtattacaaacgatcacggcattttgttttttcagcatttattgcttttgtttttgtcttgttatgccagaacacggcgtttgcgcgggcgtcatcgaatggtgatctgccgacaaaagcggacctgcaggcacaacttgactcactgaataaacaaaaagatctttctgctcaggacaaactggtgcagcaggatctgacagatacattagccaccctcgataaaatcgatcgcgtaaaagaagagacagttcagctacggcaaaaagtcgctgaagcgccggaaaaaatgcgccaggcgaccgcggcgttaacagcacttagtgatgtcgataacgacgaagaaacgcgcaaaattctgagcacgctttcgttgcgccagctggaaactcgcgttgcccaggcgctggacgatttgcaaaacgcacaaaatgatctggcgtcttataacagccagctggtttcgttacagacgcagcccgaacgcgtacaaaatgcgatgtataacgcttcgcagcagctgcaacaaattcgcagtcgtctggatgggactgatgtcggcgagacagccttacgtcccagccagaaagtgttaatgcaggctcagcaggctttgctgaatgccgagattgaccagcagcgtaaaagcctggaagggaacacagtcttacaggataccttgcaaaagcaacgggattacgtgacggcgaacagcgcccgtctggagcaccagttgcagctgttgcaagaagcagtaaacagcaagcgcctgactttaaccgaaaaaacggcgcaggaagccgtctccccggatgaagccgcgcgtattcaggctaatccgctggtgaagcaggaactggaaattaaccagcagttaagtcagcgtctgattaccgcgactgaaaacggtaatcagttgatgcagcaaaacattaaagtcaaaaactggctggagcgggcgctgcaatcggaacgcaatattaaagagcagattgccgtcctgaagggcagtctgctgttgtcacgtatcctgtaccagcaacaacaaacactcccctcggcagatgaactggaaaacatgaccaaccgcatcgcggatttgcgtctcgaacagtttgaagtcaaccagcagcgtgacgcgctgttccagagcgatgcgttcgtcagcaaactggaagaaggtcacaccaacgaagtcaacagcgaagttcacgatgcattattgcaagtagttgatatgcgtcgcgaattgctggatcagcttaacaaacagttgggtaaccagctgatgatggccattaacctgcaaatcaaccagcagcagttaatgagtgtgtcgaaaaacctgaaatccatcctgacgcagcaaattttttgggtgaacagtaaccgcccgatggactgggactggattaaagcgttcccgcaaacgctgaaagatgaatttaagtcgatgaaaatcacggtgaactgggaaaaagcctggcccgccgtattcatcgccttcctcgctggtttgccgctgctgttgattgccgggctgattcactggcgtttaggctggctgaaagcatatcaacaaaaactggcttcggcggtaggttccctgcgtaacgatagccagctcaatacgccaaaagcgattcttattgacctaatccgcgcactgccggtgtgcctgattattctcgctgtcggcctgattctgctgactatgcagctcaatatcagcgagttattgtggtcgttcagcaaaaaactggcgattttctggctggtgtttggcctgtgctggaaagtgctggagaaaaacggtgttgccgtgcgtcactttggtatgccggaacagcagaccagccactggcgtcggcaaattgtccgcatcagcctcgcgttgctgccgatccatttctggtctgtggtggcagaactctccccgctgcatctgatggatgatgtgctggggcaggcgatgattttcttcaacctgctgctgattgccttcctggtgtggccgatgtgccgcgaaagctggcgtgataaagagtcgcacaccatgcgactggtcaccattaccgtgctgtcgattatcccgattgcgttgatggtgctgaccgccacgggttacttctacaccacgctgcgcctctccgggcgttggattgaaaccgtttatttggtgatcatctggaacctgctgtaccagacggtattgcgcggcttaagcgtagcggcgcggcgtatcgcctggcgtcgtgcactggcgcgtcggcagaatctggtgaaagagggcgcagaaggtgccgaaccgccggaagaacccaccattgcgctggagcaggttaaccagcagacgctgcgtattaccatgttgctgatgtttgcgctgttcggtgtcatgttctgggcaatttggtctgatttgatcaccgtgttcagctatctcgacagcattacgctctggcattacaacgctactgaagctggtgctgcggtggtgaaaaacgtcaccatgggcagtctgttgtttgcgattatcgcctcaatggtggcctgggcgttgattcgcaacctgcctggtttgctggaagtgctggtgctctcgcgactgaatatgcgccagggcgcgtcgtatgccattactaccatccttaactacatcattattgccgttggtgcgatgacggtgttcggatcgctgggcgtctcgtgggataaactccagtggctggcggcagcattatccgtaggtcttggttttggtttacaagagatcttcggtaacttcgtttccggtttgatcattctgttcgaacgtccggtgcgcataggcgacacggtaaccattggtagcttctcgggtacggtcagcaagatccgtattcgtgcgacaacgattaccgatttcgatcgcaaagaagtgattatcccgaacaaagcgtttgttaccgagcgtctgatcaactggtcgttaactgacacgactacgcgtctggtgatccgtctcggcgtagcctatggctccgatctggaaaaagtgcgtaaagtgttgctgaaggcggcgactgagcacccaagggtgatgcacgaaccaatgccggaagtcttctttacggcatttggtgccagcacgttggatcatgagctgcgtctgtatgtgcgtgaactgcgtgaccgtagccgtactgtcgatgagctgaaccgtactatcgatcagttgtgccgtgaaaacgacatcaacattgcctttaaccaacttgaagtgcatctgcacaacgagaagggcgatgaagtgacggaagtgaaacgcgactacaaaggcgacgatccgacgccagcggtagggtaa

SEQ ID NO: 1140 - protein, 1120 aa, Escherichia coli
MTMFQYYKRSRHFVFSAFIAFVFVLLCQNTAFARASSNGDLPTKADLQAQLDSLNKQKDLSAQDKLVQQDLTDTLATLDKIDRVKEETVQLRQKVAEAPEKMRQATAALTALSDVDNDEETRKILSTLSLRQLETRVAQALDDLQNAQNDLASYNSQLVSLQTQPERVQNAMYNASQQLQQIRSRLDGTDVGETALRPSQKVLMQAQQALLNAEIDQQRKSLEGNTVLQDTLQKQRDYVTANSARLEHQLQLLQEAVNSKRLTLTEKTAQEAVSPDEAARIQANPLVKQELEINQQLSQRLITATENGNQLMQQNIKVKNWLERALQSERNIKEQIAVLKGSLLLSRILYQQQQTLPSADELENMTNRIADLRLEQFEVNQQRDALFQSDAFVSKLEEGHTNEVNSEVHDALLQVVDMRRELLDQLNKQLGNQLMMAINLQINQQQLMSVSKNLKSILTQQIFWVNSNRPMDWDWIKAFPQTLKDEFKSMKITVNWEKAWPAVFIAFLAGLPLLLIAGLIHWRLGWLKAYQQKLASAVGSLRNDSQLNTPKAILIDLIRALPVCLIILAVGLILLTMQLNISELLWSFSKKLAIFWLVFGLCWKVLEKNGVAVRHFGMPEQQTSHWRRQIVRISLALLPIHFWSVVAELSPLHLMDDVLGQAMIFFNLLLIAFLVWPMCRESWRDKESHTMRLVTITVLSIIPIALMVLTATGYFYTTLRLSGRWIETVYLVIIWNLLYQTVLRGLSVAARRIAWRRALARRQNLVKEGAEGAEPPEEPTIALEQVNQQTLRITMLLMFALFGVMFWAIWSDLITVFSYLDSITLWHYNATEAGAAVVKNVTMGSLLFAIIASMVAWALIRNLPGLLEVLVLSRLNMRQGASYAITTILNYIIIAVGAMTVFGSLGVSWDKLQWLAAALSVGLGFGLQEIFGNFVSGLIILFERPVRIGDTVTIGSFSGTVSKIRIRATTITDFDRKEVIIPNKAFVTERLINWSLTDTTTRLVIRLGVAYGSDLEKVRKVLLKAATEHPRVMHEPMPEVFFTAFGASTLDHELRLYVRELRDRSRTVDELNRTIDQLCRENDINIAFNQLEVHLHNEKGDEVTEVKRDYKGDDPTPAVG

SEQ ID NO: 1141 - DNA, 162 bp, Escherichia coli
atgtcactggaaaatgcccctgacgatgtcaaactggccgtcgatttgattgtgctactggaagaaaatcagatcccagcccgcaccgtgctgcgcgcgctggatattgtaaaacgcgattatgaaaagaaattaacgcgcgatgatgaggcggaaaagtga

SEQ ID NO: 1142 - protein, 53 aa, Escherichia coli
MSLENAPDDVKLAVDLIVLLEENQIPARTVLRALDIVKRDYEKKLTRDDEAEK

SEQ ID NO: 1143 - DNA, 528 bp, Escherichia coli
gtgaaaaccgccctgctgctggaaaaactggaaggacagctcgctacgctgcgtcagcgttgtgccccggtagcgcaatttgccacgctaagcgcccgttttaacaggcatctttttcagactcgtgcgacaacactgcaggcttgtctcgatgaggcgggcgataatctggctgcgcttcgtcatgccgttgagcaacagcaactgccgcaagtcgcctggctggcggaacatctggcggcgcaactggaggctatagcgcgtgaagccacagcctggtcgctacgcgagtgggacagtgcgccaccgaaaattgcccgctggcagcgtaaacgtattcagcatcaggattttgagcggcggctacgtgagatggttgccgaacgtagagcccgtctggcacgagcgaccgatctcgtggaacagcagacgctgcatcgtgaagtggaagcctatgaagcgcgcctggcacgctgccgccatgcgctggaaaaaatcgaaaacaggttagcgcgtttaacccgctag

SEQ ID NO: 1144 - protein, 175 aa, Escherichia coli
MKTALLLEKLEGQLATLRQRCAPVAQFATLSARFNRHLFQTRATTLQACLDEAGDNLAALRHAVEQQQLPQVAWLAEHLAAQLEAIAREATAWSLREWDSAPPKIARWQRKRIQHQDFERRLREMVAERRARLARATDLVEQQTLHREVEAYEARLARCRHALEKIENRLARLTR

SEQ ID NO: 1145 - DNA, 378 bp, Escherichia coli
atgcaacgaatcattttaatcatcattggctggctggcggtagtgctgggtacgctgggcgtggtattaccggtattaccgacgacgccgtttatcctgctggcggcctggtgctttgcccgttcttccccgcgctttcacgcctggttgctgtaccgctcatggtttggcagctatctacgtttctggcagaaacatcatgcgatgccgcgcggcgcaaaaccacgggcgattttgcttattttgattacgtttacgatttcgctgtggttcgtccagatgccgtgggtgcgcatcatgttgctggtaattctcgcctgtttgcttttttatatgtggcgaattccggtgattgatgaaaagcaagaaaagcactga

SEQ ID NO: 1146 - protein, 125 aa, Escherichia coli
MQRIILIIIGWLAVVLGTLGVVLPVLPTTPFILLAAWCFARSSPRFHAWLLYRSWFGSYLRFWQKHHAMPRGAKPRAILLILITFTISLWFVQMPWVRIMLLVILACLLFYMWRIPVIDEKQEKH

SEQ ID NO: 1147 - DNA, 111 bp, Escherichia coli
ttgatgaaaagcaagaaaagcactgaagcacaacaatcgcagttgcaattattgcgtacagccagtacattctggcgttttcgagcacaggcgcaggcggtcaaaggttaa

SEQ ID NO: 1148 - protein, 36 aa, Escherichia coli
MMKSKKSTEAQQSQLQLLRTASTFWRFRAQAQAVKG

SEQ ID NO: 1149 - DNA, 606 bp, Escherichia coli
ttgatacgttcaaaacgcgccgtgagtaccaccgtaacaagcaggcatacacttatgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagtggtcggcaccgaagcgcgtggcttcttgtttggcgctccggtagctctgggtctgggcgttggctttgtaccggtccgtaaaccgggcaaactgccgcgtgaaaccatcagtgaaacttacgacctggaatacggcaccgatcagctggaaatccacgttgatgccatcaaaccgggcgataaagttctggtggtggacgatctgctggcaaccggcggcactatcgaagcgaccgttaaactgatccgtcgtctgggtggtgaagtagctgacgctgcgttcattatcaacctgttcgatctcggcggcgaacagcgtctcgaaaaacagggcattaccagctacagccttgtcccgttcccgggccattaa

SEQ ID NO: 1150 - protein, 201 aa, Escherichia coli
MIRSKRAVSTTVTSRHTLMTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 1151 - DNA, 1932 bp, Escherichia coli
atgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgctggcgaaggggctaaactgcgaaactggcattaccgcgacgccgtgcggcgtgtgcgataactgtcgtgaaatcgagcaggggcgctttgtcgatctgattgaaatcgacgccgcctcgcgcaccaaagttgaagacactcgtgacctgctggataacgtccagtacgcgccagcgcgtggtcgttttaaagtttatctgatcgacgaagtgcatatgctgtcgcgccacagctttaacgcactgttaaaaacccttgaagaaccgccggagcacgtcaagtttctgctggcgacgaccgatccgcagaaattgccggtgacgattttgtcacgctgtctgcaatttcatctcaaagcgctggatgtcgagcaaattcgccatcagcttgagcacatcctcaacgaagaacatatcgctcacgagccacgggcgctgcaattgctggcacgcgccgctgaaggcagcctgcgagatgccttaagtctgaccgaccaggcgattgccagcggtgacggccaggtttcaacccaggccgtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggtctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccagaccgccgtatgggtgttgagatgacgctgctgcgcgcgctggcgttccatccgcgtatgcctctgcctgagccagaagtgccacgccagtcctttgcgcccgttgcgccaacggcagtaatgacgccaacacaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgcccggtgccatcggcgctggaaaaagcgccagccaaaaaagaagcgtatcgctggaaggcgaccactccagtgatgcagcaaaaagaagtggtcgccacgccgaaggcgctgaaaaaagcgctggaacatgaaaaaacgccggaactggcggcgaagctggcggcagaagccattgagcgcgacccgtgggcggctcaggtgagtcaactttcgctaccaaaactggtcgaacaggtggcgttaaatgcctggaaagaggagagcgacaacgcagtatgtctgcatttgcgctcctctcagcggcatttgaacaaccgcggcgcacagcaaaaactggctgaagcgttgagcacgttaaaaggttcaacggttgaactgactatcgttgaagatgataatcccgcggtgcgtacgccgctggaatggcgtcaggcgatatacgaagaaaaacttgcgcaggcgcgcgagtccattattgcggataataatattcagaccctgcgtcgattcttcgatgcggagctggatgaagaaagtatccgccccatttga

SEQ ID NO: 1152 - protein, 643 aa, Escherichia coli
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPEHVKFLLATTDPQKLPVTILSRCLQFHLKALDVEQIRHQLEHILNEEHIAHEPRALQLLARAAEGSLRDALSLTDQAIASGDGQVSTQAVSAMLGTLDDDQALSLVEAMVEANGERVMALINEAAARGIEWEALLVEMLGLLHRIAMVQLSPAALGNDMAAIELRMRELARTIPPTDIQLYYQTLLIGRKELPYAPDRRMGVEMTLLRALAFHPRMPLPEPEVPRQSFAPVAPTAVMTPTQVPPQPQSAPQQAPTVPLPETTSQVLAARQQLQRVQGATKAKKSEPAAATRARPVNNAALERLASVTDRVQARPVPSALEKAPAKKEAYRWKATTPVMQQKEVVATPKALKKALEHEKTPELAAKLAAEAIERDPWAAQVSQLSLPKLVEQVALNAWKEESDNAVCLHLRSSQRHLNNRGAQQKLAEALSTLKGSTVELTIVEDDNPAVRTPLEWRQAIYEEKLAQARESIIADNNIQTLRRFFDAELDEESIRPI

SEQ ID NO: 1153 - DNA, 330 bp, Escherichia coli
atgtttggtaaaggcggtctgggtaacctgatgaagcaagcccagcagatgcaagaaaaaatgcagaaaatgcaggaagagatcgcgcagctggaagtcaccggcgaatctggcgcaggtctggtaaaagtgaccatcaacggtgcacacaactgccgtcgcgtagagatcgacccgagcctgctggaagacgacaaagagatgctggaagacctggtggctgcagcattcaacgacgcagcacgtcgtattgaagaaacgcagaaagaaaaaatggcctctgtatcctccggaatgcagctgccgcctggctttaagatgccattctga

SEQ ID NO: 1154 - protein, 109 aa, Escherichia coli
MFGKGGLGNLMKQAQQMQEKMQKMQEEIAQLEVTGESGAGLVKVTINGAHNCRRVEIDPSLLEDDKEMLEDLVAAAFNDAARRIEETQKEKMASVSSGMQLPPGFKMPF

SEQ ID NO: 1155 - DNA, 606 bp, Escherichia coli
atgcaaaccagcccgctgttaacacagcttatggaagcactgcgctgtctgccgggcgttggcccgaagtcggcgcagcgtatggcgttcacgctgcttcagcgcgatcgtagcggcgggatgcgtctggcgcaggcgctcacccgggcgatgtcggaaatcggtcactgcgccgattgccgcaccttcaccgaacaggaagtctgtaacatctgttcgaatccacgtcgtcaggaaaacggtcaaatctgcgtggtggagagtccggcggacatttacgccattgagcagacggggcagttttcaggtcgttattttgtgttgatgggacacctgtcaccgctggacggcatcggtcctgatgatatcgggcttgatcgtctggaacagcgtctggcagaggaaaaaatcactgaagtgatcctcgccaccaaccccacggttgaaggtgaagctaccgctaactacattgccgagctttgtgcgcaatatgacgtggaagccagccgaatcgctcatggcgtaccggttggcggcgaactggaaatggtcgatggcaccacgctgtcacactcccttgccgggcgtcataagattcgtttttaa

SEQ ID NO: 1156 - protein, 201 aa, Escherichia coli
MQTSPLLTQLMEALRCLPGVGPKSAQRMAFTLLQRDRSGGMRLAQALTRAMSEIGHCADCRTFTEQEVCNICSNPRRQENGQICVVESPADIYAIEQTGQFSGRYFVLMGHLSPLDGIGPDDIGLDRLEQRLAEEKITEVILATNPTVEGEATANYIAELCAQYDVEASRIAHGVPVGGELEMVDGTTLSHSLAGRHKIRF

SEQ ID NO: 1157 - DNA, 1875 bp, Escherichia coli
atgaaaggacaagaaactcgtggttttcagtcagaagtgaaacagcttctgcacctgatgatccattctctctattccaataaagaaatcttcctgcgtgagcttatctctaacgcctccgatgcggcggacaagctgcgtttccgcgcgctttctaacccggacctgtacgaaggtgatggtgaactacgcgttcgtgtctctttcgataaagacaagcgcacgctgaccatctccgataacggcgtggggatgacccgcgacgaagtgattgaccatctggggactatcgctaaatccggcaccaaatcattcctcgaatccctgggttctgaccaggcgaaagacagccagctgatcggtcagtttggtgttggtttctactctgcgtttatcgtggctgacaaagtgaccgtgcgtactcgcgcggcaggcgaaaaaccagaaaacggcgtcttctgggaatcggctggcgaaggtgaatacaccgttgccgacatcactaaagaagatcgtggtactgaaatcaccctgcatctgcgtgaaggcgaagacgagttcctcgatgactggcgtgtgcgttccatcatcagcaaatattccgaccatatcgcgctgccggtagagatcgaaaaacgcgaagagaaagacggcgaaaccgttatctcctgggagaaaatcaacaaagcgcaggcgctgtggactcgtaacaagtcggaaatcaccgatgaagagtacaaagagttctacaaacacatcgcccacgactttaacgagccgctgacctggagccacaaccgcgttgaaggtaagcaggagtacaccagcctgctgtacattccgtctcaggcaccgtgggatatgtggaaccgcgatcataaacacggtctgaaactgtatgttcagcgtgtgttcatcatggacgacgcagaacagttcatgccgaactatctgcgcttcgtgcgtggtctgattgactccagcgatctgccgctgaacgtttcccgtgaaatcctccaggacagcacggtaacgcgtaacctgcgcaatgcgctgaccaagcgtgtgctgcaaatgctggaaaaactggcgaaagacgacgcggaaaaataccagaccttctggcaacagtttggcctggtactgaaagaaggtccggcggaagatttcgctaaccaggaagcgatcgccaaactgctgcgttttgcttctacccataccgattcttctgcgcagaccgtgtctctggaagactacgtttcccgcatgaaagaagggcaggagaaaatctactatatcaccgcagacagttacgcggcagcgaagagcagcccgcacctggaactgctgcgtaagaaaggcatcgaagttctgctgctttccgaccgcatcgatgagtggatgatgaactatctgactgagttcgacggtaaaccgttccagtctgtgtctaaagttgacgagtcgctggaaaaactggctgacgaagttgatgagagcgcgaaagaagcggagaaagcactgactccgttcatcgaccgtgtgaaagccctgctcggcgagcgcgtgaaagatgtccgtctgactcaccgtctgaccgatacgccagcgatcgtttcgaccgacgcggacgaaatgagcactcagatggcgaaactgttcgctgcggcgggccagaaagtgccagaagtgaaatacatcttcgaactgaacccggatcacgtactggtgaaacgtgcggcggatactgaagatgaagcgaagttcagcgagtgggtagaactgctgctggatcaggcgctgctggcagaacgcggcacgctggaagatccgaacctgtttattcgtcgtatgaaccagctgctggtttcctga

SEQ ID NO: 1158 - protein, 624 aa, Escherichia coli
MKGQETRGFQSEVKQLLHLMIHSLYSNKEIFLRELISNASDAADKLRFRALSNPDLYEGDGELRVRVSFDKDKRTLTISDNGVGMTRDEVIDHLGTIAKSGTKSFLESLGSDQAKDSQLIGQFGVGFYSAFIVADKVTVRTRAAGEKPENGVFWESAGEGEYTVADITKEDRGTEITLHLREGEDEFLDDWRVRSIISKYSDHIALPVEIEKREEKDGETVISWEKINKAQALWTRNKSEITDEEYKEFYKHIAHDFNEPLTWSHNRVEGKQEYTSLLYIPSQAPWDMWNRDHKHGLKLYVQRVFIMDDAEQFMPNYLRFVRGLIDSSDLPLNVSREILQDSTVTRNLRNALTKRVLQMLEKLAKDDAEKYQTFWQQFGLVLKEGPAEDFANQEAIAKLLRFASTHTDSSAQTVSLEDYVSRMKEGQEKIYYITADSYAAAKSSPHLELLRKKGIEVLLLSDRIDEWMMNYLTEFDGKPFQSVSKVDESLEKLADEVDESAKEAEKALTPFIDRVKALLGERVKDVRLTHRLTDTPAIVSTDADEMSTQMAKLFAAAGQKVPEVKYIFELNPDHVLVKRAADTEDEAKFSEWVELLLDQALLAERGTLEDPNLFIRRMNQLLVS

SEQ ID NO: 1159 - DNA, 645 bp, Escherichia coli
atgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgctacggtttcctgttggacggcttcccgcgtaccattccgcaggcagacgcgatgaaagaagcgggcatcaatgttgattacgttctggaattcgacgtaccggacgaactgattgttgaccgtatcgtaggccgccgcgttcacgcgccgtctggtcgtgtttatcacgttaaattcaatccgccgaaagtagaaggcaaagacgacgttaccggtgaagagctgactacccgtaaagacgatcaggaagagaccgtacgtaaacgtctggttgaataccatcagatgactgcaccgctgatcggctactactccaaagaagcggaagcgggtaacaccaaatacgcgaaagttgacggcaccaagccggtggctgaagttcgcgcagctctggaaaaaattctcggctaa

SEQ ID NO: 1160 - protein, 214 aa, Escherichia coli
MRIILLGAPGAGKGTQAQFIMEKYGIPQISTGDMLRAAVKSGSELGKQAKDIMDAGKLVTDELVIALVKERIAQEDCRYGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKPVAEVRAALEKILG

SEQ ID NO: 1161 - DNA, 963 bp, Escherichia coli
atgcgtcaaactaaaaccggtatcctgctggcaaatctgggtacgcctgatgcccccacacctgaagcggtaaaacgctatctgaaacaatttttaagcgacagacgcgtggttgatacctcacggttgttatggtggccgttgctgcgcggcgtgattttgccgctgcgttcgccgcgtgtggcgaagctgtatgcctctgtctggatggaaggtggctcgccgctgatggtttacagccgccagcaacagcaggcgctggcgcaacgtttaccggagacgcccgtggcgctgggaatgagctacggttcgccatcactggaaagcgccgtagatgaacttctggcagagcatgtagatcatattgtggtgctgccgctttatccgcaatactcctgttcaacggtcggtgcggtatgggatgaactggcacgcattctggcgcgcaaacgtagcattccggggatatcgtttattcgtgattacgcagataaccacgattatattaatgcactggcgaacagcgtacgtgcttcttttgccaaacatggcgaaccggatctgctgttgctctcttatcatggcattccccagcgttatgcagatgaaggcgatgattacccgcaacgttgccgcacaacaactcgcgaactcgcttccgcactggagatggcaccggaaaaagtgatgatgacctttcagtcgcgctttggtcgggaaccctggctgatgccttataccgacgaaacgctgaaaatgctcggagaaaaaggcgtgggtcatattcaggtgatgtgcccgggctttgctgcggattgtctggagacgctggaagagattgccgagcaaaaccgtgaggtcttcctcggtgcgggcgggaaaaaatatgaatatattccggcgcttaatgccacgccggaacatatcgaaatgatggctaatcttgttgccgcgtatcgctaa

SEQ ID NO: 1162 - protein, 320 aa, Escherichia coli
MRQTKTGILLANLGTPDAPTPEAVKRYLKQFLSDRRVVDTSRLLWWPLLRGVILPLRSPRVAKLYASVWMEGGSPLMVYSRQQQQALAQRLPETPVALGMSYGSPSLESAVDELLAEHVDHIVVLPLYPQYSCSTVGAVWDELARILARKRSIPGISFIRDYADNHDYINALANSVRASFAKHGEPDLLLLSYHGIPQRYADEGDDYPQRCRTTTRELASALEMAPEKVMMTFQSRFGREPWLMPYTDETLKMLGEKGVGHIQVMCPGFAADCLETLEEIAEQNREVFLGAGGKKYEYIPALNATPEHIEMMANLVAAYR

SEQ ID NO: 1163 - DNA, 960 bp, Escherichia coli
atgaagccggaaaacaaattacccgttctggaccttatctctgctgaaatgaagaccgttgtgaatactcttcagccggatttaccgccctggcctgcaacgggagcgattgctgagcaacgacagtattacacgcttgagcgccgattctggaatgtgggcgctccagaaatggcaaccagagcttacagggttccaacaaaatatgggcaggtgaaaacacgtctcttttatccgcagccagatagcccggcgacgctattttatttgcatggaggcggttttattctcggcaatctcgatacccacgatcgcatcatgcgcctgctggcaagctacagccaatgtacggtgattggcattgattacaccctttcacctgaagcgcgttttccgcaagcgatagaggaaattgtggctgcctgttgttatttccaccagcaggcggaggattatcaaatcaatatgtcccgcattggttttgctggtgattccgcaggtgccatgctggcgctcgccagtgcgttgtggttgcgcgataaacagatcgattgcggtaaagttgcgggcgttttgctgtggtatgggctttacggattacgggattccgtgactcgtcgtctgttgggtggtgtctgggatggcttaacgcaacaggatttgcagatgtatgaagaggcgtatttaagcaacgacgcggaccgcgagtcgccatattactgcctgtttaataatgatctcactcgcgaagttccgccctgttttattgccggggcggagttcgatccactgctggatgacagctgtctgctttaccagacgttagcggcacaccagcaaccttgtgagttcaaactctactccggtatgctgcacgcctttttgcattattcacggatgatgaaaaccgccgacgaggctcttcgcgacggcgctcagttctttaccgctcagctttag

SEQ ID NO: 1164 - protein, 319 aa, Escherichia coli
MKPENKLPVLDLISAEMKTVVNTLQPDLPPWPATGAIAEQRQYYTLERRFWNVGAPEMATRAYRVPTKYGQVKTRLFYPQPDSPATLFYLHGGGFILGNLDTHDRIMRLLASYSQCTVIGIDYTLSPEARFPQAIEEIVAACCYFHQQAEDYQINMSRIGFAGDSAGAMLALASALWLRDKQIDCGKVAGVLLWYGLYGLRDSVTRRLLGGVWDGLTQQDLQMYEEAYLSNDADRESPYYCLFNNDLTREVPPCFIAGAEFDPLLDDSCLLYQTLAAHQQPCEFKLYSGMLHAFLHYSRMMKTADEALRDGAQFFTAQL

SEQ ID NO: 1165 - DNA, 1305 bp, Escherichia coli
atgaaatttcccggtaaacgtaaatccaaacattacttccccgtaaacgcacgcgatccgctgcttcagcaattccagccagaaaacgaaaccagcgctgcctgggtagtgggtatcgatcaaacgctggtcgatattgaagcgaaagtggatgatgaattcattgagcgttatggattaagcgccgggcattcactggtgattgaggatgacgttgccgaagcgctttatcaggaactaaaacagaaaaacctgattacccatcagtttgcgggtggcaccattggtaacaccatgcacaactactcggtgctcgcggacgaccgttcggtgctgctgggcgtcatgtgcagcaatattgaaattggcagctacgcctatcgttacctgtgtaacacctccagccgtaccgatcttaactatctacaaggcgtggatggcccgattggtcgttgctttacgctgattggcgagtccggggaacgtacctttgctatcagcccgggccacatgaaccagctgcgggctgaaagtattccggaagatgtgattgccggagcctcggcactggttctcacctcttatctggtgcgttgcaagccgggtgaacccatgccggaagcaaccatgaaagccattgagtacgcgaagaaatataacgtaccggtggtgctgacgctgggcaccaagtttgtcattgccgagaatccgcagtggtggcagcaattcctcaaagaccacgtctctatccttgcgatgaacgaagatgaagccgaagcgttgaccggagaaagcgatccgttgttggcatctgacaaggcgctggactgggtagatctggtgctgtgcaccgccgggccaatcggcttgtatatggcgggctttaccgaagacgaagcgaaacgtaaaacccagcatccgctgctgccgggtgctatagcggaatttaaccagtatgagtttagccgcgccatgcgccacaaggattgccagaatccgctgcgtgtctattcgcacattgcgccgtacatgggcgggccggaaaaaatcatgaacactaatggagcaggggatggcgcactggcagcgttgctgcatgacattaccgccaacagctaccaccgtagcaacgtaccaaactccagcaaacataaattcacctggttaacttattcatcgttagcgcaggtgtgtaaatatgctaaccgtgtgagctatcaggtactgaaccagcattcacctcgtttaacgcgcggcttgccggagcgtgaagacagcctggaagagtcttactgggatcgttaa

SEQ ID NO: 1166 - protein, 434 aa, Escherichia coli
MKFPGKRKSKHYFPVNARDPLLQQFQPENETSAAWVVGIDQTLVDIEAKVDDEFIERYGLSAGHSLVIEDDVAEALYQELKQKNLITHQFAGGTIGNTMHNYSVLADDRSVLLGVMCSNIEIGSYAYRYLCNTSSRTDLNYLQGVDGPIGRCFTLIGESGERTFAISPGHMNQLRAESIPEDVIAGASALVLTSYLVRCKPGEPMPEATMKAIEYAKKYNVPVVLTLGTKFVIAENPQWWQQFLKDHVSILAMNEDEAEALTGESDPLLASDKALDWVDLVLCTAGPIGLYMAGFTEDEAKRKTQHPLLPGAIAEFNQYEFSRAMRHKDCQNPLRVYSHIAPYMGGPEKIMNTNGAGDGALAALLHDITANSYHRSNVPNSSKHKFTWLTYSSLAQVCKYANRVSYQVLNQHSPRLTRGLPEREDSLEESYWDR

SEQ ID NO: 1167 - DNA, 1677 bp, Escherichia coli
atgcatcacgccaccccgcttatcaccaccattgttggcggccttgtgctcgcctttatcctcggcatgctggccaataaactacgtatttctcctctggtgggatatctgttagcgggtgtgctggcaggaccattcactccgggctttgttgccgataccaagcttgcgccggaactggctgaactgggcgttattttgctgatgttcggcgtcggtttgcatttttcgctcaaggatttgatggcggtaaagtccatcgccattcccggcgcgatcgcccagatagccgtggcgacgctgctgggtatggcgctctccgccgtgctgggctggtcgttaatgaccggtatcgtgttcggcttatgtctttccaccgccagtaccgtggtgttactgcgcgcacttgaagaacggcaattaattgacagtcagcgtgggcaaatcgccatcggttggttgattgtggaagacctggtgatggtcctgacgctggtattgctacccgcggtagcaggaatgatggaacagggcgatgtgggctttgccactcttgcagtcgatatggggatcaccatcggcaaggtgatcgcatttatcgccattatgatgctggtaggtcgccgtctggtgccgtggattatggcacgcagcgcagcaaccggttcccgcgagctgtttaccctgtcggtgctggcgctggcgttagggattgcctttggtgcggtagagctgtttgatgtctcctttgcactcggtgcgttctttgccgggatggtactgaacgagtctgaactgagtcaccgtgccgcccacgatacactgccattgcgcgacgcgtttgcggtgctgttttttgtctccgtcgggatgttgtttgatccgttaattctgattcagcaaccgctggcagtactggcgacgctggcaattattctgtttggtaaatcggtcgcggccctgttccttgtgcgtttgtttggtcactcccagcgcacggcgttaaccatcgccgccagcctggcgcagattggtgagttcgcgtttatcctggcgggactaggaatggcattgaatttactgccgcaggccggacaaaacctggtactggcaggggcgatcctgtcgattatgctcaacccggtactgttcgcactactggagaaatatctggcgaagaccgaaacgctggaagagcagacgctggaagaggcaatcgaagaagagaagcagatcccagtggatatttgcaaccatgcgctactggtgggttacggtcgtgtaggcagcctgctgggggagaaattgctcgcctctgatattccgctggtggtgattgagacgtcacgaacccgtgttgatgagctgcgcgagcgcggggtccgcgcagtattgggcaatgcggctaacgaagaaattatgcaactggcgcatctggaatgtgcaaaatggctgatcctgacgattcccaacggctatgaagcgggcgagattgtggcatctgcccgcgcgaaaaatccggatattgagattattgcccgcgcccattatgacgatgaagtggcgtatatcaccgaacgtggtgcgaatcaggtagtgatgggtgagcgtgaaattgcccgtactatgctggaactgctggaaacgccaccggcgggtgaggtggtgacgaggtaa

SEQ ID NO: 1168 - protein, 558 aa, Escherichia coli
MHHATPLITTIVGGLVLAFILGMLANKLRISPLVGYLLAGVLAGPFTPGFVADTKLAPELAELGVILLMFGVGLHFSLKDLMAVKSIAIPGAIAQIAVATLLGMALSAVLGWSLMTGIVFGLCLSTASTVVLLRALEERQLIDSQRGQIAIGWLIVEDLVMVLTLVLLPAVAGMMEQGDVGFATLAVDMGITIGKVIAFIAIMMLVGRRLVPWIMARSAATGSRELFTLSVLALALGIAFGAVELFDVSFALGAFFAGMVLNESELSHRAAHDTLPLRDAFAVLFFVSVGMLFDPLILIQQPLAVLATLAIILFGKSVAALFLVRLFGHSQRTALTIAASLAQIGEFAFILAGLGMALNLLPQAGQNLVLAGAILSIMLNPVLFALLEKYLAKTETLEEQTLEEAIEEEKQIPVDICNHALLVGYGRVGSLLGEKLLASDIPLVVIETSRTRVDELRERGVRAVLGNAANEEIMQLAHLECAKWLILTIPNGYEAGEIVASARAKNPDIEIIARAHYDDEVAYITERGANQVVMGEREIARTMLELLETPPAGEVVTR

SEQ ID NO: 1169 - DNA, 1221 bp, Escherichia coli
atggcaatgagtgaacaaacccagcctgtggcgggcgcggctgcgtcaacgactaaggcccgaacatcgtttggtattttaggtgctatcagcctctcacatctgctgaacgacatgatccaatcgctgattctggcgatttatccactgcttcagtcagaattttctctgacatttatgcagattggcatgataaccctcaccttccagctcgcctcttcgctactgcaaccggtggtcggctactggaccgataaatatccgatgccgtggtcgttgccgattggcatgtgctttaccttaagtggtctggtgctgctggcgctggcgggcagtttcggcgcagttctgctggcagcggcgctggtcggtaccggttcatcggtctttcatccggaatcttctcgcgtggcccgtatggcttccggcgggcgtcatggcctggcgcaatctatatttcaggtcggcggcaactttggcagttccctgggccccttgctggcggcggtgattatcgcgccttatggcaaaggcaacgttgcctggtttgtgcttgcggcactgctggcgatcgtggtgttggcgcaaatcagccgttggtactcggcacagcaccgaatgaataaaggaaaacccaaagcgacgattatcaatccactgccgcgcaataaagttgttctggcggtcagcattctgttaatcctcattttctcgaaatatttctatatggcgagcatcagcagctattacaccttttatctgatgcaaaaattcggattatctatccagaatgctcagcttcatttgtttgccttcctgtttgccgttgcggcaggtacggtgattggcgggcctgtaggggataaaattggacggaaatatgtgatttggggctctatcctcggtgttgcgccgtttacgctgattttaccctacgccagcctgcactggacgggggttttaacggtgattattggatttatcctcgcttcagcattctctgccattctggtctacgcccaggagctgcttccgggacgtatcggtatggtttctggactgtttttcggttttgctttcggcatgggaggtctgggggcggcagttctggggcttatcgccgaccacaccagcatagagttagtctataaaatctgtgctttcctgccactattggggatattgaccatattcctgcctgataaccggcataaagactga

SEQ ID NO: 1170 - protein, 406 aa, Escherichia coli
MAMSEQTQPVAGAAASTTKARTSFGILGAISLSHLLNDMIQSLILAIYPLLQSEFSLTFMQIGMITLTFQLASSLLQPVVGYWTDKYPMPWSLPIGMCFTLSGLVLLALAGSFGAVLLAAALVGTGSSVFHPESSRVARMASGGRHGLAQSIFQVGGNFGSSLGPLLAAVIIAPYGKGNVAWFVLAALLAIVVLAQISRWYSAQHRMNKGKPKATIINPLPRNKVVLAVSILLILIFSKYFYMASISSYYTFYLMQKFGLSIQNAQLHLFAFLFAVAAGTVIGGPVGDKIGRKYVIWGSILGVAPFTLILPYASLHWTGVLTVIIGFILASAFSAILVYAQELLPGRIGMVSGLFFGFAFGMGGLGAAVLGLIADHTSIELVYKICAFLPLLGILTIFLPDNRHKD

SEQ ID NO: 1171 - DNA, 1653 bp, Escherichia coli
atgaaattattacagcggggcgtggcgttagcactgttaaccacatttacactggcgagtgaaactgctctggcgtacgagcaggataaaacctacaaaattacagttctgcacaccaatgatcatcatgggcatttttggcgcaatgaatatggtgaatatggtctggcggcgcaaaaaacgctggtggatggtatccgcaaagaggttgcggctgaaggcggtagcgtgctgctactttccggtggcgacattaacactggcgtgcccgagtccgacttacaggatgccgaacctgattttcgcggtatgaatctggtgggctatgacgcgatggcgatcggtaatcatgaatttgataacccgctcaccgtattacgccagcaggaaaagtgggctaagttcccgttgctttccgccaatatctaccagaaaagtaccggcgagcgcctgtttaaaccatgggcgctgtttaagcgtcaggatctgaaaattgccgttattggcctgacgacggatgacacagccaaaattggtaatccggaatatttcactgatatcgaatttcgtaagcccgctgatgaagcgaagctggtgattcaggagctgcaacagacagaaaagccagacattattatcgcggcgacctatatggggcattacgacaatggtgagcacggctctaacgcaccgggcgatgtggagatggtacgcgcgctgcctgccggatcgctggcgatgatcgtcggtggtcactcgcaagatccagtctgtatggcggcagaaaacaaaaaacaggtcgattacgtgccgggtacgccatgcaaaccggatcaacaaaacggcatctggattgtgcaggcgcatgagtggggcaaatacgtgggacgggctgattttgagtttcgtaatggcgaaatgaaaatggttaactaccagctgattccggtgaacctgaagaagaaagtgacctgggaagacgggaaaagcgagcgcgtgctgtacacccctgaaatcgctgaaaaccagcaaatgatctcgctgttatcaccgttccagaacaaaggcaaagcgcagctggaagtgaaaataggcgaaaccaatggtcgtctggaaggcgatcgtgacaaagtacgttttgtacagaccaatatggggcggttgattctggcagcacaaatggatcgcactggtgccgactttgcggtgatgagcggaggcggaattcgtgattctatcgaagcaggtgatatcagctataaaaacgtactgaaagtgcagccattcggcaatgtggtggtgtatgccgacatgaccggtaaagaggtgattgattacttgaccgccgtcgcgcagatgaagccagattcaggtgcctacccgcaatttgccaacgttagctttgtggcgaaagacggtaaactgaacgacctgaaaatcaaaggcgaaccggtcgatccggcgaaaacttaccgcatggcgacattaaacttcaatgccaccggcggggatggctatccgcgccttgataacaaaccgggctatgtgaataccggctttattgatgccgaagtgctgaaagcgtatatacagaaaagctcgccgctggatgtgagtgtttatgaaccgaaaggtgaggtgagctggcagtaa

SEQ ID NO: 1172 - protein, 550 aa, Escherichia coli
MKLLQRGVALALLTTFTLASETALAYEQDKTYKITVLHTNDHHGHFWRNEYGEYGLAAQKTLVDGIRKEVAAEGGSVLLLSGGDINTGVPESDLQDAEPDFRGMNLVGYDAMAIGNHEFDNPLTVLRQQEKWAKFPLLSANIYQKSTGERLFKPWALFKRQDLKIAVIGLTTDDTAKIGNPEYFTDIEFRKPADEAKLVIQELQQTEKPDIIIAATYMGHYDNGEHGSNAPGDVEMVRALPAGSLAMIVGGHSQDPVCMAAENKKQVDYVPGTPCKPDQQNGIWIVQAHEWGKYVGRADFEFRNGEMKMVNYQLIPVNLKKKVTWEDGKSERVLYTPEIAENQQMISLLSPFQNKGKAQLEVKIGETNGRLEGDRDKVRFVQTNMGRLILAAQMDRTGADFAVMSGGGIRDSIEAGDISYKNVLKVQPFGNVVVYADMTGKEVIDYLTAVAQMKPDSGAYPQFANVSFVAKDGKLNDLKIKGEPVDPAKTYRMATLNFNATGGDGYPRLDNKPGYVNTGFIDAEVLKAYIQKSSPLDVSVYEPKGEVSWQ

SEQ ID NO: 1173 - DNA, 504 bp, Escherichia coli
atgaaatttgaccatcttgttgatgttagcttccacaattttgtctttaacggaaaattcgattttgtcgaactggggcaaacaatggcatggttggaacaaaactttgttgagccggactctaaaaatgatatgggaaatggtttttatatctggctatttggtaatgttgagtttcatttcgaaaacaacaagctatatatgatttggtgcgattatctgagccaaatccatttgggcaaagcgatccgatttgataaaggaatattgaataacgtcgctgagttgaacgttacgcgtgtatttaacatgcttgttaacgaaggcgctgatctgcaaatccgccgtcaatcgccccatacactcttaatccacgtcaatcgctcaggcgtgacactttggtttgaagcagatgaagaacagcctggtgatccgcagaattatatgctgatggcatttggtttgacacatcgcgattacgatgcaagatttcaatattcataa

SEQ ID NO: 1174 - protein, 167 aa, Escherichia coli
MKFDHLVDVSFHNFVFNGKFDFVELGQTMAWLEQNFVEPDSKNDMGNGFYIWLFGNVEFHFENNKLYMIWCDYLSQIHLGKAIRFDKGILNNVAELNVTRVFNMLVNEGADLQIRRQSPHTLLIHVNRSGVTLWFEADEEQPGDPQNYMLMAFGLTHRDYDARFQYS

SEQ ID NO: 1175 - DNA, 801 bp, Escherichia coli
gtggaaaggattacagagacattaagtatcgcttgtgcagatgagataccggatatcgccttacttcggcaaacatcgagagagaaggtattacatctgcattttgccagcgaagcagagaggtatcgtgaggaattcgggctggtgctgaaagcacagctcgatgaatttgttgttggcatgcattctgccgacccggttatcaggatcgccagattaatatcgcttgaagagattaaccgccatcaggattttttcgaacactgcgcgaaagaatatcgtaagctggcgacagagcttatatttgcattggctgaacaactgaacgttgagatggcggaaaataacccgctagttacctttgcccccttcaaatgcaaccgtaagcgaaaaggcaaaatgggaaagtggcagtattgttttcacggttttcattgtacatttgagaataaaaaaacagagcaaaatattgaagttcccctcgcctacggctttgctttcggcgatctggacccgtattttttttccggatttatcaaatcgacccccgcctggcagcctctgccagtggctatttacgatgattaccacgacggtagcaggatcattcaacaactgctggcgctgggaaagttacaaaaaatcccttcaccgatcccacaatacacgggggttgctgcggtagatcggtccaatgtcgacatcgcaaattttcgctcaacactggagagtcgcctgcaccgatgtaaattacgctggcttttgaagcatgtaaaaaattcacaaaggagcgaaagatga

SEQ ID NO: 1176 - protein, 266 aa, Escherichia coli
MERITETLSIACADEIPDIALLRQTSREKVLHLHFASEAERYREEFGLVLKAQLDEFVVGMHSADPVIRIARLISLEEINRHQDFFEHCAKEYRKLATELIFALAEQLNVEMAENNPLVTFAPFKCNRKRKGKMGKWQYCFHGFHCTFENKKTEQNIEVPLAYGFAFGDLDPYFFSGFIKSTPAWQPLPVAIYDDYHDGSRIIQQLLALGKLQKIPSPIPQYTGVAAVDRSNVDIANFRSTLESRLHRCKLRWLLKHVKNSQRSER

SEQ ID NO: 1177 - DNA, 480 bp, Escherichia coli
atgacacccgcagttaaattactcgaaaaaaacaagatttcgtttcaaatccatacctacgagcacgatccggctgaaaccaattttggcgatgaagtcgtcaaaaaattaggtttgaatccggatcaggtctacaaaacgctgctggtcgcagtgaacggtgatatgaaacaccttgccgtggccgttacgccggtcgcaggtcaactggatcttaaaaaagtagcaaaagcgctgggtgccaagaaagttgagatggccgatccgatggtcgcgcagcgttcgacgggatatctggttggagggattagcccactggggcagaaaaaacgtctgccaacgattatcgacgcccccgcacaagaatttgccactatttatgtttccggcggcaagcgcggtctggatatcgaactggcggcaagcgacctggcaaagatactcgatgccaaatttgctgatatcgcccgtcgcgattaa

SEQ ID NO: 1178 - protein, 159 aa, Escherichia coli
MTPAVKLLEKNKISFQIHTYEHDPAETNFGDEVVKKLGLNPDQVYKTLLVAVNGDMKHLAVAVTPVAGQLDLKKVAKALGAKKVEMADPMVAQRSTGYLVGGISPLGQKKRLPTIIDAPAQEFATIYVSGGKRGLDIELAASDLAKILDAKFADIARRD

SEQ ID NO: 1179 - DNA, 795 bp, Escherichia coli
atggatctgttgtaccgggtaaaaacgctttgggccgcgctgcgcggtaatcattacacctggcctgctatcgatatcactcttcccggcaatcgccattttcatctgattggcagtattcatatgggtagccacgatatggctcccctgcccacccgtttgctcaaaaagctcaaaaacgccgatgcgctgatcgtcgaggcggatgtttccaccagcgatacgccttttgccaatttgcctgcctgcgaggcactggaagagcgcattagcgaggagcaactccaaaacctgcagcacattagccaggagatgggcatttctccgtcgctcttttctacccaaccgttgtggcaaatcgcgatggttcttcaggcgacgcaggcacaaaaactggggctgcgggcagaatacggtatcgattaccagctattgcaggcggcgaagcaacaacataaacccgtgattgaactggaaggggctgaaaaccagattgccatgttgctccagctccctgacaaaggactggcgctgctggacgacacgctgacccactggcacaccaatgcacggttgctgcaacaaatgatgagctggtggttgaatgcgccgccgcaaaataatgaaataacgctgcccaatacgttcagtcagtcgctgtacgatgtgctgatgcatcagcgaaatctcgcctggcgggataaattacgcgccatgccgccggggcgctatgtggtcgcagtcggtgcactacacctgtatggagaagggaatttgccgcagatgttgcgctaa

SEQ ID NO: 1180 - protein, 264 aa, Escherichia coli
MDLLYRVKTLWAALRGNHYTWPAIDITLPGNRHFHLIGSIHMGSHDMAPLPTRLLKKLKNADALIVEADVSTSDTPFANLPACEALEERISEEQLQNLQHISQEMGISPSLFSTQPLWQIAMVLQATQAQKLGLRAEYGIDYQLLQAAKQQHKPVIELEGAENQIAMLLQLPDKGLALLDDTLTHWHTNARLLQQMMSWWLNAPPQNNEITLPNTFSQSLYDVLMHQRNLAWRDKLRAMPPGRYVVAVGALHLYGEGNLPQMLR

SEQ ID NO: 1181 - DNA, 288 bp, Escherichia coli
aatataaggagttttcgtgatgcctggttggctgatttttttgtccattcaacgccacatcgaaagatccctgctgaaatccataccacgttatcacgaaagttggacatcattaatgctgccacttctcattgggatttacgctcccctccggggaaccgatacgaagagttatccgggaaattacaggaatactcctccattagagtgaataaacagtaccgactgatttttaaatgggttaatggcaaggccgaagaattgtttttagacccacacaactactaa

SEQ ID NO: 1182 - protein, 95 aa, Escherichia coli
NIRSFRDAWLADFFVHSTPHRKIPAEIHTTLSRKLDIINAATSHWDLRSPPGNRYEELSGKLQEYSSIRVNKQYRLIFKWVNGKAEELFLDPHNY

SEQ ID NO: 1183 - DNA, 342 bp, Escherichia coli
atgaaacaggcaacaagaaaaccgacgacacccggagatattcttctctatgaatatctggaaccgctcgatttgaaaatcaatgagttagcagagttgctgcatgttcatcgtaatagcgtcagtgcactgatcaataacaatcgtaaactcaccactgagatggcattccgtctggcgaaagtttttgataccacagtcgatttttggctaaacctccaggcggcagttgatctttgggaagttgaaaacaacatgcgtacccaggaagaattgggacggattgaaacagtggctgaatatttggcacgccgtgaagagcgtgcaaaaaaggtcgcgtag

SEQ ID NO: 1184 - protein, 113 aa, Escherichia coli
MKQATRKPTTPGDILLYEYLEPLDLKINELAELLHVHRNSVSALINNNRKLTTEMAFRLAKVFDTTVDFWLNLQAAVDLWEVENNMRTQEELGRIETVAEYLARREERAKKVA

SEQ ID NO: 1185 - DNA, 2505 bp, Escherichia coli
atgtcacaaactatcgacctgaccctggacggcctgtcctgcggtcactgcgttaaacgcgtgaaagaaagtctcgaacagcgcccggatgttgaacaggcggatgtgtctatcactgaagcgcacgttaccgggactgccagtgcagaacagctgatcgaaaccatcaaacaagcgggttatgacgcatctgtaagccacccaaaggctaaaccgctggcggagtcatcaatcccgtcggaagcactgacagcggtttctgaggcgcttccggcagcgaccgccgatgacgatgacagccagcagttgctgctgagcggcatgagctgcgccagctgtgtcacccgcgtacaaaatgcgttgcaaagcgtaccgggcgtcactcaggcacgggtaaacctggcggagcgtactgcgctggtgatgggcagcgcctccccacaagatttagtgcaggcggtggaaaaagcgggctacggcgcggaagcgattgaagatgacgctaaacgccgcgaacgccagcaagaaaccgccgtcgctacgatgaagcgcttccgctggcaggcaattgtcgcactggcggtgggtatcccggtgatggtctgggggatgatcggcgataacatgatggtcaccgccgacaaccgcagcctgtggttggttatcggcctgataaccctggcggtaatggttttcgccggcgggcatttttaccgcagcgcatggaaaagcctgctgaacggtgcagcgacgatggatacgctggtggcgctgggtactggcgtggcgtggctctattcgatgagcgtcaacctgtggccgcagtggttcccgatggaagcgcgacatctttattacgaagccagcgcgatgattattggtctgatcaatctcggccatatgctggaagcgcgcgcgcgtcagcgttcttctaaggcgctggagaaattactcgatttaaccccaccgacggcgcgcctggtcaccgacgaaggtgaaaaaaacgtgccgctggcagatgttcagccaggtatgttactgcgcctgacgaccggcgaccgtgtgccggtagatggtgagattactcaaggcgaagcgtggctggatgaagcgatgctgacgggcgaacctatcccgcagcaaaaaggcgaaggcgatagcgtccatgccgggacagtggtgcaggacggtagcgtgctgtttcgcgccagtgcggttggcagccatactacgctgtcgcggattattcgtatggtgcgccaggcccagagcagtaagccagaaatcggtcagctggcggataaaatctcagccgtatttgtgccggtagtggtggtgattgcgctgatcagtgcggcaatctggtatttctttggtccggcaccgcagattgtctacaccctggtgattgccaccacggtgctgattattgcctgtccgtgtgcgctggggctggcgacgccgatgtcgattatttcgggcgtcgggcgggcggctgagtttggcgtgctggtacgggacgccgacgcgctgcaacgcgccagtacgctcgacaccgtagtgttcgataaaaccgggacgctgaccgaaggtaaaccgcaggttgtcgcagtaaaaacgtttgctgatgttgatgaagcgcaagcattgcgtctggcggcggcgctggagcaaggttccagccatccgctggcacgagcgatcctcgataaagcaggtgatatgcagctgccgcaggtcaacggtttccgcacattgcgcgggctgggcgtgagcggtgaagctgaaggtcatgcgttattgctgggtaatcaggcgttgttaaatgagcaacaggttgataccaaagctatcgaagcggagattactgctcaggcatcgcaaggggcaacgcctgtgctgctggcggttgacgggaaagcggtagccctgctggctgtacgcgatccattgcgtagtgatagcgtggcggcgctgcaacgcctgcataaagcgggatatcgcctggtgatgctaaccggggataacccgaccaccgccaatgcgatcgctaaagaagcagggattgatgaggtgatagccggcgtgctgccggacggtaaagccgaagcgatcaaacgtctgcaaagtgaaggacgtcaggtagcaatggtgggcgacggcattaacgatgcgccagcgctggctcaggcggatgtcggtattgcgatggggggcggcagtgatgttgccattgaaaccgcggcgattaccctgatgcgccatagcctgatgggtgttgcggatgcgctcgcaatttcccgcgcaacgctgcgcaacatgaagcagaacctgctcggtgcgtttatctacaacagcattggtattccggtcgccgccggtattttgtggccgttcactggaacactgcttaacccggtggttgccggagcggcaatggcgctctcgtcgatcaccgtagtgagtaacgccaaccgcttgctgcggtttaaaccgaaggaataa

SEQ ID NO: 1186 - protein, 834 aa, Escherichia coli
MSQTIDLTLDGLSCGHCVKRVKESLEQRPDVEQADVSITEAHVTGTASAEQLIETIKQAGYDASVSHPKAKPLAESSIPSEALTAVSEALPAATADDDDSQQLLLSGMSCASCVTRVQNALQSVPGVTQARVNLAERTALVMGSASPQDLVQAVEKAGYGAEAIEDDAKRRERQQETAVATMKRFRWQAIVALAVGIPVMVWGMIGDNMMVTADNRSLWLVIGLITLAVMVFAGGHFYRSAWKSLLNGAATMDTLVALGTGVAWLYSMSVNLWPQWFPMEARHLYYEASAMIIGLINLGHMLEARARQRSSKALEKLLDLTPPTARLVTDEGEKNVPLADVQPGMLLRLTTGDRVPVDGEITQGEAWLDEAMLTGEPIPQQKGEGDSVHAGTVVQDGSVLFRASAVGSHTTLSRIIRMVRQAQSSKPEIGQLADKISAVFVPVVVVIALISAAIWYFFGPAPQIVYTLVIATTVLIIACPCALGLATPMSIISGVGRAAEFGVLVRDADALQRASTLDTVVFDKTGTLTEGKPQVVAVKTFADVDEAQALRLAAALEQGSSHPLARAILDKAGDMQLPQVNGFRTLRGLGVSGEAEGHALLLGNQALLNEQQVDTKAIEAEITAQASQGATPVLLAVDGKAVALLAVRDPLRSDSVAALQRLHKAGYRLVMLTGDNPTTANAIAKEAGIDEVIAGVLPDGKAEAIKRLQSEGRQVAMVGDGINDAPALAQADVGIAMGGGSDVAIETAAITLMRHSLMGVADALAISRATLRNMKQNLLGAFIYNSIGIPVAAGILWPFTGTLLNPVVAGAAMALSSITVVSNANRLLRFKPKE

SEQ ID NO: 1187 - DNA, 933 bp, Escherichia coli
atgttagatgcaaacaaattacagcaggcagtggatcagacttacacccaatttcactcacttaacggcggacaaaatgccgattacattccctttctggcgaatgtccctggtcaactggcggcagtggctatcgtgaccagcgatggcaacgtctatagtgcgggtgacagtgattaccgctttgcgctggaatccatctcgaaagtctgtacgttagcccttgcgttagaagatgtcggcccgcaggcggtacaggacaaagttggcgctgacccgaccggattgccctttaactcagttatcgccttagagttgcatggcggcaaaccgctttcgccactggtaaatgctggcgctattgccaccaccagcctgattaacgctgaaaatactgaacaacgctggcagcgaattttacatatccaacaacaactggctggtgagcaggtagcgctctctgatgaagtcaaccagtcggaacaaacaaccaacttccataaccgggccattgcctggctgctgtactccgccggatatctctattgtgatgcaatggaagcctgtgacgtgtacacccgtcagtgctccacgctcatcaatactattgaactggcaacgcttggcgcgacgctggcggcgggtggtgtgaatccgctgacgcataaacgcgttcttcaggccgacaatgtgccgtacattctggccgaaatgatgatggaagggctgtatggtcgctccggtgactgggcgtatcgcgttggtttaccgggcaaaagcggtgtaggtggcggtattctggcggtcgttcctggcgtgatgggaattgccgcgttttcaccaccgctggatgaagaaggcaacagtgttcgcggtcaaaaaatggtggcatcggtcgctaagcaactcggctataacgtgtttaagggctga

SEQ ID NO: 1188 - protein, 310 aa, Escherichia coli
MLDANKLQQAVDQTYTQFHSLNGGQNADYIPFLANVPGQLAAVAIVTSDGNVYSAGDSDYRFALESISKVCTLALALEDVGPQAVQDKVGADPTGLPFNSVIALELHGGKPLSPLVNAGAIATTSLINAENTEQRWQRILHIQQQLAGEQVALSDEVNQSEQTTNFHNRAIAWLLYSAGYLYCDAMEACDVYTRQCSTLINTIELATLGATLAAGGVNPLTHKRVLQADNVPYILAEMMMEGLYGRSGDWAYRVGLPGKSGVGGGILAVVPGVMGIAAFSPPLDEEGNSVRGQKMVASVAKQLGYNVFKG

SEQ ID NO: 1189 - DNA, 1293 bp, Escherichia coli
atgatgaacacggaaggtaataacggtaacaaacctctcggtctatggaacgtcgtttccatcggcattggggcaatggtgggggcggggatcttcgcgctgctggggcaggctgcgttgctaatggaagcctcgacctgggtcgcctttgcttttggcggtattgtggcgatgttttccggttatgcctatgcgcgtctgggggcgagctatcccagcaatggcggtattatcgacttctttcgtcgcggattaggcaacggcgttttttcgctggcgctctcgttattgtacctgttgacgctggcggtgagtatcgccatggtcgcccgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgattattgccggtgtctggtcgctgcaaccggcgcatatttccgtttctgcgccccccagttccggggcgttcttctcctgtatcgggataaccttccttgcctatgcgggctttggcatgatggcgaacgcggcggataaagtgaaagatccggaggtcataatgccacgggcgtttctggtggcgattggcgttaccacgttgctttatatctcgctggcgctggttttgcttagcgatgtgtcggcattagagttagaaaaatatgccgataccgccgtagcgcaggctgcttctccgctcctcgggcatgtggggtatgtgatcgtcgtcatcggcgctttactggcgacggcttcagccatcaacgcaaacctgttcgccgtgtttaacatcatggacaacatgggcagcgaacgcgaactgccgaagctaatgaataaacctctgtggcggcagagtacctggggcaacatcatcgtcgtggtgttgattatgctgatgacggcggcgctgaatttaggctcactcgccagcgttgccagcgccacctttttgatctgctatctggcggtgtttgtggtggcgatccgcctgcgtcatgatattcacgcctcgttgccgattcttatcgttggtacgttggttatgttgttggtgatcgttggctttatctacagtctctggtcccagggcagccgtgcgctgatatggattattggcgcactcttactcagccttattgtggcaatggtcatgaagcgcaataaaaccgtataa

SEQ ID NO: 1190 - protein, 430 aa, Escherichia coli
MMNTEGNNGNKPLGLWNVVSIGIGAMVGAGIFALLGQAALLMEASTWVAFAFGGIVAMFSGYAYARLGASYPSNGGIIDFFRRGLGNGVFSLALSLLYLLTLAVSIAMVARAFGAYAVQFLHEGSQEEHLILLYALGIIAVMTLFNSLSNHAVGRLEVILVGIKMMILLLLIIAGVWSLQPAHISVSAPPSSGAFFSCIGITFLAYAGFGMMANAADKVKDPEVIMPRAFLVAIGVTTLLYISLALVLLSDVSALELEKYADTAVAQAASPLLGHVGYVIVVIGALLATASAINANLFAVFNIMDNMGSERELPKLMNKPLWRQSTWGNIIVVVLIMLMTAALNLGSLASVASATFLICYLAVFVVAIRLRHDIHASLPILIVGTLVMLLVIVGFIYSLWSQGSRALIWIIGALLLSLIVAMVMKRNKTV

SEQ ID NO: 1191 - DNA, 408 bp, Escherichia coli
atgaacattagcgatgtagcaaaaattaccggcctgaccagcaaagccattcgcttctatgaagagaaggggctggtgacgccgccgatgcgcagcgaaaacggttatcgcacctacacgcagcagcatctcaacgaactgaccttactgcgccaggcacgccaggtgggctttaacctggaggagagcggcgaactggtgaatctgtttaacgatccgcagcgtcatagtgccgacgtcaaacgtcgtacgctggagaaggtggcggagatcgaacggcatatcgaagaactgcaatccatgcgcaaccagctactggcgctggcgaatgcctgccctggcgatgacagcgccgactgcccgattatcgaaaatctctccggctgctgtcatcatcgggcggggtga

SEQ ID NO: 1192 - protein, 135 aa, Escherichia coli
MNISDVAKITGLTSKAIRFYEEKGLVTPPMRSENGYRTYTQQHLNELTLLRQARQVGFNLEESGELVNLFNDPQRHSADVKRRTLEKVAEIERHIEELQSMRNQLLALANACPGDDSADCPIIENLSGCCHHRAG

SEQ ID NO: 1193 - DNA, 204 bp, Escherichia coli
atgaaggagcaaaggaaaatccccctgacgcatattatgattatcggtgcgtttatttttgccttcttgcaagtggtgttattagcctccctggttcacgctgtgaatgttaacaacgaaatccaggaaggcttatttcagtcggggcgcattatggtagaaagtttgcagcatattctttcggtgcaaacggagattaactga

SEQ ID NO: 1194 - protein, 67 aa, Escherichia coli
MKEQRKIPLTHIMIIGAFIFAFLQVVLLASLVHAVNVNNEIQEGLFQSGRIMVESLQHILSVQTEIN

SEQ ID NO: 1195 - DNA, 423 bp, Escherichia coli
atgatgaatagctccattaaatcgttttccctgctggcggttatattactgactggctgtagttcacccacttcccgcatcgcagattgccaggcgcagggcgtcagccatgacacctgttatctcgcagaacaacagcgtcagacggctattttaagtgcatccgaggcgcaggcatttaaaaatgcagaagccgcacaacatgcccaggcggcaaagaaagccatttataaaggatttggcatgacctttagaatgagcagtaagaactttgcttatctcaatgattcattatgtgcaattgatgaagacaataaagatgccactgtttatcagtcaggtctttataacgtcattgtttatcaccatacgggaaaagtcgccttaatgaaggaaggtcagtttgtgggttatttaaaatga

SEQ ID NO: 1196 - protein, 140 aa, Escherichia coli
MMNSSIKSFSLLAVILLTGCSSPTSRIADCQAQGVSHDTCYLAEQQRQTAILSASEAQAFKNAEAAQHAQAAKKAIYKGFGMTFRMSSKNFAYLNDSLCAIDEDNKDATVYQSGLYNVIVYHHTGKVALMKEGQFVGYLK

SEQ ID NO: 1197 - DNA, 1017 bp, Escherichia coli
atgaaaactgtaaacgtagctttactggcactcataatttcagcaacatccagccctgttgttttagctggtgataccattgaagcggcggcaacagagctttcagccattaactccggcatgtcgcaatcggagattgagcagaagattacccgctttttagaacgcacagacaacagtcccgctgcgtatacctatttgactgaacatcactacatcccttctgaaacacctgataccactcagactccccctgtccagacagatcctgacgcaggacaaaaaaccgttgccgctacaggtgttgtacagatacctgcccgttatcagagcatgatcaacgcccgacagtctgcggtaactgacgcccagcaaacgcaaattacagagcaacaggcgcagatcgtagccacacaaaaaacgctcgccgcgactggagatacgcaaaataccgcgcattatcaggagatgattaatgccagactggcggctcaaaatgaggctaatcagcgcactaccacggaacaagggcagaaaatgaatgcactgacaaccgatgtggcagcacaacagcaaaaagaaagggctcaatacgataaacaaatgcaaagtctggcgcagaagtctgtccaggcacatgagcaaattgaaagtctgagacaagattccgcacaaacgcagcaacagttaaccaacacgcaaaaacgggtcgcagataacagccaacaaattaacacgctcaataaccatttcgattctctgaaaaacgaagttgaggacaatcgtaaagaagccaatgcgggaactgcatctgccatcgctatcgcctcacaaccacaggtgaaaaccggtgacgtgatgatggtgtcagcgggagcgggaaccttcaacggtgaatctgcggtgtctgtaggaacatcttttaatgccggaacgcatacggtacttaaagccggtatttctgcggatacgcaatctgatttcggcgcaggtgtcggcgtaggatattcgttctaa

SEQ ID NO: 1198 - protein, 338 aa, Escherichia coli
MKTVNVALLALIISATSSPVVLAGDTIEAAATELSAINSGMSQSEIEQKITRFLERTDNSPAAYTYLTEHHYIPSETPDTTQTPPVQTDPDAGQKTVAATGVVQIPARYQSMINARQSAVTDAQQTQITEQQAQIVATQKTLAATGDTQNTAHYQEMINARLAAQNEANQRTTTEQGQKMNALTTDVAAQQQKERAQYDKQMQSLAQKSVQAHEQIESLRQDSAQTQQQLTNTQKRVADNSQQINTLNNHFDSLKNEVEDNRKEANAGTASAIAIASQPQVKTGDVMMVSAGAGTFNGESAVSVGTSFNAGTHTVLKAGISADTQSDFGAGVGVGYSF

SEQ ID NO: 1199 - DNA, 363 bp, Escherichia coli
atgaatgaatttgagaagatttttaatgaaatgaatctggaccgggcattgctaccgatcctttttcgttcgaaccggtcaacagtgtggaaatatttaagtggcgatagtacggctcctgcctcagctatgtcactgattatgctgttgcagttaatccagaaacgaaaccccgatctgttagccgaatggttaacgctttctgatttcaccattccgccagaagtttacctggaccaacctgattactggaaagggtgggtgtatacccaacacaaggtcaataaaaacgtcctggaatatctaaaaaaacactatccggatgaagaccaaaaaagtatgggtaaaggccgggaagagtaa

SEQ ID NO: 1200 - protein, 120 aa, Escherichia coli
MNEFEKIFNEMNLDRALLPILFRSNRSTVWKYLSGDSTAPASAMSLIMLLQLIQKRNPDLLAEWLTLSDFTIPPEVYLDQPDYWKGWVYTQHKVNKNVLEYLKKHYPDEDQKSMGKGREE

SEQ ID NO: 1201 - DNA, 459 bp, Escherichia coli
atgatggagttaatggtcgttcatccacatattttctggctaagtctcggcggtttgctgctggcagccgagatgttgggcggcaatggttatctgttgtggagcggcgtggcagcggtgattaccggtctggtggtctggttgctgccgctgggttgggagtggcaaggggtaatgtttgccgtcctgacgctgctcgccgcctggctgtggtggaaatggttgtcgcggcgggtgcgcgaacaaaagcacagcgacagtcatttaaaccagcgcgggcagcagttgattggccgacgttttgttctggaatctccgctggtcaacgggcgcggtcatatgcgcgtcggtgacagttcatggcctgtcagcgccagcgaggatctcggtgcaggtacgcatgttgaagtcattgcgatagaagggataacgctgatcatccgtgcggtcatcgcctga

SEQ ID NO: 1202 - protein, 152 aa, Escherichia coli
MMELMVVHPHIFWLSLGGLLLAAEMLGGNGYLLWSGVAAVITGLVVWLLPLGWEWQGVMFAVLTLLAAWLWWKWLSRRVREQKHSDSHLNQRGQQLIGRRFVLESPLVNGRGHMRVGDSSWPVSASEDLGAGTHVEVIAIEGITLIIRAVIA

SEQ ID NO: 1203 - DNA, 918 bp, Escherichia coli
atgcttatctttatcccgattctcatttttgtcgcgctggtcattgtcggcgcgggcgtcaaaatcgtgccgcagggctatcaatggacggtagaacgctttggtcgctataccaaaacgttacagccaggtctaagcctggtggtgccctttatggatcgcattggtcgcaagatcaatatgatggagcaagtgctcgacatcccttcccaggaagttatctcgaaagataacgccaacgttaccatcgacgccgtgtgctttattcaggtgattgacgcgccgcgcgcggcttatgaagtcagcaatctggagctggcgatcatcaacctgaccatgactaacattcgtaccgtgctgggttcaatggaacttgatgaaatgctctctcagcgcgacagcattaactcgcgtctgctgcatattgtcgatgaggccaccaacccgtgggggattaaagtcacccgtatcgaaattcgtgatgtgcgcccgcccgcagagcttatctcttcaatgaacgcgcagatgaaagcggaacgtaccaaacgcgcttacatccttgaagcggaagggatccgtcaggcggaaatcctcaaagccgaaggtgaaaaacagtcacaaatcctgaaagcggaaggcgaacgtcagtcggcgtttttacaggctgaagcgcgtgaacgttccgctgaagcagaagcccgcgccaccaaaatggtgtctgaagccatcgcctccggtgatattcaggcggtgaactacttcgtcgcacagaaatacaccgaagcgttacagcagatcggttcgtccagtaacagcaaagtggtgatgatgccattagaggccagcagcctgatggggtcgattgccgggattgctgagctggtgaaagacagcgccaacaaacggactcagccatga

SEQ ID NO: 1204 - protein, 305 aa, Escherichia coli
MLIFIPILIFVALVIVGAGVKIVPQGYQWTVERFGRYTKTLQPGLSLVVPFMDRIGRKINMMEQVLDIPSQEVISKDNANVTIDAVCFIQVIDAPRAAYEVSNLELAIINLTMTNIRTVLGSMELDEMLSQRDSINSRLLHIVDEATNPWGIKVTRIEIRDVRPPAELISSMNAQMKAERTKRAYILEAEGIRQAEILKAEGEKQSQILKAEGERQSAFLQAEARERSAEAEARATKMVSEAIASGDIQAVNYFVAQKYTEALQQIGSSSNSKVVMMPLEASSLMGSIAGIAELVKDSANKRTQP

SEQ ID NO: 1205 - DNA, 678 bp, Escherichia coli
atgcaggaaaatagtcctttgcttcagctacaaaacgtaggatatctggcgggtgatacgaagattcttaataacatcaatttttcgctgcgtgctggcgaatttaagttaattaccggtccttctggttgtggcaaaagtacactgctaaaaatagttgcttcattgatcagcccaaccagcggaacgttactgtttgaaggtgaggatgtcagcacactaaagccagaaatctaccgccagcaagtctcttactgcgcccagacgccgacgctgtttggcgatacggtatacgataacctgatttttccctggcagatccgtaaccagcagcctgacccggccatttttctcgattttcttgaacgcttcgctttaccggacagcattttgacgaagaatatcgccgagctatctggtggtgaaaaacaacgcatctcattgattcgtaacctgcaatttatgccgaaggttttattgctcgacgaaatcaccagtgcgctggatgaaagtaataaacataacgttaatgagatgatccaccgttatgtgcgcgagcaaaatattgccgtgctgtgggtgacacacgataaagacgaaattaatcatgcggataaggtgattacactgcaaccgcatgccggagaaatgcaggaagcacgctatgaactcgcataa

SEQ ID NO: 1206 - protein, 225 aa, Escherichia coli
MQENSPLLQLQNVGYLAGDTKILNNINFSLRAGEFKLITGPSGCGKSTLLKIVASLISPTSGTLLFEGEDVSTLKPEIYRQQVSYCAQTPTLFGDTVYDNLIFPWQIRNQQPDPAIFLDFLERFALPDSILTKNIAELSGGEKQRISLIRNLQFMPKVLLLDEITSALDESNKHNVNEMIHRYVREQNIAVLWVTHDKDEINHADKVITLQPHAGEMQEARYELA

SEQ ID NO: 1207 - DNA, 780 bp, Escherichia coli
atgaactcgcataatattactaacgaatcattggcactggcattaatgctggtggtggtggcaatcttaattagccataaagaaaagctggcgctggagaaagacattctctggagcgtcgggcgtgcgataattcagctgattattgtcggctatgtgctgaagtatattttcagcgtggatgatgccagcctgacattattgatggtgttatttatctgctttaatgcggcgtggaatgcgcaaaaacgcagtaaatatattgctaaagcttttatctcatcgtttattgccattacggtcggggcgggaattaccctggcggtgctgattctctcagggtcgattgaatttatcccgatgcaggtgatccctatcgccgggatgatagccggtaacgccatggtagcggtggggttgtgttacaacaatttagggcaacgggttattagcgaacagcaacagattcaggagaaactgagtcttggcgcgacgccgaaacaggcttcagctatattgattcgcgacagtattcgcgcggctttaattccgacggtcgattcagcaaaaacggttggcttagtgagtttaccaggaatgatgtccgggctgatatttgccgggattgatccggtgaaggcgattaaatatcagattatggtgacctttatgctgctctcaactgccagcctgtctaccattattgcctgctatttaacctatcgtaaattttataattcgcgccaccagttggtggtgacgcaattgaagaagaaatga

SEQ ID NO: 1208 - protein, 259 aa, Escherichia coli
MNSHNITNESLALALMLVVVAILISHKEKLALEKDILWSVGRAIIQLIIVGYVLKYIFSVDDASLTLLMVLFICFNAAWNAQKRSKYIAKAFISSFIAITVGAGITLAVLILSGSIEFIPMQVIPIAGMIAGNAMVAVGLCYNNLGQRVISEQQQIQEKLSLGATPKQASAILIRDSIRAALIPTVDSAKTVGLVSLPGMMSGLIFAGIDPVKAIKYQIMVTFMLLSTASLSTIIACYLTYRKFYNSRHQLVVTQLKKK

SEQ ID NO: 1209 - DNA, 891 bp, Escherichia coli
atgtcaaagaaaatatcgacaacagagagcgactccatgtccgtagaaaatattgtcaacattaacgaatctaacctgcaacaggttcttgaacagtcgatgaccactccggtgctgttctatttttggtctgaacgtagccagcactgtttgcagttaaccccaattctggaaagcctcgcggcgcagtacaacgggcaatttattctggcgaagctggactgcgacgcggagcagatgattgccgcccagtttggtctgcgcgcgattccgaccgtgtatctgttccagaacgggcaaccggtagacggcttccaggggccgcaaccggaagaggcgatccgcgccctgctggataaagtgctgccgcgcgaagaagagctgaaagcgcagcaggcgatgcagctgatgcaggaaggcaattacaccgacgccttgccattgctgaaagacgcctggcagttgtcgaatcagaacggggagatcggcctgctgctggcagaaacgctgattgcgctgaaccgttctgaagatgctgaagccgtgctgaaaaccattcctttacaggatcaggacacccgctaccaggggctggtggcgcaaatcgaactgctgaagcaggcggcagatacgccggaaattcaacagttgcaacagcaggtggcggagaatccagaagatgccgcactggcaacgcaactggcgctgcaactgcatcaggttgggcgcaatgaagaggcgctggagttgctgttcgggcatctgcgtaaagatctcaccgccgcagacggtcagacgcgtaaaacgttccaggagatccttgctgcgctgggtacgggtgatgcactggcgtcgaagtatcgccgccagctgtatgcgttgttgtattga

SEQ ID NO: 1210 - protein, 296 aa, Escherichia coli
MSKKISTTESDSMSVENIVNINESNLQQVLEQSMTTPVLFYFWSERSQHCLQLTPILESLAAQYNGQFILAKLDCDAEQMIAAQFGLRAIPTVYLFQNGQPVDGFQGPQPEEAIRALLDKVLPREEELKAQQAMQLMQEGNYTDALPLLKDAWQLSNQNGEIGLLLAETLIALNRSEDAEAVLKTIPLQDQDTRYQGLVAQIELLKQAADTPEIQQLQQQVAENPEDAALATQLALQLHQVGRNEEALELLFGHLRKDLTAADGQTRKTFQEILAALGTGDALASKYRRQLYALLY

SEQ ID NO: 1211 - DNA, 810 bp, Escherichia coli
atgactcataaagcaacggagatcctgacaggtaaagttatgcaaaaatcggtcttaattaccggatgttccagtggaattggcctggaaagcgcgctcgaattaaaacgccagggttttcatgtgctggcaggttgccggaaaccggatgatgttgagcgcatgaacagcatgggatttaccggcgtgttgatcgatctggatttgccagaaagtgttgatcgcgcagccgacgaagtgatcgccctgaccgataattgtctgtatgggatctttaacaatgccggattcggcatgtatggccccctttccaccatcagccgtgcgcagatggaacagcagttttccgccaactttttcggcgcacaccagctcaccatgcgcctgttacccgcgatgttaccgcacggtgaaggacgtattgtgatgacctcatcggtgatgggattaatctccacgccgggtcgtggcgcttacgcggccagtaaatatgcgctggaggcgtggtcagacgcactgcgcatggagctacgttacagcggaattaaagttagcctgatcgaacccggtcccattcgtactcgcttcaccgacaacgtcaaccagacgcaaagtgataaacctgtcgaaaatcccggcatcgccgcccgctttacgttgggaccggaagcggtggtcgacaaagtgcgccatgcttttattagcgagaagccgaagatgcgctatccggtaacgctggtgacctgggcagtaatggtgcttaagcgcctgctgccggggcgcgtgatggacaaaatattgcaggggtga

SEQ ID NO: 1212 - protein, 269 aa, Escherichia coli
MTHKATEILTGKVMQKSVLITGCSSGIGLESALELKRQGFHVLAGCRKPDDVERMNSMGFTGVLIDLDLPESVDRAADEVIALTDNCLYGIFNNAGFGMYGPLSTISRAQMEQQFSANFFGAHQLTMRLLPAMLPHGEGRIVMTSSVMGLISTPGRGAYAASKYALEAWSDALRMELRYSGIKVSLIEPGPIRTRFTDNVNQTQSDKPVENPGIAARFTLGPEAVVDKVRHAFISEKPKMRYPVTLVTWAVMVLKRLLPGRVMDKILQG

SEQ ID NO: 1213 - DNA, 657 bp, Escherichia coli
atgctccccctgaccgacggacttcttaagatgatgaacttcaacaatgttttccgctggcatttgcccttcctgttcctggtcctgttaaccttccgtgccgccgcagcggacacgttattgattctgggtgatagcctgagcgccgggtatcgaatgtctgctagcgcggcctggcctgccttgttgaatgataagtggcagagtaaaacgtcggtagtcaatgccagcatcagcggcgacacctcgcaacaagggctggcgcgccttccggctctgctgaaacagcatcagccgcgctgggtgctggtagaactgggcggcaatgacggtttgcgtggttttcagccacaacaaaccgagcaaacgctgcgccagatattgcaggatgtcaaagccgccaacgctgaaccattgttaatgcaaatacgtctgcctgcaaactatggtcgccgttataatgaagcctttagcgccatttaccccaaactcgccaaagagtttgatgttccgctgctgcccttttttatggaagaggtctacctcaaaccacaatggatgcaggatgacggtattcatcccaaccgcgacgcccagccgtttattgccgactggatggcgaagcagttgcagcctttagtaaatcatgactcataa

SEQ ID NO: 1214 - protein, 218 aa, Escherichia coli
MLPLTDGLLKMMNFNNVFRWHLPFLFLVLLTFRAAAADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFFMEEVYLKPQWMQDDGIHPNRDAQPFIADWMAKQLQPLVNHDS

SEQ ID NO: 1215 - DNA, 687 bp, Escherichia coli
atgccagcggaaaacattgttgaagttcatcatcttaagaagtccgtcggtcagggggagcatgaactctccatcctcaccggagttgagctggttgtcaaacgtggcgagaccatcgcactggtgggcgagtcgggatcgggtaagtcaaccttgctggcgatcctcgccgggctggatgacggcagcagtggcgaagtgagactggtgggacaaccgctacataatatggacgaagaagcgcgggcaaagttgcgcgcgaagcacgtaggctttgtttttcagtcatttatgttaattcctacccttaacgcgctggaaaacgtcgagcttccggcgctgctgcgcggtgagagtagcgcagaaagtcgtaacggggcgaaagcgttgctcgaacagttagggttgtgtaaacgtcttgatcatcttccggcacagctttctggcggcgaacagcaacgagtggcgctggcgcgagcctttaatggtcgacctgatgtgctgtttgccgacgaacccaccggcaaccttgaccgccagacgggcgataaaattgccgatctacttttttccctcaaccgtgagcatggcaccacgttgattatggtgacccatgacctgcaactggcggcacgctgtgaccgctgcttacggctggtgaacgggcagttgcaggaggaagcatga

SEQ ID NO: 1216 - protein, 228 aa, Escherichia coli
MPAENIVEVHHLKKSVGQGEHELSILTGVELVVKRGETIALVGESGSGKSTLLAILAGLDDGSSGEVRLVGQPLHNMDEEARAKLRAKHVGFVFQSFMLIPTLNALENVELPALLRGESSAESRNGAKALLEQLGLCKRLDHLPAQLSGGEQQRVALARAFNGRPDVLFADEPTGNLDRQTGDKIADLLFSLNREHGTTLIMVTHDLQLAARCDRCLRLVNGQLQEEA

SEQ ID NO: 1217 - DNA, 2415 bp, Escherichia coli
atgattgcacgttggttctggcgcgaatggcgctcgccgtcgctattaattgtctggctggcgcttagcctggcggtggcctgcgtgctggcgctgggcaatatcagcgatcgcatggagaagggcttaagccagcaaagccgtgagtttatggcgggcgatcgggcgttgcgcagttcgcgcgaagtgccgcaagcatggctggaggaagcgcaaaagcgcggcctgaaagttggcaagcagctgactttcgccaccatgacctttgcaggcgacacgccgcagctggcgaacgtcaaagcggtggatgatatctacccgatgtatggcgatctgcaaactaatccccctggcctgaaaccgcaggcgggcagcgtattgctggccccacgtctgatggcactgcttaacctgaaaacgggcgacaccattgacgtgggcgatgccaccttgcggattgccggagaagtgattcaggaaccggattccggttttaatcctttccagatagccccacgcctgatgatgaatctggcggatgttgataaaaccggagccgtgcagccggggagtcgggtcacctggcgctataaattcggcggtagcgagaaccagctcgacggctatgagaaatggttgttaccccagcttaaacccgaacaacgctggtacggtctggaacaggacgaaggcgcgctggggcgatcgatagaacgttcgcaacagttcctgctgctttcggcgcttctgaccttgctgctggcggtggcggcggtcgcggtggcgatgaatcattactgtcgcagtcgctacgacttggtggcgatcctcaaaacgctgggggcagggcgagcgcaactgcgtaagttaattgtcggtcagtggttgatggtgctggtactttcagccgttaccggtggggcgataggtctgttgttcgaaaacgtgttgatggtgctgctcaaacccgtgctacctgccgctttacctcctgccagcctctggccgtggctgtgggcgctcggcaccatgacagtcatctcgctgctggtggggctgcgaccataccgcctgttgttggcaacgcagcctttacgcgtgttacgtaatgatgtggttgcaaacgtctggccgctgaagttttatctgccgattgtcagtgtggtggttgtgctactgctcgccggactgatgggcggcagtatgctgctctgggcggtgctggcgggcgcggtagtactggctttgctgtgcggtgtgctgggctggatgctgctgaatgtacttcgccgcatgacgctgaaatcgctacctctgcgcctggcggttagccgcctgttacgtcagccgtggtcaacgttaagccagctttcggcattttcgctctcctttatgctgctggcactgttgttggtgttgcgtggcgatctgctcgatcgctggcaacagcagctaccgccagaaagcccgaactactttttaatcaacatcgccacagaacaggttacgccgctaaaagcgtttctcgcggaacatcagatagtcccggaatcgttttatccggtagtgcgggcgcggttgacggcgattaacgacaagccgacagaaggcaatggagatgaggcgctcaaccgcgagctgaatctcacttggcaaaatgcgcggcctgatcataacccgatcgtcgccggtaactggccgccaaaagccgatgaagtgtcgatggaagaggggctggcgaaacgcttaaacgttgccctcggcgataccgtgacttttatgggcgatacccaggagttccgcgctaaagtgaccagcctgcgcaaagtggactgggaaagtctgcggcctaatttctattttattttcccggaaggggcattagacgggcaaccgcagagctggcttaccagtttccgctgggagaatggcaacggcatgttgacgcaactcaaccgccagttcccgaccattagcctgttagacattggcgcgattttaaaacaggtcggtcaggtgctggagcaggtaagtcgggcgctggaagtgatggtggtgctggtcaccgcctgcggcatgttgctgttgctggcgcaggtgcaggtgggaatgcgtcagcgtcatcaggagctggtggtgtggcgcacacttggtgcggggaaaaaactgctgcgcacgacattgtggtgtgagttcgccatgctcgggtttgtatccggcctggtggccgcaattggtgcggaaacggcactggcggtactgcaatcgaaagtgtttgatttcccgtgggagccagactggcgattgtggattgttctgccgtgcagcggtgcgctactgctgtcgctttgcggcggctggctgggtgcgcgactgcttaagggtaaggcgctgttcaggcagtttgcggggtga

SEQ ID NO: 1218 - protein, 804 aa, Escherichia coli
MIARWFWREWRSPSLLIVWLALSLAVACVLALGNISDRMEKGLSQQSREFMAGDRALRSSREVPQAWLEEAQKRGLKVGKQLTFATMTFAGDTPQLANVKAVDDIYPMYGDLQTNPPGLKPQAGSVLLAPRLMALLNLKTGDTIDVGDATLRIAGEVIQEPDSGFNPFQIAPRLMMNLADVDKTGAVQPGSRVTWRYKFGGSENQLDGYEKWLLPQLKPEQRWYGLEQDEGALGRSIERSQQFLLLSALLTLLLAVAAVAVAMNHYCRSRYDLVAILKTLGAGRAQLRKLIVGQWLMVLVLSAVTGGAIGLLFENVLMVLLKPVLPAALPPASLWPWLWALGTMTVISLLVGLRPYRLLLATQPLRVLRNDVVANVWPLKFYLPIVSVVVVLLLAGLMGGSMLLWAVLAGAVVLALLCGVLGWMLLNVLRRMTLKSLPLRLAVSRLLRQPWSTLSQLSAFSLSFMLLALLLVLRGDLLDRWQQQLPPESPNYFLINIATEQVTPLKAFLAEHQIVPESFYPVVRARLTAINDKPTEGNGDEALNRELNLTWQNARPDHNPIVAGNWPPKADEVSMEEGLAKRLNVALGDTVTFMGDTQEFRAKVTSLRKVDWESLRPNFYFIFPEGALDGQPQSWLTSFRWENGNGMLTQLNRQFPTISLLDIGAILKQVGQVLEQVSRALEVMVVLVTACGMLLLLAQVQVGMRQRHQELVVWRTLGAGKKLLRTTLWCEFAMLGFVSGLVAAIGAETALAVLQSKVFDFPWEPDWRLWIVLPCSGALLLSLCGGWLGARLLKGKALFRQFAG

SEQ ID NO: 1219 - DNA, 1095 bp, Escherichia coli
atgcaagagagacacacggaacaggactatcgtgccctgctgattgctgatacgcccattattgatgttcgcgcccccatcgagtttgagcaaggcgcaatgcccgccgctatcaacctgccgttaatgaataacgatgaacgcgccgccgttggcatctgctataaacagcaagggtcagacgcggcgctggcactggggcataaactggtggcgggtgaaattcgtcagcagcgcatggacgcctggcgggcagcgtgcctgcaaaatccgcacggtattctctgctgcgcccgtggcggtcagcgctcgcatattgtgcaacgctggctgcatgacgcggggattgattatccgctggtggaaggcggttataaggcactgcgccagaccgcgattcaggcgaccattgaactgtcacaaaaaccgatagtgctgattggcggttgtaccggctgcggcaaaacgctgttagtgcaacaacaaccgaacggtgttgatctggaagggctggcgcgccatcgcggttctgcttttggtcgcacgttacaaccacaacttagccaggcgagttttgaaaacctgctggctgccgaaatgctaaaaaccgacgcccgtcagaatttgcgcttgtgggtgctggaagatgaaagccggatgatcggttcgaatcacctgccggaatgtctgcgcgaacgaatgactcaggcgacgattgcggtggtagaagatccgtttgagatccgtcttgaacgcctgaacgaagagtatttcttgcgtatgcatcatgattttacccacgcttatggcgacgaacagggctggcaggagtattgcgaatacctgcatcacgggctttcggcgattaaacgtcggctgggactacaacgctataacgaactggctgcaaggctggatgcggcgctgacaacgcaactcaccaccggcagcaccgacggtcatctggcctggctagtgccgctgcttgaagaatattacgacccgatgtatcgctatcagcttgaaaaaaaagcggaaaaagttgtctttcgcggtgagtgggcggaagtggcggaatgggttaaggcgcagtga

SEQ ID NO: 1220 - protein, 364 aa, Escherichia coli
MQERHTEQDYRALLIADTPIIDVRAPIEFEQGAMPAAINLPLMNNDERAAVGICYKQQGSDAALALGHKLVAGEIRQQRMDAWRAACLQNPHGILCCARGGQRSHIVQRWLHDAGIDYPLVEGGYKALRQTAIQATIELSQKPIVLIGGCTGCGKTLLVQQQPNGVDLEGLARHRGSAFGRTLQPQLSQASFENLLAAEMLKTDARQNLRLWVLEDESRMIGSNHLPECLRERMTQATIAVVEDPFEIRLERLNEEYFLRMHHDFTHAYGDEQGWQEYCEYLHHGLSAIKRRLGLQRYNELAARLDAALTTQLTTGSTDGHLAWLVPLLEEYYDPMYRYQLEKKAEKVVFRGEWAEVAEWVKAQ

SEQ ID NO: 1221 - DNA, 927 bp, Escherichia coli
atgttcgatccagaaaccttgcggactttcattgcggttgctgaaacaggaagtttttcaaaagcggcagaacgattatgtaaaaccacggcgacgatcagttatcgcattaaacttctggaagagaataccggagtggcgctgtttttccgcacgactcgcagcgtgacgttgacggcggctggcgagcatctactttgtcaggccagagactggctgggctggctggaaagtatgcccagcgagttacaacaggtgaatgatggcgtggaacgccaggtgaatatcgtcatcaacaacctgctctataacccccaggccgttgccaggctgctggcgtggctaaatgaacgttacccgtttacccaatttcacatctcccgacaaatctatatgggcgtctgggactcgctattgtacgaaggtttttcactggctatcggcgtcacgggaaccgaggcgctggcaaatacctttagtcttgatcccttaggatcggtgcaatggcgctttgtcatggcggcggatcatccgctggcgaacgttgaagagccgctaacagaagcacagttgcggcgctttccggcggtcaatattgaagacagcgcccgcaccttaaccaaacgcgtcgcctggcgattgccggggcaaaaagagattattgttcccgatatggaaacgaaaatcgccgcccatctggcgggcgttggcattggttttttgccaaaatcactttgccagtcaatgctcgataatcaacaactggtcagccgggtaatcccaacgatgcgccctccttcgccattgagtctggcatggcgcaaatttggcagcggcaaagcggtagaagatattgtgaccttgtttacccagcgcaggccggaaatcagcggatttttagaaattttcggcaacccacgcagttaa

SEQ ID NO: 1222 - protein, 308 aa, Escherichia coli
MFDPETLRTFIAVAETGSFSKAAERLCKTTATISYRIKLLEENTGVALFFRTTRSVTLTAAGEHLLCQARDWLGWLESMPSELQQVNDGVERQVNIVINNLLYNPQAVARLLAWLNERYPFTQFHISRQIYMGVWDSLLYEGFSLAIGVTGTEALANTFSLDPLGSVQWRFVMAADHPLANVEEPLTEAQLRRFPAVNIEDSARTLTKRVAWRLPGQKEIIVPDMETKIAAHLAGVGIGFLPKSLCQSMLDNQQLVSRVIPTMRPPSPLSLAWRKFGSGKAVEDIVTLFTQRRPEISGFLEIFGNPRS

SEQ ID NO: 1223 - DNA, 483 bp, Escherichia coli
atgaaacttcaggtattaccgttaagtcaggaagcctttagtgcttatggcgacgtaatcgaaacgcagaaacgggattttttccatattaacaatggactggtggagcgttaccacgatttggcgctggttgagattcttgagcaagaccgtacgcttatcagcattaaccgcgcgcaaccggcgaatctgccgctgactattcacgaactcgaacgtcatccgctgggtacacaggcctttatcccgatgaaaggtgaagtgtttgtggtggtggtggcgttaggtgacgacaaaccagacctgtcaaccctgcgggcgtttattaccaatggcgaacagggagtgaattaccatcgtaacgtctggcatcacccacttttcgcctggcagcgcgtcaccgattttctgaccatcgatcgcggcggcagtgacaactgtgatgttgaaagtattcctgaacaggaactctgttttgcgtga

SEQ ID NO: 1224 - protein, 160 aa, Escherichia coli
MKLQVLPLSQEAFSAYGDVIETQKRDFFHINNGLVERYHDLALVEILEQDRTLISINRAQPANLPLTIHELERHPLGTQAFIPMKGEVFVVVVALGDDKPDLSTLRAFITNGEQGVNYHRNVWHHPLFAWQRVTDFLTIDRGGSDNCDVESIPEQELCFA

SEQ ID NO: 1225 - DNA, 816 bp, Escherichia coli
atgacggaagttagacggcgcggcaggccaggacaggcggagcctgtggcacagaagggtgcacaggcgttagagcggggaattgcgattctgcaatatctggaaaaaagtgggggaagttcgtcggttagcgatatctctctcaatctggatttgccgctctccacgacctttcgcttgctgaaggttttacaggcagcggattttgtctatcaggacagtcagttaggttggtggcatataggattaggtgtctttaacgtcggtgcagcgtacatccataaccgcgatgtcctctccgtcgccgggccgtttatgcgccgcctgatgttactttccggcgaaacggtcaatgtcgcgatccgtaacggcaatgaagcggtattaattggtcagttagagtgtaaatcgatggtcagaatgtgtgcgccgctgggcagtcgtctgccgctgcatgcttccggtgcgggcaaggcgctgctttatccgctggcggaagaagagttgatgagcatcattctgcaaaccggtttgcagcagtttacgccaacgacgcttgtggatatgcccaccttgctgaaggacctggaacaagcgcgtgaactgggctataccgtagataaagaagagcatgttgtcggcctgaattgcatagcttcagcaatttacgatgatgtaggtagtgttgttgccgctatctccatctccgggccttcatcaagactgacagaagatcgttttgtcagtcagggtgagctggtcagagacaccgcccgcgatatcagcacggcgttgggactgaaagcacatctatag

SEQ ID NO: 1226 - protein, 271 aa, Escherichia coli
MTEVRRRGRPGQAEPVAQKGAQALERGIAILQYLEKSGGSSSVSDISLNLDLPLSTTFRLLKVLQAADFVYQDSQLGWWHIGLGVFNVGAAYIHNRDVLSVAGPFMRRLMLLSGETVNVAIRNGNEAVLIGQLECKSMVRMCAPLGSRLPLHASGAGKALLYPLAEEELMSIILQTGLQQFTPTTLVDMPTLLKDLEQARELGYTVDKEEHVVGLNCIASAIYDDVGSVVAAISISGPSSRLTEDRFVSQGELVRDTARDISTALGLKAHL

SEQ ID NO: 1227 - DNA, 1836 bp, Escherichia coli
ttgacaaaatttgaaagttggaaaaattttccaattaatagaggtaggaataaaatggcaaaaatgagagccgttgacgcggcaatgtatgtgctggagaaagaaggtatcaccaccgccttcggcgttccgggagctgcaatcaatccgttctactcagcgatgcgtaagcacggcggtattcgtcacattctggcgcgtcatgtggaaggtgcttcgcacatggcggaaggttatacccgcgcaacggcagggaatatcggcgtatgtctggggacttccggtcctgcgggcacggacatgatcaccgcgctctattccgcatctgctgattccattcctattctgtgtattaccggccaggctccgcgcgcccgtctgcataaagaagatttccaggccgttgatattgaagcaattgctaaaccggtcagcaaaatggcggttacagttcgtgaagcggcgctggtgcctcgtgtgctgcaacaggcgtttcacctgatgcgttctggtcgaccgggtccggtactggtggatttaccgttcgacgtacaggttgcggaaatcgagtttgatcctgatatgtacgaaccgctgccggtctacaaacctgctgccagccgtatgcagatcgaaaaagctgtagaaatgttaatccaggccgaacgtccggtgattgttgccggaggcggggtaatcaatgctgacgcagctgcactgttacaacagtttgctgaactgaccagcgttccggtgatcccaacgctgatgggctggggttgtatcccggatgaccacgaactgatggccgggatggtgggtctgcaaaccgcgcatcgttacggtaacgcaacgctgctggcttccgacatggtatttggtatcggtaaccgttttgccaaccgtcataccggttcggtagagaaatacaccgaagggcgcaaaatcgttcatatcgatattgagccgacgcaaattggccgcgtactgtgtccggatcttggcattgtctctgatgctaaagcggcgctgacgctgctggttgaagtggcgcaggagatgcaaaaagccggtcgtctgccgtgtcgtaaagagtgggtcgccgactgccagcagcgcaaacgcactttgctgcgcaaaacccacttcgacaacgtgccggtgaaaccgcagcgcgtgtatgaagagatgaacaaagcctttggccgcgatgtttgttatgtcaccaccattggcctgtcacaaatcgctgcggcacaaatgctgcatgtctttaaagaccgccactggatcaactgtgggcaggcaggcccgctgggctggacgattccggcggcgctgggggtttgtgccgctgatccagagcgcaatgtggtggcgatttccggtgacttcgacttccagttcctgattgaagaattagccgttggcgcacagttcaacattccgtacatccatgtactggtcaataacgcctatctgggtctgattcgccagtcgcaacgtgcctttgatatggattactgcgtacagctcgcgttcgaaaatattaactccagcgaagtgaacggttatggcgtcgaccacgtaaaagtagcggaaggtttaggttgtaaagcaattcgcgttttcaaaccggaagatattgcaccagcctttgaacaggcgaaaatcttaatggcgcaatatcgggtaccggtagtcgtggaagttattctcgagcgtgtgaccaatatttcgatgggcagtgaactggataacgtcatggaatttgaagatatcgccgataacgcagcggatgcaccgactgaaacctgtttcatgcactatgaataa

SEQ ID NO: 1228 - protein, 611 aa, Escherichia coli
MTKFESWKNFPINRGRNKMAKMRAVDAAMYVLEKEGITTAFGVPGAAINPFYSAMRKHGGIRHILARHVEGASHMAEGYTRATAGNIGVCLGTSGPAGTDMITALYSASADSIPILCITGQAPRARLHKEDFQAVDIEAIAKPVSKMAVTVREAALVPRVLQQAFHLMRSGRPGPVLVDLPFDVQVAEIEFDPDMYEPLPVYKPAASRMQIEKAVEMLIQAERPVIVAGGGVINADAAALLQQFAELTSVPVIPTLMGWGCIPDDHELMAGMVGLQTAHRYGNATLLASDMVFGIGNRFANRHTGSVEKYTEGRKIVHIDIEPTQIGRVLCPDLGIVSDAKAALTLLVEVAQEMQKAGRLPCRKEWVADCQQRKRTLLRKTHFDNVPVKPQRVYEEMNKAFGRDVCYVTTIGLSQIAAAQMLHVFKDRHWINCGQAGPLGWTIPAALGVCAADPERNVVAISGDFDFQFLIEELAVGAQFNIPYIHVLVNNAYLGLIRQSQRAFDMDYCVQLAFENINSSEVNGYGVDHVKVAEGLGCKAIRVFKPEDIAPAFEQAKILMAQYRVPVVVEVILERVTNISMGSELDNVMEFEDIADNAADAPTETCFMHYE

SEQ ID NO: 1229 - DNA, 777 bp, Escherichia coli
atgttacgtttctctgctaatttatcgatgttatttggtgaatatgattttctcgcccgttttgagaaagctgcgcagtgtggttttcgcggcgttgaatttatgttcccttatgactacgacattgaagaattaaaacaggtgctggcgagtaataaactcgaacatacgctgcacaatttaccggcaggtgactgggcggcgggcgagcggggtattgcctgtattcctggccgtgaagaagagtttcgggatggcgtagcagcagcgattcgttatgctcgtgctctgggtaataaaaaaattaactgtctggtcggtaaaacgccgactggtttcagcagtgaacagattcacacaacgcttgtagaaaacctacgttatgctgcgaatatgctgatgaaagaagatattttattactgattgaacctattaaccattttgatattcctggtttccatctcaccggaacccggcaggcactgaaactgattgacgatgttggttgctgcaatttgaaaattcagtatgacatttatcacatgcagcggatggaaggtgaattaactaataccatgactcagtgggccgataaaattggtcacctgcaaattgctgataatccgcatcgcggcgaaccgggaaccggagaaattaattacgaatatctctttacggtaattgaaaattctgactacaacggttgggttggctgtgaatataaaccccaaaccaccacggaagccggtttacgctggatggatccgtaccgttaa

SEQ ID NO: 1230 - protein, 258 aa, Escherichia coli
MLRFSANLSMLFGEYDFLARFEKAAQCGFRGVEFMFPYDYDIEELKQVLASNKLEHTLHNLPAGDWAAGERGIACIPGREEEFRDGVAAAIRYARALGNKKINCLVGKTPTGFSSEQIHTTLVENLRYAANMLMKEDILLLIEPINHFDIPGFHLTGTRQALKLIDDVGCCNLKIQYDIYHMQRMEGELTNTMTQWADKIGHLQIADNPHRGEPGTGEINYEYLFTVIENSDYNGWVGCEYKPQTTTEAGLRWMDPYR

SEQ ID NO: 1231 - DNA, 879 bp, Escherichia coli
atgaaactgggatttattggcttaggcattatgggtacaccgatggccattaatctggcgcgtgccggtcatcaactgcatgtcacaaccattggtccggttgctgatgaattactgtcactgggcgccgttagtgttgaaactgcgcgccaggtaacagatgcatcggacatcatttttattatggtgccggatacgccacaggttgaagacgttctgtttggtgaaaatggttgtaccaaagcctcgctgaagggcaaaaccattgttgatatgagctccatttccccgattgaaactaaacgtttcgctcgtcaggtgaatgaactgggcggcgattatctcgatgcgccagtctccggcggtgaaatcggcgcgcgtgaagggacgttatcgattatggttggcggtgatgaagcagtatttgaacgtgtaaaaccgctgtttgaactgctcggtaaaaatatcactctcgtgggcggtaacggcgacggtcaaacctgcaaagtggcaaatcagattatcgtggcgctcaatattgaagcggtttctgaagccttgttgtttgcttcaaaagccggtgcggacccggtacgtgtgcgccaggcgctgatgggcggctttgcttcctcacgtattctggaagttcacggtgagcgcatgattaaacgcacctttaatccaggtttcaaaattgcgctgcaccagaaagatctcaacctggcactgcaaagtgcgaaagcactggcgctgaacctgccaaacaccgcgacctgccaggaattgtttaatacctgtgcggcaaacggtggcagccagttggatcactctgcgttagtgcaggcgctggaattaatggctaaccataaactggcctga

SEQ ID NO: 1232 - protein, 292 aa, Escherichia coli
MKLGFIGLGIMGTPMAINLARAGHQLHVTTIGPVADELLSLGAVSVETARQVTDASDIIFIMVPDTPQVEDVLFGENGCTKASLKGKTIVDMSSISPIETKRFARQVNELGGDYLDAPVSGGEIGAREGTLSIMVGGDEAVFERVKPLFELLGKNITLVGGNGDGQTCKVANQIIVALNIEAVSEALLFASKAGADPVRVRQALMGGFASSRILEVHGERMIKRTFNPGFKIALHQKDLNLALQSAKALALNLPNTATCQELFNTCAANGGSQLDHSALVQALELMANHKLA

SEQ ID NO: 1233 - DNA, 1455 bp, Escherichia coli
atggaacatcagagaaaactattccagcaacgcggctatagcgaagatctactgccgaaaacgcaaagtcagcggacctggaaaacatttaactattttaccttatggatgggttcggttcataacgttcccaattatgtgatggttggcggcttttttattctcggcttgtctacctttagtattatgctggcaattatcctcagtgcctttttcattgccgcggtaatggtattaaacggtgctgcgggcagtaaatacggcgtaccgtttgccatgatcctgcgtgcttcttacggcgtacgtggtgcactgtttcccggattattaagaggcggtattgctgccattatgtggtttggcctgcaatgttacgcggggtcactggcctgcttgattctgattggcaaaatctggccgggatttttgactctcggtggcgatttcacgctgttaggcctttctctaccgggattaattacttttttactcttctggctggttaacgttggtattggttttggcggcggaaaagttttaaataaattcactgccattcttaacccgtgcatctatatcgttttcggcggtatggcgatttgggcgatttcgctggtcgggatcggtccaatctttgactacattccgggcggtattcagaaagcagaaaacagtggcttcctgtttctggtggtgataaacgcggtggttgcggtctgggcggcaccggcggtgagcgcatccgactttacgcaaaacgcccactcgtttcgtgagcaggcgctggggcaaacgctgggtttagttgtggcctatattctgtttgcggtcgccggggtatgtattattgccggagccagtattcattacggcgctgacacctggaacgtgctggatattgttcagcgttgggacagcctgttcgcctcgttctttgcggtactggttattctgatgacgactatctctactaacgccaccggtaatattattccggctggttatcagattgccgccattgcaccgacgaaactgacctataaaaacggcgtactgattgccagtattatcagcctgctgatctgcccgtggaaattaatggaaaatcaggacagtatttatctgttcctcgatattatcggcggaatgcttggtccggtaattggtgtgatgatggcgcattattttgtcgtgatgcgtgggcaaattaatcttgatgaactgtacaccgcacctggcgattataaatattacgataacggttttaacctcaccgcgttttcagtaactctggtggccgttattttatctcttggcggtaagtttattccctttatggaaccgttatcacgtgtttcatggtttgtcggcgtcatcgtcgcctttgcggcctacgccttattaaagaaacgtacaacagcagaaaaaacaggagaacaaaaaaccataggttaa

SEQ ID NO: 1234 - protein, 484 aa, Escherichia coli
MEHQRKLFQQRGYSEDLLPKTQSQRTWKTFNYFTLWMGSVHNVPNYVMVGGFFILGLSTFSIMLAIILSAFFIAAVMVLNGAAGSKYGVPFAMILRASYGVRGALFPGLLRGGIAAIMWFGLQCYAGSLACLILIGKIWPGFLTLGGDFTLLGLSLPGLITFLLFWLVNVGIGFGGGKVLNKFTAILNPCIYIVFGGMAIWAISLVGIGPIFDYIPGGIQKAENSGFLFLVVINAVVAVWAAPAVSASDFTQNAHSFREQALGQTLGLVVAYILFAVAGVCIIAGASIHYGADTWNVLDIVQRWDSLFASFFAVLVILMTTISTNATGNIIPAGYQIAAIAPTKLTYKNGVLIASIISLLICPWKLMENQDSIYLFLDIIGGMLGPVIGVMMAHYFVVMRGQINLDELYTAPGDYKYYDNGFNLTAFSVTLVAVILSLGGKFIPFMEPLSRVSWFVGVIVAFAAYALLKKRTTAEKTGEQKTIG

SEQ ID NO: 1235 - DNA, 1362 bp, Escherichia coli
atgtcttttgatttaatcattaaaaacggcaccgttattttagaaaacgaagctcgcgttgtagatatcgccgttaaagacggaaaaattgctgctatcggccaggatctgggcgatgcaaaagacgttatggatgcgtctggtctggtggtttcgccgggcatggttgatgcgcacacccatatttctgaaccgggtcgcagccactgggaaggttatgaaaccggtactcgcgcagcagcaaaaggtggtatcaccaccatgatcgaaatgccgctcaaccagctgcctgcaacggttgaccgcgcctcaattgaattgaagttcgatgccgctaaaggaaagctgactatcgatgcggcacaactcggtggcctggtgtcttacaacattgaccgtctgcatgagttggatgaagtgggtgttgtcggtttcaaatgcttcgttgcgacctgtggcgatcgcggtatcgacaacgacttccgtgacgtcaatgactggcaattcttcaaaggcgcgcagaagctgggtgaactaggccagccggtgctggtgcactgcgaaaacgcgctgatctgtgacgcactgggcgaagaagcgaagcgtgaaggtcgcgtaactgcccatgactatgtggcttcgcgtccggtatttaccgaagtggaagcgattcgccgcgtactgtacctggcgaaagtcgctggttgccgtctgcacgtttgccacgtcagcagcccggaaggtgttgaggaagtgactcgtgcacgtcaggaaggtcaggatgttacttgtgaatcctgcccgcattactttgtgctggataccgatcagttcgaagaaatcggtactctggcgaagtgttcaccgccgatccgcgatctggaaaaccagaaaggcatgtgggaaaaactgtttaacggtgaaatagactgcctggtttccgaccactctccatgcccgccggaaatgaaagccggtaacataatgaaagcgtggggcggtatcgctggtctgcaaagctgcatggacgtgatgttcgatgaagcggtacagaaacgcggaatgtctctgccaatgttcggcaaattaatggcgactaacgcagcagatattttcggtctgcagcaaaaaggccgtatcgccccaggaaaagatgccgacttcgtcttcattcagccgaatagcagctatgttcttaccaatgacgatctggaatatcgccacaaagtcagcccgtatgttggccgtactattggcgcgcgtatcacgaaaaccatcttacgtggtgatgtgatttacgatatcgaacagggcttccctgttgcgccgaaaggtcaatttatccttaaacatcagcagtaa

SEQ ID NO: 1236 - protein, 453 aa, Escherichia coli
MSFDLIIKNGTVILENEARVVDIAVKDGKIAAIGQDLGDAKDVMDASGLVVSPGMVDAHTHISEPGRSHWEGYETGTRAAAKGGITTMIEMPLNQLPATVDRASIELKFDAAKGKLTIDAAQLGGLVSYNIDRLHELDEVGVVGFKCFVATCGDRGIDNDFRDVNDWQFFKGAQKLGELGQPVLVHCENALICDALGEEAKREGRVTAHDYVASRPVFTEVEAIRRVLYLAKVAGCRLHVCHVSSPEGVEEVTRARQEGQDVTCESCPHYFVLDTDQFEEIGTLAKCSPPIRDLENQKGMWEKLFNGEIDCLVSDHSPCPPEMKAGNIMKAWGGIAGLQSCMDVMFDEAVQKRGMSLPMFGKLMATNAADIFGLQQKGRIAPGKDADFVFIQPNSSYVLTNDDLEYRHKVSPYVGRTIGARITKTILRGDVIYDIEQGFPVAPKGQFILKHQQ

SEQ ID NO: 1237 - DNA, 1302 bp, Escherichia coli
atgttcaattttgcagtgggccgcgaaagcctgttatcaggatttcagtggtttttctttattttttgcaacacggttgtggttcctcctacgctactttctgcttttcagttgccgcaaagtagcctgcttacgctcacgcaatatgcttttcttgctaccgcactggcctgcttcgctcaggcgttctgcggtcatcgtcgcgctattatggaggggccgggcggcctgtggtggggaaccatcctgactatcacccttggcgaagcatcgcgcgggacaccgatcaacgatatcgctaccagtctggcggtggggattgcgctctccggcgtgctgacgatgttgattggttttagcggattaggccatcgcctggcacggttatttacgccgtcggtgatggtcttgtttatgttgatgctgggtgcgcaactgaccactatctttttcaaaggtatgctcgggctgccgtttggcatagccgacccgaattttaaaattcaattaccgccgttcgcgctctcggtggcggtgatgtgcctggtactggcgatgattattttcctgccacaacgttttgcccgttacggcctgctggtcggtacgataaccggctggttgttgtggtacttttgctttccttcttcgcattcgctctccggtgagttgcactggcagtggttcccgctcggcagtggcggtgctttgtcgccggggattattctgacggcggtgattacaggtctggtaaatatcagcaatacctacggtgcgattcggggcacggatgttttttatccgcagcagggcgcggggaatacgcgttatcgtcgcagctttgtggcgaccggatttatgacactgataactgtgccgctggcggtaattccattttcaccgtttgtttcatccattggtttattaacccagacaggcgattacacgcggcgttcgtttatttatggcagcgttatttgcctgctggtggcactggttccggcactcacgcgactgttttgcagtatccctttacccgtgagtagtgcggtcatgctggtttcttatctgcctttactcttttccgcgctggtgtttagccagcaaataacctttaccgctcgcaatatttatcgactcgcattgccgttatttgtcggcatatttttaatggcattaccgcctgtgtatctgcaagaccttccattaacgctgcgtcctctgctcagtaacggcttactggtcgggattttactggctgttcttatggataatcttattccgtgggaacgcatcgaataa

SEQ ID NO: 1238 - protein, 433 aa, Escherichia coli
MFNFAVGRESLLSGFQWFFFIFCNTVVVPPTLLSAFQLPQSSLLTLTQYAFLATALACFAQAFCGHRRAIMEGPGGLWWGTILTITLGEASRGTPINDIATSLAVGIALSGVLTMLIGFSGLGHRLARLFTPSVMVLFMLMLGAQLTTIFFKGMLGLPFGIADPNFKIQLPPFALSVAVMCLVLAMIIFLPQRFARYGLLVGTITGWLLWYFCFPSSHSLSGELHWQWFPLGSGGALSPGIILTAVITGLVNISNTYGAIRGTDVFYPQQGAGNTRYRRSFVATGFMTLITVPLAVIPFSPFVSSIGLLTQTGDYTRRSFIYGSVICLLVALVPALTRLFCSIPLPVSSAVMLVSYLPLLFSALVFSQQITFTARNIYRLALPLFVGIFLMALPPVYLQDLPLTLRPLLSNGLLVGILLAVLMDNLIPWERIE

SEQ ID NO: 1239 - DNA, 1146 bp, Escherichia coli
atgaaaattgtcattgcgccagactcgtttaaagagagtttaagtgcagaaaaatgttgtcaggcaattaaagccgggttttcgaccatatttcccgatgcgcactatatctgtttgccgatagcggatggcggcgaagggacggtggaggcgatggtcgccgcgacgggcggcaacatcgtgacgcttgaagtctgcgggccgatgggcgaaacagtgaatgctttttatggccttaccggcgacgggaaaacggcggtgattgagatggcggcggcaagcggcctgatgctggtcgcgcctgaaaagcgtaatccgttgctggcgtcaagttttggcaccggagagctgattcgtcatgcgctggataacggcattcgccatattattctcggcattggcggcagtgcgacggtcgacggcggtatgggcatggcgcaggcgctcggtgtgcgtttccttgatgctgacggtcaggtgctggcggctaacggcggcaatttagcgcgcgtggcaagcattgagatggatgaatgcgatccgcgtctggcgaactgccatattgaagtagcatgtgatgttgataacccgctggtaggggcacgcggcgcggcggcggtgtttggtccgcaaaaaggggcaacgccggaaatggtcgaagaactggaacaggggctgcaaaattacgcccgtgttttacaacagcaaactgaaattaatgtctgccagatggcgggcggcggcgctgcgggcggtatgggcattgcggcggcggtattcctcaatgcggatattaaaccgggtattgagattgtgttgaatgcggtcaatctggcgcaggcggtgcagggtgcagcactggtgatcaccggggaagggcgcatcgactcgcaaacggcaggcggtaaagctccgctgggcgtggcgtcggtggcgaagcagtttaatgtcccggtgattgggattgctggcgtattgggtgatggcgtggaagtggtgcaccagtacggcattgatgcggtattcagcattttgccacgtctggcacctttagccgaagtgctcgccagcggtgaaaccaatctcttcaacagtgcgcgaaatattgcctgcgccattaaaataggtcagggaattaaaaactga

SEQ ID NO: 1240 - protein, 381 aa, Escherichia coli
MKIVIAPDSFKESLSAEKCCQAIKAGFSTIFPDAHYICLPIADGGEGTVEAMVAATGGNIVTLEVCGPMGETVNAFYGLTGDGKTAVIEMAAASGLMLVAPEKRNPLLASSFGTGELIRHALDNGIRHIILGIGGSATVDGGMGMAQALGVRFLDADGQVLAANGGNLARVASIEMDECDPRLANCHIEVACDVDNPLVGARGAAAVFGPQKGATPEMVEELEQGLQNYARVLQQQTEINVCQMAGGGAAGGMGIAAAVFLNADIKPGIEIVLNAVNLAQAVQGAALVITGEGRIDSQTAGGKAPLGVASVAKQFNVPVIGIAGVLGDGVEVVHQYGIDAVFSILPRLAPLAEVLASGETNLFNSARNIACAIKIGQGIKN

SEQ ID NO: 1241 - DNA, 786 bp, Escherichia coli
atgggatatttaaataacgtcaccggttaccgcgaagatttactggctaaccgtgcgattgttaaacacggtaatttcgcactgttaacaccagacggtctggtaaaaaatattattccgggctttgaaaattgtgacgcgacaatcctctccacgccaaagctgggtgcctcttttgttgattatctggtcacactgcatcaaaacggcggcaaccaacagggcttcggtggcgaaggcattgaaacgttcctgtatgtgatctctggaaatatcactgccaaagccgaagggaaaacatttgtcttaagcgaaggtggctatctttattgcccgccaggctccttaatgacgtttgttaacgcccaggccgaagacagccaaatctttttatataagcgtcgctatattccggtagaaggtcatgcgccgtggctggtttctggcaatgccagcgaactggaacgcattcattatgaaggcatggacgatgttattctgctggattttctgcccaaagagttaggttttgatatgaacatgcatatcctctcttttgcaccaggtgccagccacggttatatcgaaacccatgttcaggaacacggtgcctatattctttccggtcagggggtttataacctcgacaataactggatcccggtgaaaaaaggcgattacatctttatgggcgcttattctttacaggctggttatggcgtagggcgtggtgaagcgttcagctatatttactcgaaagattgcaaccgcgacgtagagatttaa

SEQ ID NO: 1242 - protein, 261 aa, Escherichia coli
MGYLNNVTGYREDLLANRAIVKHGNFALLTPDGLVKNIIPGFENCDATILSTPKLGASFVDYLVTLHQNGGNQQGFGGEGIETFLYVISGNITAKAEGKTFVLSEGGYLYCPPGSLMTFVNAQAEDSQIFLYKRRYIPVEGHAPWLVSGNASELERIHYEGMDDVILLDFLPKELGFDMNMHILSFAPGASHGYIETHVQEHGAYILSGQGVYNLDNNWIPVKKGDYIFMGAYSLQAGYGVGRGEAFSYIYSKDCNRDVEI

SEQ ID NO: 1243 - DNA, 1236 bp, Escherichia coli
atgattacacatttccgtcaagctatagaagaaacgctgccctggctttcctcttttggcgctgacccagcgggtgggatgacccgtttactttattcgccggaatggctggaaacccagcagcagtttaaaaaaagaatggcagcaagcgggctggaaacacgtttcgatgaagtggggaatttatacggtcgcctgagtggcaccgaatatccacaggaagtggttctgagcggttcgcatatcgataccgtggttaacggcggtaacctcgacgggcaattcggtgcgctggcggcgtggctggctattgactggctgaaaacgcaatacggcgcgccgttacgtacggtcgaagtggtggcgatggcagaagaagaaggcagccgcttcccgtatgttttctggggcagtaaaaatatttttgggctggcgaatcctgacgacgtgcggaatatctgtgatgccaaaggaaatagttttgtcgatgcgatgaaggcttgcggatttactctgccgaacgccccactaactccgcgtcaggatattaaagcctttgtcgaactgcatatcgaacagggctgtgtgctggaaagtaatgggcaatcaattggcgtggtgaatgcaattgtcgggcagcgtcgttatacggtgacgctgaatggcgaatcaaaccatgcaggcaccacgccgatgggttatcgtcgtgatacggtttacgctttcagtcgcatttgccatcagtctgtcgaaaaagcgaaaaagatgggcgacccgctggttctgacctttggcaaagtagagccgcgcccgaatacggtgaatgtagtgccgggtaaaaccacgttcaccattgattgtcgtcataccgacgctaccgtgctgcgcgatttcacccaacagttagaaaacgacatgcgggcgatttgcgatgaaatggatattggtattgatatcgatttatggatggacgaagaacccgtgccgatgaataaggagctggtcgccaccctgacagaattgtgtgaaagcgaaaaactgaattaccgggtgatgcacagtggtgccgggcacgacgcgcaaattttcgcgcctcgcgtgccgacctgcatgattttcattcccagcatcaacgggatcagccataacccggcggaacgcaccaatattaccgaccttgccgaaggggtcaaaacgttggcactcatgctttatcaacttgcctggcagaaataa

SEQ ID NO: 1244 - protein, 411 aa, Escherichia coli
MITHFRQAIEETLPWLSSFGADPAGGMTRLLYSPEWLETQQQFKKRMAASGLETRFDEVGNLYGRLSGTEYPQEVVLSGSHIDTVVNGGNLDGQFGALAAWLAIDWLKTQYGAPLRTVEVVAMAEEEGSRFPYVFWGSKNIFGLANPDDVRNICDAKGNSFVDAMKACGFTLPNAPLTPRQDIKAFVELHIEQGCVLESNGQSIGVVNAIVGQRRYTVTLNGESNHAGTTPMGYRRDTVYAFSRICHQSVEKAKKMGDPLVLTFGKVEPRPNTVNVVPGKTTFTIDCRHTDATVLRDFTQQLENDMRAICDEMDIGIDIDLWMDEEPVPMNKELVATLTELCESEKLNYRVMHSGAGHDAQIFAPRVPTCMIFIPSINGISHNPAERTNITDLAEGVKTLALMLYQLAWQK

SEQ ID NO: 1245 - DNA, 1050 bp, Escherichia coli
atgaaaatcagtcgggaaacactccaccagctaatcgagaataaactctgccaggctgggttaaaacgtgagcacgctgcaaccgtggctgaagtattggtttacgccgatgccagagggatccactctcatggcgcggtgcgcgttgaatactacgccgaacgcatttcaaaaggcggcaccaaccgcgaaccggagtttcgtcttgaggaaaccggaccgtgctcggcaattttacatgccgacaatgccgccggacaggtcgcagcgaaaatgggtatggaacatgccatcaaaaccgcccagcaaaaaggcgttgcggtggtcggtatcagccggatgggtcacagcggcgcaatctcttattttgtgcagcaggcagcccgcgccggattaattggcatttcgctgtgccagtccgatccaatggtggtgccgtttggcggcgcggaaatttactacggcactaacccactggcctttgccgcgccgggagaaggcgacgagatccttacctttgatatggcgactaccgtacaggcatggggaaaagtgctcgacgcccgctcgcgcaatatgtctatcccggatacctgggcagtcgataaaaacggtgcaccaacaaccgatccgttcgcggtacatgctctgctccccgccgctgggccgaaagggtatggcctgatgatgatgattgacgtcctctcaggcgtcttactcggcttaccgttcgggcgacaggttagttcgatgtatgacgatttacacgccgggcgtaatttggggcaattacatatagttattaacccgaactttttctcctccagcgaattattccgtcaacatcttagccagaccatgcgcgaattaaataccattacccccgcgcccggttttaatcaggtttattatcccggacaggatcaggatattaaacaacgaaaagccgccgtcgaaggcatcgaaattgttgatgatatttaccagtatttaatttccgacgcgctttataacacgtcatacgaaacgaaaaatccctttgcgcaataa

SEQ ID NO: 1246 - protein, 349 aa, Escherichia coli
MKISRETLHQLIENKLCQAGLKREHAATVAEVLVYADARGIHSHGAVRVEYYAERISKGGTNREPEFRLEETGPCSAILHADNAAGQVAAKMGMEHAIKTAQQKGVAVVGISRMGHSGAISYFVQQAARAGLIGISLCQSDPMVVPFGGAEIYYGTNPLAFAAPGEGDEILTFDMATTVQAWGKVLDARSRNMSIPDTWAVDKNGAPTTDPFAVHALLPAAGPKGYGLMMMIDVLSGVLLGLPFGRQVSSMYDDLHAGRNLGQLHIVINPNFFSSSELFRQHLSQTMRELNTITPAPGFNQVYYPGQDQDIKQRKAAVEGIEIVDDIYQYLISDALYNTSYETKNPFAQ

SEQ ID NO: 1247 - DNA, 1668 bp, Escherichia coli
atgatccacgcctttattaaaaaagggtgttttcaggattcggtcagtttaatgattatttcacgaaaactcagcgaatcagaaaatgttgatgatgtttccgtaatgatgggtacgcccgccaataaagcgttattagatactacaggtttctggcatgacgattttaatcacgccacgccgaacgatatttgcgtggcaattcgtagcgaagcggcggatgcggggatcgcgcaggcggttatgcagcagcttgaagaggcgctaaaacaactggcgcagggttcaggcagcagccaggcgttgacgcaggtgcgtcgctgggacagtgccagtcagaaattacccgatgccaatctggcgctgatttcagtggctggtgagtatgcggcggagctggcgaaccaggcgctggatcgcaacctcaacgtgatgatgttctccgataacgtcacgctggaagatgaaatccaacttaaaacccgcgcgcgggaaaaaggcttgctggtgatggggccagactgcggtacgtcgatgattgccgccacgccgctggcttttgctaacgtgatgccggaaggcaacattggcgtcataggcgcttccggtaccgggattcaggagctgtgctcacagattgcgctggcaggggagggaattactcacgcgattggtcttggcgggcgcgatctcagccgtgaagtgggcggcatcagtgcgctaacggcgctggaaatgctcagtgcagacgagaaaagcgaagtgctggcatttgtttcaaaaccacctgccgaaactgtgcgtctgaaaattgttaatgccatgaaagcaactggcaaaccgacggtggcgctgtttttaggttataccccggcggtggcccgcgacgagaatgtctggtttgcctcctcgctggatgaggccgctcgtctggcttgtctgctttcacgcgtcactgcgcgacgtaacgcgatagcgcctgtcagcagcggatttatttgcggtttgtataccggcggtacgctggctgctgaagcggcgggattacttgccggacaccttggcgtggaagccgacgatacccatcaacatggcatgatgctggacgccgacggacatcagatcctcgacctgggcgatgatttttacaccgtcgggcgtccccatccgatgatcgacccgaccttacgcaacctgttaattgccgatctcggcgctaaaccgcaagtgcgcgtgttgctgcttgatgtcgtgattggcttcggtgcgaccgccgatcctgccgcctcgctggtgagcgcctggcaaaaagcctgtgccgcgcgttcagacaatcaaccactgtatgccattgccacggtgacaggcactgaacgtgacccgcaatgccgctcgcagcaaatcgccacgctggaagatgcggggatcgcggtagtgagttcgctaccggaagccaccttgctggctgcggcgttaattcatccgctcccgtcagccacacagcaacacacaccgtcattactggaaaacgtcgccgtgattaacatcggattacgcagctttgcgctggagctacaaagcgccagcaaaccggttgtgcattaccaatggtcgccagtcgccggcggcaataaaaaactggctcgtttattagaacgtttgcaataa

SEQ ID NO: 1248 - protein, 555 aa, Escherichia coli
MIHAFIKKGCFQDSVSLMIISRKLSESENVDDVSVMMGTPANKALLDTTGFWHDDFNHATPNDICVAIRSEAADAGIAQAVMQQLEEALKQLAQGSGSSQALTQVRRWDSASQKLPDANLALISVAGEYAAELANQALDRNLNVMMFSDNVTLEDEIQLKTRAREKGLLVMGPDCGTSMIAATPLAFANVMPEGNIGVIGASGTGIQELCSQIALAGEGITHAIGLGGRDLSREVGGISALTALEMLSADEKSEVLAFVSKPPAETVRLKIVNAMKATGKPTVALFLGYTPAVARDENVWFASSLDEAARLACLLSRVTARRNAIAPVSSGFICGLYTGGTLAAEAAGLLAGHLGVEADDTHQHGMMLDADGHQILDLGDDFYTVGRPHPMIDPTLRNLLIADLGAKPQVRVLLLDVVIGFGATADPAASLVSAWQKACAARSDNQPLYAIATVTGTERDPQCRSQQIATLEDAGIAVVSSLPEATLLAAALIHPLPSATQQHTPSLLENVAVINIGLRSFALELQSASKPVVHYQWSPVAGGNKKLARLLERLQ

SEQ ID NO: 1249 - DNA, 252 bp, Escherichia coli
atgtttacatcagtggcgcaagccaatgctgcggttatcgaacaaattcgtcgcgctcgtccacactggctggatgtgcaaccggcttcttcacttatcagcgaactaaacaagggcaaaacactgcttcacgccgggccgccaatgcgctggcaggagatgaccgggccaatgaaaggggcgtgcgtgggcgcatgtctgttcgaaggctgggcgaaagatgaagcgcaggcacaggcaatgctggagtag

SEQ ID NO: 1250 - protein, 83 aa, Escherichia coli
MFTSVAQANAAVIEQIRRARPHWLDVQPASSLISELNKGKTLLHAGPPMRWQEMTGPMKGACVGACLFEGWAKDEAQAQAMLE

SEQ ID NO: 1251 - DNA, 960 bp, Escherichia coli
atgggtggcattacttctgccagtatgccgatgctggtggtcgagaacgtgaccgacggcaaccgggcgtactgcaacctcaacgaaggtatcggaaaagtgatgcgttttggcgcttacggcgaagatgtcctgactcgccatcgctggatgcgcgatgtgttaatgccagtattaagcgcggcgctggggcgcatggagcgcggtatcgatctcacggcaatgatggcgcagggcattaccatgggcgatgagttccatcaacgcaatattgcttcctctgcactgttaatgcgtgcgctggctccacaaattgctcgcctcgatcatgataaacagcacattgcggaagtgatggatttcctcagcgtgaccgatcagttcttcctcaacctcgcgatggcctactgcaaggcggcgatggatgcaggcgcgatgatccgcgcaggcagcatcgttacggctatgacccgcaacggcaatatgttcgggattcgggtcagcgggctgggtgaacgctggtttacggcgcctgtaaacactccgcaaggtctgtttttcaccggcttctcgcaggagcaggcgaacccggatatgggcgatagcgcgattaccgaaacctttggtatcggaggtgcggcaatgatcgccgcacctggcgtaacgcgctttgtcggtgcgggtggcatggaagcggccagagcggtatctgaagagatggcggaaatttaccttgaacgcaatatgcaattgcagatccccggctgggatttccagggggcgtgcctggggctggacattcgtcgcgtggtagaaaccggcattacgccactcatcaataccggtatcgcccataaagaggcggggatcgggcagattggcgcaggcaccgtgcgggcaccgctggcgtgctttgaacaggcgctggaagcactggctgaaagcatggggattggttga

SEQ ID NO: 1252 - protein, 319 aa, Escherichia coli
MGGITSASMPMLVVENVTDGNRAYCNLNEGIGKVMRFGAYGEDVLTRHRWMRDVLMPVLSAALGRMERGIDLTAMMAQGITMGDEFHQRNIASSALLMRALAPQIARLDHDKQHIAEVMDFLSVTDQFFLNLAMAYCKAAMDAGAMIRAGSIVTAMTRNGNMFGIRVSGLGERWFTAPVNTPQGLFFTGFSQEQANPDMGDSAITETFGIGGAAMIAAPGVTRFVGAGGMEAARAVSEEMAEIYLERNMQLQIPGWDFQGACLGLDIRRVVETGITPLINTGIAHKEAGIGQIGAGTVRAPLACFEQALEALAESMGIG

SEQ ID NO: 1253 - DNA, 816 bp, Escherichia coli
atgacgatcatccatcctctacttgccagccgtagcgcaccgaattatcgccagtcctggcggttagcgggagtgtggcggcgggcgattaacctgatgacggaaagcggcgaactgttaacgctgcatcgtcaggggagtggtttcggccccggcggatgggtgcttcgccgcgcgcaattcgatgcgttatgcggtggattatgcggcaatgaacgaccacaggttgtggcacaagggattcgtctcgggcgtttcacggttaaacagccacagcgttattgtttgctacgtattacgccgcctgcgcatcctcaaccgcttgccgttgcatggatgcaacgcgcggaggaaaccgggcttttcgggccactggcattggcggcaagcgatccgctgcctgctgaattacgccagtttcgtcactgttttcaggccgcgctcaatggcgttaagaccgactggcggcactggctgggtaaaggccccggattaacgccaagtcatgatgacacgctgagcggaatgctgctggcggcctggtattatggcgctttagatgcgcgctccggtcgcccgttttttgcctgttccgacaatcttcaactcgttaccactgcggtgagcgtcagttatttacgttatgccgcgcaaggatatttcgcctcgccactcctgcactttgttcatgctctgagttgcccgaaacgtaccgcagcggcgatcgattcgctgctggcgctggggcatacgtcaggggccgatacgctgctggggttctggcttggccaacaattattacaagggaaaccatga

SEQ ID NO: 1254 - protein, 271 aa, Escherichia coli
MTIIHPLLASRSAPNYRQSWRLAGVWRRAINLMTESGELLTLHRQGSGFGPGGWVLRRAQFDALCGGLCGNERPQVVAQGIRLGRFTVKQPQRYCLLRITPPAHPQPLAVAWMQRAEETGLFGPLALAASDPLPAELRQFRHCFQAALNGVKTDWRHWLGKGPGLTPSHDDTLSGMLLAAWYYGALDARSGRPFFACSDNLQLVTTAVSVSYLRYAAQGYFASPLLHFVHALSCPKRTAAAIDSLLALGHTSGADTLLGFWLGQQLLQGKP

SEQ ID NO: 1255 - DNA, 894 bp, Escherichia coli
atgaaaacactggttgtggctcttgggggcaacgccttactccagcgcggtgaggcgctgacggcaaaaaatcaatatcgcaatattgccagtgctgtacccgcgctggcgcgcctggcccgttcttatcggctggcgattgttcacggcaacgggccgcaggtggggctgctggcgttacagaatctggcgtggaaagaggtagaaccgtatccgctggatgtactggtggcggaaagccaggggatgattggctatatgctggcgcagggcttgagcgcacagccgcagatgccgcctgtcacgacggtgctgacgcgcattgaggtttcgcctgatgatccggcgtttttacagccagagaaatttattggtccggtttatcagccagaagaacaagaggcactggaagcggcttacggctggcagatgaaacgtgatggtaaatatttacgccgggtggtagcgtctccgcaaccgcgtaaaattctcgacagcgaagccatcgagttgttgctcaaagaggggcatgtggtgatttgcagtggcggcggcggtgtgcctgtggcggaagacggggcagggagtgaagcggtgattgataaagatctcgccgctgcgttgctcgccgagcagattaatgccgatggactggtgatcctcaccgatgctgatgcggtatatgaaaactggggaacgccgcagcaacgtgccattcgccgtgccacaccggatgagttagcgccatttgccaaagccgatggttcgatggggccgaaggtaacggcggtgagtggttatgtcagaagccgtggtaaacccgcgtggattggggcgttatcgcggattgaagagacgctggcgggcgaagcggggacttgtatttcgctgtag

SEQ ID NO: 1256 - protein, 297 aa, Escherichia coli
MKTLVVALGGNALLQRGEALTAKNQYRNIASAVPALARLARSYRLAIVHGNGPQVGLLALQNLAWKEVEPYPLDVLVAESQGMIGYMLAQGLSAQPQMPPVTTVLTRIEVSPDDPAFLQPEKFIGPVYQPEEQEALEAAYGWQMKRDGKYLRRVVASPQPRKILDSEAIELLLKEGHVVICSGGGGVPVAEDGAGSEAVIDKDLAAALLAEQINADGLVILTDADAVYENWGTPQQRAIRRATPDELAPFAKADGSMGPKVTAVSGYVRSRGKPAWIGALSRIEETLAGEAGTCISL

SEQ ID NO: 1257 - DNA, 1068 bp, Escherichia coli
atgaaacaggtttgcgtcctcggtaacgggcagttaggccgtatgctgcgtcaggcaggcgaaccgttaggcattgctgtctggccagtcgggctggacgctgaaccggcggcggtgccttttcaacaaagcgtgattaccgctgagatagaacgctggccggaaaccgcattaacccgcgagctggcgcgccatccggcctttgtgaaccgcgatgtgttcccgattattgctgaccgtctgactcagaagcagcttttcgataagctccacctgccgaccgcaccgtggcagttactttccgaacacagcgagtggcctgcggtgtttgatcgtttaggtgagctggcgattgttaaacgtcgcactggtggctatgacggacgcggtcaatggcgtttacgcgccgatgaaaccgaacagttaccggctgaatgctacggcgaatgtattgtcgagcagggcataaacttctcaggtgaagtgtcgctggttggcgcgcgcggctttgatggcagcaccgtgttttatccgctgacgcataacctgcatcagaacggcattttgcgcaccagcgtcgctttcccgcaggccaatgcacagcaacaggcgcaagctgaagagatgttgtcggcgattatgcaggagctgagctatgtgggcgtgatggcgatggagtgttttgtcacgccgcaaggtctgctgatcaacgaactggctccgcgtgtgcataacagtgggcactggacacaaaacggtgccagcatcagccagtttgagctacatctgcgggcgattaccgatctgccgttaccgcaaccagtagtgaataatccgtcggtgatgatcaatctgattggtagcgatctgaattatgactggctgaaactgccgcttgtgcatctgcactggtacgacaaagaagtccgtccgggccgtaaagtggggcatttgaatttgaccgacagcgacacatcgcgtctgaccgcgacgctggaagccttaatcccactgctgccgccggagtatgccagcggcgtgatgtgggcgcagagcaagttcagttaa

SEQ ID NO: 1258 - protein, 355 aa, Escherichia coli
MKQVCVLGNGQLGRMLRQAGEPLGIAVWPVGLDAEPAAVPFQQSVITAEIERWPETALTRELARHPAFVNRDVFPIIADRLTQKQLFDKLHLPTAPWQLLSEHSEWPAVFDRLGELAIVKRRTGGYDGRGQWRLRADETEQLPAECYGECIVEQGINFSGEVSLVGARGFDGSTVFYPLTHNLHQNGILRTSVAFPQANAQQQAQAEEMLSAIMQELSYVGVMAMECFVTPQGLLINELAPRVHNSGHWTQNGASISQFELHLRAITDLPLPQPVVNNPSVMINLIGSDLNYDWLKLPLVHLHWYDKEVRPGRKVGHLNLTDSDTSRLTATLEALIPLLPPEYASGVMWAQSKFS

SEQ ID NO: 1259 - DNA, 510 bp, Escherichia coli
atgtcttcccgcaataatccggcgcgtgtcgccatcgtgatggggtccaaaagcgactgggctaccatgcagttcgccgccgaaatcttcgaaatcctgaatgtcccgcaccacgttgaagtggtttctgctcaccgcacccccgataaactgttcagcttcgccgaaagcgccgaagagaacggttatcaggtgattattgcgggcgcaggcggcgcagcgcacctgcctggcatgattgccgccaaaacgctggtgccggtgctgggcgtgccagtacagagcgccgcactgagcggtgtcgatagcctctactccatcgtacaaatgccgcgcggcattccggtgggtacgctggcgattggtaaagctggcgcggcaaacgcggcgttactggcagcacaaattcttgcgactcatgataaagaactgcaccagcgtctgaatgaatggcgcaaagcacaaactgatgaagtgctggaaaacccggacccgcgaggtgcggcatga

SEQ ID NO: 1260 - protein, 169 aa, Escherichia coli
MSSRNNPARVAIVMGSKSDWATMQFAAEIFEILNVPHHVEVVSAHRTPDKLFSFAESAEENGYQVIIAGAGGAAHLPGMIAAKTLVPVLGVPVQSAALSGVDSLYSIVQMPRGIPVGTLAIGKAGAANAALLAAQILATHDKELHQRLNEWRKAQTDEVLENPDPRGAA

SEQ ID NO: 1261 - DNA, 330 bp, Escherichia coli
atgcaacgctgcaacggatttttgatttctggcatcgcccttacggcaggagcgccactgtgtattagctggttcggtcttgtcggcttctattttggcgcattgtcactggtagctgcggcggtcatttcctggatagtctatttctggctcatttatttagtactcacccgcccccataaccaacgttttgtagaaagatttatattgattgtcggtatttgcttttttccatggagcattgtgttgatatgggcattctttgccagttcagccagagcgcataatcaacacgcagaacaaattaaaaactcaacaactgacggttaa

SEQ ID NO: 1262 - protein, 109 aa, Escherichia coli
MQRCNGFLISGIALTAGAPLCISWFGLVGFYFGALSLVAAAVISWIVYFWLIYLVLTRPHNQRFVERFILIVGICFFPWSIVLIWAFFASSARAHNQHAEQIKNSTTDG

SEQ ID NO: 1263 - DNA, 723 bp, Escherichia coli
gtggcgacactctttattgcagatcttcatctctgcgtggaagaaccggcgatcaccgccggttttctgcgttttttagcgggggaggcccgcaaggccgatgcgctgtatattcttggcgatctgtttgaagcctggatcggcgacgacgatcccaacccacttcatcaccagatggccgcagcaatcaaagcggtatccgattccggcgttccctgttatttcattcatggcaaccgtgattttctgctcggcaaacgctttgcccgtgaaagcggcatgacgttattgccggaagaaaaggtgctcgaactttatggtcgtcgggtgttgattatgcatggcgacacgctgtgcaccgatgacgcgggttatcaggcttttcgcgccaaagtccacaaaccctggctgcaaacgctatttctcgccctgccgttgtttgtgcgcaaacgcattgccgcgcgaatgcgcgcgaacagcaaagaagccaacagcagtaaatcgctggcgatcatggacgttaaccaaaacgcggtggtcagtgcgatggaaaaacatcaagtgcaatggctgatccacgggcatacccatcgcccggcggtgcatgaacttatcgccaatcagcaacctgcttttcgcgtggtactgggtgcctggcatacagaaggttcgatggtgaaagtcacggcggatgacgttgagctgattcattttcctttctga

SEQ ID NO: 1264 - protein, 240 aa, Escherichia coli
MATLFIADLHLCVEEPAITAGFLRFLAGEARKADALYILGDLFEAWIGDDDPNPLHHQMAAAIKAVSDSGVPCYFIHGNRDFLLGKRFARESGMTLLPEEKVLELYGRRVLIMHGDTLCTDDAGYQAFRAKVHKPWLQTLFLALPLFVRKRIAARMRANSKEANSSKSLAIMDVNQNAVVSAMEKHQVQWLIHGHTHRPAVHELIANQQPAFRVVLGAWHTEGSMVKVTADDVELIHFPF

SEQ ID NO: 1265 - DNA, 495 bp, Escherichia coli
atggttactttccacaccaatcacggcgatattgtcatcaaaacttttgacgataaagcacctgaaacagttaaaaacttcctggactactgccgcgaaggtttttacaacaacaccattttccaccgtgttatcaacggctttatgattcagggcggcggttttgaaccgggcatgaaacaaaaagccaccaaagacccgatcaaaaacgaagcgaacaacggtctgaaaaatacccgtggtacgctggcaatggcccgtactcaggcaccgcactctgcaactgcccagttcttcatcaacgtggttgataacgacttcctgaacttctctggcgaaagcctgcaaggttggggctactgcgtatttgctgaagtggttgaaggcatggacgtggtagacaaaatcaaaggtgtggcaaccggtcgtagcggtatgcaccaggacgtgccaaaagaagacgttatcattgaaagcgtgaccgttagcgagtaa

SEQ ID NO: 1266 - protein, 164 aa, Escherichia coli
MVTFHTNHGDIVIKTFDDKAPETVKNFLDYCREGFYNNTIFHRVINGFMIQGGGFEPGMKQKATKDPIKNEANNGLKNTRGTLAMARTQAPHSATAQFFINVVDNDFLNFSGESLQGWGYCVFAEVVEGMDVVDKIKGVATGRSGMHQDVPKEDVIIESVTVSE

SEQ ID NO: 1267 - DNA, 1386 bp, Escherichia coli
atgctaaaaatcttcaatactctgacacgccaaaaagaggaatttaagcctattcacgccggggaagtcggcatgtacgtgtgtggaatcaccgtttacgatctctgtcatatcggtcacgggcgtacctttgttgcctttgacgtggttgcgcgctatctgcgtttcctcggctataagctgaagtatgtgcgcaacattactgatatcgacgacaaaatcatcaaacgcgccaatgaaaatggcgaaagctttgtggcgctggtggatcgcatgatcgccgaaatgcacaaagattttgatgctttgaacattctgcgcccggatatggagccgcgcgcgacgcaccatatcgccgaaattattgaactcactgaacaactgatcgctaaaggtcacgcttatgtggcggacaacggcgacgtgatgttcgacgtcccgaccgatccgacatatggcgtgctgtcgcgtcaggatctcgatcagctgcaggcaggcgcgcgcgttgacgtggtcgatgacaaacgtaacccgatggacttcgttctgtggaagatgtcgaaagagggcgaaccgagctggccgtctccgtggggcgcgggccgtcctggctggcacattgagtgttcggcaatgaactgcaaacagttgggtaaccactttgatatccacggcggcggttctgacctgatgttcccgcaccacgagaacgaaattgcccagtccacctgtgcgcacgatggccagtatgtgaattactggatgcactccggtatggtgatggttgaccgcgagaagatgtctaaatcgctgggtaacttcttcaccgtgcgtgacgtgctgaaatactacgatgcggaaactgtgcgttacttcctgatgtcgggtcactatcgcagccagctgaactacagcgaagagaacctgaaacaggcgcgtgcggcgctggaacgtctctatactgccttgcgcggcacagacaaaaccgttgcgcctgccggtggcgaagcgtttgaagcgcgctttattgaagcaatggacgacgatttcaacaccccggaagcctattccgtgctgtttgatatggcgcgtgaagtgaaccgtctgaaagcagaagatatggcagcggcgaatgcaatggcgtctcacctgcgtaaactttctgccgtattgggcctgctggagcaagaaccggaagcgttcctgcaaagcggtgcgcaggcagacgacagcgaagtggctgagattgaagcgttaattcaacagcgtctggatgcccgtaaagcgaaagactgggcggcggcagatgcggcgcgtgaccgccttaacgagatggggatcgtgctggaagatggcccgcaagggaccacctggcgtcgtaagtaa

SEQ ID NO: 1268 - protein, 461 aa, Escherichia coli
MLKIFNTLTRQKEEFKPIHAGEVGMYVCGITVYDLCHIGHGRTFVAFDVVARYLRFLGYKLKYVRNITDIDDKIIKRANENGESFVALVDRMIAEMHKDFDALNILRPDMEPRATHHIAEIIELTEQLIAKGHAYVADNGDVMFDVPTDPTYGVLSRQDLDQLQAGARVDVVDDKRNPMDFVLWKMSKEGEPSWPSPWGAGRPGWHIECSAMNCKQLGNHFDIHGGGSDLMFPHHENEIAQSTCAHDGQYVNYWMHSGMVMVDREKMSKSLGNFFTVRDVLKYYDAETVRYFLMSGHYRSQLNYSEENLKQARAALERLYTALRGTDKTVAPAGGEAFEARFIEAMDDDFNTPEAYSVLFDMAREVNRLKAEDMAAANAMASHLRKLSAVLGLLEQEPEAFLQSGAQADDSEVAEIEALIQQRLDARKAKDWAAADAARDRLNEMGIVLEDGPQGTTWRRK

SEQ ID NO: 1269 - DNA, 522 bp, Escherichia coli
atgccaaccgttattacgcacgccgccgttcccctatgcattggtttagggttgggttcgaaagccatccctccgcgtctgttatttgccggaatcatcctggcgatgctgcccgatgctgatgtattgtcgtttaaatttggcgttgcttacggcaatgtttttggtcatcgcgggtttacccattcgctggtgtttgcgtttgttgtcccgctgttatgtgtgctgattggacgtcgatggttcagggctgggctgattcgctgctggctgtttttaaccgtctcgttgctatcgcacagcttgctggattcggtaaccactggcggtaaaggggttggctggctgtggccgtggtcagatgaacgctttttcgctccctggcaggtgattaaagtcgcgccgtttgcattgtctcgttacaccacgccgtacgggcatcaggtgattatttctgaattgatgtgggtgtggttgccggggatgctactgatgggaatgttgtggtggcgcagacgataa

SEQ ID NO: 1270 - protein, 173 aa, Escherichia coli
MPTVITHAAVPLCIGLGLGSKAIPPRLLFAGIILAMLPDADVLSFKFGVAYGNVFGHRGFTHSLVFAFVVPLLCVLIGRRWFRAGLIRCWLFLTVSLLSHSLLDSVTTGGKGVGWLWPWSDERFFAPWQVIKVAPFALSRYTTPYGHQVIISELMWVWLPGMLLMGMLWWRRR

SEQ ID NO: 1271 - DNA, 243 bp, Escherichia coli
ttgaatatcatgatccacagggtgagtaacatggcgacattttctttaggtaaacatccgcacgttgagctgtgcgacttgctgaaactggaaggctggagcgaaagcggcgcgcaggcgaaaatcgcgatagcagaaggccaggtgaaagtcgacggtgcggttgaaacgcgcaaacgctgcaaaattgtcgccggtcagacagtgagttttgcaggtcacagcgtacaggttgttgcctga

SEQ ID NO: 1272 - protein, 80 aa, Escherichia coli
MNIMIHRVSNMATFSLGKHPHVELCDLLKLEGWSESGAQAKIAIAEGQVKVDGAVETRKRCKIVAGQTVSFAGHSVQVVA

SEQ ID NO: 1273 - DNA, 867 bp, Escherichia coli
atggcagcaaagattattgacggtaaaacgattgcgcagcaggtgcgctctgaagttgctcaaaaagttcaggcgcgtattgcagccggactgcgggcaccaggactggccgttgtgctggtgggcagtaaccctgcatcgcaaatttatgtcgcaagcaaacgcaaggcttgtgaagaagtcgggttcgtctcccgctcttatgacctcccggaaaccaccagcgaagcggagctgctggagcttatcgatgcgctgaatgccgacaacaccattgatggcattctggttcaactgccgttaccggcgggtattgataacgtcaaagtgctggaacgtattcatccggacaaagacgtggacggtttccatccttacaacgtcggtcgtctgtgccagcgcgcgccacgtctgcgtccctgtaccccgcgcggtatcgtcacgctgcttgagcgttacaacattgataccttcggccttaacgccgtggtgattggcgcatcgaatatcgtcggtcgcccaatgagcatggaactgctgctggcaggttgcaccaccaccgtgactcaccgtttcactaaaaatctgcgtcaccacgtagaaaatgccgatctactgatcgttgccgtcggcaagccgggctttattcctggtgactggatcaaagaaggcgcaattgtgattgatgtcggcatcaaccgtctggaaaatggcaaagttgtgggcgacgtcgtgtttgaagacgcggctaaacgcgcctcatacattacgcctgttccgggcggcgttggcccgatgacggttgccacgctgattgaaaacacgctacaggcgtgcgttgaatatcatgatccacagggtgagtaa

SEQ ID NO: 1274 - protein, 288 aa, Escherichia coli
MAAKIIDGKTIAQQVRSEVAQKVQARIAAGLRAPGLAVVLVGSNPASQIYVASKRKACEEVGFVSRSYDLPETTSEAELLELIDALNADNTIDGILVQLPLPAGIDNVKVLERIHPDKDVDGFHPYNVGRLCQRAPRLRPCTPRGIVTLLERYNIDTFGLNAVVIGASNIVGRPMSMELLLAGCTTTVTHRFTKNLRHHVENADLLIVAVGKPGFIPGDWIKEGAIVIDVGINRLENGKVVGDVVFEDAAKRASYITPVPGGVGPMTVATLIENTLQACVEYHDPQGE

SEQ ID NO: 1275 - DNA, 1164 bp, Escherichia coli
atgtcactcttccgcagaaatgaaatatggtatgcctcgtattcgctcccgggcgggaaacgaattaaggaatctcttggcacaaaggacaagcggcaagctcaggagttgcacgacaagcgaaaagcagaactctggcgagtagaaaagctaggggatttacctgatgtcacttttgaagaggcctgcctaagatggcttgaggaaaaagctgataaaaaatctctcgattcagataaaagccggattgagttctggcttgaacattttgagggtataaggcttaaagatatctcggaggcaaagatttactctgctgtaagcagaatgcataacagaaagacgaaagaaatatggaaacagaaagttcaggccgccatcaggaaaggtaaagaaccgcctgtttatgaaccaaagccagtatcaactcagacaaaggcaaagcatcttgccatgataaaggccattctccgtgctgcagaacgcgactggaagtggctggaaaaagcgcctgtcatcaagataccagcggtcagaaacaagcgagtcagatggctggaaaaggaggaagcaaaacgccttattgatgagtgccccgaaccactgaaatctgtcgtcaagtttgcgctggcaactggtctgagaaagtcgaacatcataaatctggaatggcaacaaatcgacatgcagcgacgagttgcctgggtgaatccagaagagagcaaatcaaaccgcgccattggtgtggcgctgaacgataccgcctgtaaagtgttgcgtgatcaaataggcaagcatcacaaatgggtgtttgtacataccaaggcggctaagcgagcagatggaacatcaacgcctgcggtcaggaagatgcgcatcgacagcaagacatcatggctatcagcttgtcgtcgtgcaggaattgaagatttccgtttccatgacctcagacacacctgggcaagctggctgatccagtcaggcgtcccattatctgtgcttcaggaaatgggcggatgggagtccatagaaatggttcgtaggtatgctcaccttgcgcctaatcatttgacagagcatgcaaggaaaatagacgacatttttggtgataatgtcccaaatatgtcccactgtggaattatggaggatataaagaaggcgtaa

SEQ ID NO: 1276 - protein, 387 aa, Escherichia coli
MSLFRRNEIWYASYSLPGGKRIKESLGTKDKRQAQELHDKRKAELWRVEKLGDLPDVTFEEACLRWLEEKADKKSLDSDKSRIEFWLEHFEGIRLKDISEAKIYSAVSRMHNRKTKEIWKQKVQAAIRKGKEPPVYEPKPVSTQTKAKHLAMIKAILRAAERDWKWLEKAPVIKIPAVRNKRVRWLEKEEAKRLIDECPEPLKSVVKFALATGLRKSNIINLEWQQIDMQRRVAWVNPEESKSNRAIGVALNDTACKVLRDQIGKHHKWVFVHTKAAKRADGTSTPAVRKMRIDSKTSWLSACRRAGIEDFRFHDLRHTWASWLIQSGVPLSVLQEMGGWESIEMVRRYAHLAPNHLTEHARKIDDIFGDNVPNMSHCGIMEDIKKA

SEQ ID NO: 1277 - DNA, 306 bp, Escherichia coli
atgaccacatttaccaataaagaactgattaaagaaatcaaagaacgaatcagcagcctagaggttcgagacgatattgagcgccgtgcttatgaaatcgcactcgtatctctggaagtagagccagatgaacgcgaagcctatgaattattcatggaaaagcgtttcggtgacttagtagatcgtcggagagtaaaaaacggcgataacgaatacatggcatgggatatgactctcggttggatcgtctggcagcaacgagctggtatccatttttcaacaatgacacagcaagaggtgaaataa

SEQ ID NO: 1278 - protein, 101 aa, Escherichia coli
MTTFTNKELIKEIKERISSLEVRDDIERRAYEIALVSLEVEPDEREAYELFMEKRFGDLVDRRRVKNGDNEYMAWDMTLGWIVWQQRAGIHFSTMTQQEVK

SEQ ID NO: 1279 - DNA, 363 bp, Escherichia coli
atgcgcatgaatgttttcgaaatggaagggtttcttcgcgggaaatgtgtaccgcgagatctgaaagtgaatgaaacaaatgctgagtacctgttacgtaaattcgacgcgcttgaagctaaatgtgcggcactggaaaacaaaataataccagtgtcagctgaactgccaccagcaaatgaaagtgttctgttatttgatgctaatggagaaggctggctgattggctggcgttctctctggtacacctggggacaaaaagaaaccggagaatggcagtggacatttcaggtcggggaccttgaaaacgtcaatatcactcactgggcagtaatgccaaaagcaccggaggctggagcataa

SEQ ID NO: 1280 - protein, 120 aa, Escherichia coli
MRMNVFEMEGFLRGKCVPRDLKVNETNAEYLLRKFDALEAKCAALENKIIPVSAELPPANESVLLFDANGEGWLIGWRSLWYTWGQKETGEWQWTFQVGDLENVNITHWAVMPKAPEAGA

SEQ ID NO: 1281 - DNA, 537 bp, Escherichia coli
atgtcatttattaaaactttttccgggaagcatttttattatgacaggataaataaagacgacatcgtgattaacgatatcgcggtttccctttcaaatatctgtcgctttgccggtcatctttcacacttctacagtgtcgcccaacatgcggtgctttgcagccagctggtgccgcaggaatttgcttttgaagcgttaatgcatgatgcaacagaagcgtattgccaggacatccccgcgccgctgaaacgccttcttcctgactataaacggatggaagaaaaaatagacgccgtaatccgtgagaaatacgggttacccccagttatgagtacacccgtgaaatatgccgatctcatcatgctggcaaccgaacgccgcgatctcgggcttgatgatggctctttctggcctgtactggaaggcatcccggcaacagagatgttcaacgtgattccactggcaccgggtcatgtctacgggatgtttatggaacgttttaacgatttatcggagttacgcaaatgcgcatga

SEQ ID NO: 1282 - protein, 178 aa, Escherichia coli
MSFIKTFSGKHFYYDRINKDDIVINDIAVSLSNICRFAGHLSHFYSVAQHAVLCSQLVPQEFAFEALMHDATEAYCQDIPAPLKRLLPDYKRMEEKIDAVIREKYGLPPVMSTPVKYADLIMLATERRDLGLDDGSFWPVLEGIPATEMFNVIPLAPGHVYGMFMERFNDLSELRKCA

SEQ ID NO: 1283 - DNA, 825 bp, Escherichia coli
atgtctcagaacttagacgcaaccgcaattaatcaaatccatgcccttatttctgctcagggtgttaatgaaattatcagtaagattggtgccgatgctgtggcattgcctgagaatttccgcattcatgatctggaaaaatttaatttaaatcgcttccgtttccgtggtgcgctttccactgccagcatcgatgactttacccgttattctaaagatcttgcagatgaaggcacccgctgctttatcgatgccgataatatgcgtgccgtcagtgtgcttaacctgggtactattgatgaaccaggtcacgcagataacaccgccactctcaaactgaaaaagacagcaccgttctctgctctgttgtctgttaacggcgagcgtaactcccagaagtcactggcagaatggattgaagactgggccgactaccttgtgggctttgatgctaatggtgacgccattcaggcaacaaaagcggctgcggctgtccgtaaaatcacgattgaagcaaaccagaccgctgattttgaagacaatgacttcagcggcaaacgctccctgatggagtctgtcgaagcgaaaaccaaagatattatgccagtggcatttgaatttaaatgcgttccgtttgaaggcctgaaagaacgtccgtttaaattacgcctcagcattatcactggcgatcgtcctgtactggttctgcgcattattcagctggaagcagtgcaggaagaaatggctaacgaatttcgtgatctgcttgttgagaaattcaaagacagcaaagtagaaacctttattggtactttcaccgcctga

SEQ ID NO: 1284 - protein, 274 aa, Escherichia coli
MSQNLDATAINQIHALISAQGVNEIISKIGADAVALPENFRIHDLEKFNLNRFRFRGALSTASIDDFTRYSKDLADEGTRCFIDADNMRAVSVLNLGTIDEPGHADNTATLKLKKTAPFSALLSVNGERNSQKSLAEWIEDWADYLVGFDANGDAIQATKAAAAVRKITIEANQTADFEDNDFSGKRSLMESVEAKTKDIMPVAFEFKCVPFEGLKERPFKLRLSIITGDRPVLVLRIIQLEAVQEEMANEFRDLLVEKFKDSKVETFIGTFTA

SEQ ID NO: 1285 - DNA, 459 bp, Escherichia coli
atggctagcgaacgcagtactgatgtgcaggcatttatcggggagctggacggcggcgtatttgaaaccaaaatcggcgcagttctcagtgaggtcgcttccggtgtgatgaacacgaaaaccaaagggaaggtctcactcaatctggaaatcgaaccgtttgatgagaaccgtgtgaaaatcaaacacaaactctcatatgttcgcccaactaaccgcgggaaaatttccgaagaagacaccaccgaaacgccgatgtatgtcaatcgcggtggtcgcctgactattctgcaggaagaccagggacaattactgactcttgccggtgaacctgacggaaaactccgcgcagcagtcgttaatatcgttcgtaataaactgattatttatctcatcactgaatatctttatatagtgaggacttattatgtctcagaacttagacgcaaccgcaattaa

SEQ ID NO: 1286 - protein, 152 aa, Escherichia coli
MASERSTDVQAFIGELDGGVFETKIGAVLSEVASGVMNTKTKGKVSLNLEIEPFDENRVKIKHKLSYVRPTNRGKISEEDTTETPMYVNRGGRLTILQEDQGQLLTLAGEPDGKLRAAVVNIVRNKLIIYLITEYLYIVRTYYVSELRRNRN

SEQ ID NO: 1287 - DNA, 780 bp, Escherichia coli
ttgtggtgccgggtgcctcccggtgcctggcgaaggttgcacaccaggcgggtgggtatccacagaaggtcgactgtcagcctcaaccttaacccgcgtgcgctgagccgcattcaccacaacgctaaggattctctctggttgaaaatacttagctgttatgtgcctgcttttagccacatcaggcgaggtggacctggttattccccaacaacaaggattcggttaatctggatatccccaacaacaataagagtattcaatgtgatcgctgaattaacggcagcaatgacggctattcgtgaaacagcccagattgcaaaactaatgaacgaggcaaaaactcaagctgaagtaaatgcggctattggtgagctgaactcaaagcttgcgtctattcagcgcgaatgcgtgtctctcgttgaactggtgggctcttatcaagaaataaatgcttctctcaaagctaaaattgcagaattcgaaaactttgaggctcagacggaaggctatatccttaaccaacttgagtcgggtacttttgtatactcgaaggaggtaatcgtgaacggtggcagcataaccatgcatctttgcccaaaatgttttggacaaaagatagtatcgatacttcaaccattcccggttagcgaagatgagctttttcataaaagcaggtgcctccactgtgaaaataagtttctgatgaataaaaatccggattacgtatcgcctccatccattgaggagttgtccagaaaacttaacggcaatctgtag

SEQ ID NO: 1288 - protein, 259 aa, Escherichia coli
MWCRVPPGAWRRLHTRRVGIHRRSTVSLNLNPRALSRIHHNAKDSLWLKILSCYVPAFSHIRRGGPGYSPTTRIRLIWISPTTIRVFNVIAELTAAMTAIRETAQIAKLMNEAKTQAEVNAAIGELNSKLASIQRECVSLVELVGSYQEINASLKAKIAEFENFEAQTEGYILNQLESGTFVYSKEVIVNGGSITMHLCPKCFGQKIVSILQPFPVSEDELFHKSRCLHCENKFLMNKNPDYVSPPSIEELSRKLNGNL

SEQ ID NO: 1289 - DNA, 531 bp, Escherichia coli
atggataacccgacattgaacaaattgagtgaagaaacccggttacagatcatcccttaccttgtgagttttgcctttgctgattattccaggtctgcggcaagtaaggctcgctgtgagcattgtgctggtactggatttcatagtgtattgcgcgaagtggtgaaacactccagaagcggggaatctgttatcaaggaagagtgggtgaaggaattatgtcagcattgccatggtaagggagaagtcagcacggcttgcagagggtgtaagggtaaaggcattgtcctggatgaaaaaagaacccggcttcatggcgcgcctgtttataagatttgtgggcgttgcaatggaaaccggtttagtcgtttaccgaccacactggcacgacgtcatgtccagaagctggtaccagacctgactgattatcagtggtacaaaggatatgcagacgtcattgataaactggtaacaaagtgctggcaggaagaagcattcgctgaagcacaattgagaaaggtgacgagataa

SEQ ID NO: 1290 - protein, 176 aa, Escherichia coli
MDNPTLNKLSEETRLQIIPYLVSFAFADYSRSAASKARCEHCAGTGFHSVLREVVKHSRSGESVIKEEWVKELCQHCHGKGEVSTACRGCKGKGIVLDEKRTRLHGAPVYKICGRCNGNRFSRLPTTLARRHVQKLVPDLTDYQWYKGYADVIDKLVTKCWQEEAFAEAQLRKVTR

SEQ ID NO: 1291 - DNA, 195 bp, Escherichia coli
atgctaaaacagcaagatatgacagaaacggcgaaagttgtttttaatgaattaaacggcaaaccggcaacagtcggggagatagcacaaaacacatacctttcacgcgaacgctgtcagttaatactgacccagctggttatggcggggctggcagattaccagttcggctgttacagacgccttcagcaatga

SEQ ID NO: 1292 - protein, 64 aa, Escherichia coli
MLKQQDMTETAKVVFNELNGKPATVGEIAQNTYLSRERCQLILTQLVMAGLADYQFGCYRRLQQ

SEQ ID NO: 1293 - DNA, 1062 bp, Escherichia coli
atgaaaaacactgtaaaaataaacagtattgatttaatcaacgctgattgcctgcattttattcagtccctgcctgatgattccattgacctgattgttaccgatccgccttacttcaaggtgaaacccaacggttgggacaatcagtggaaaggggacgaagattaccttaagtggctggaccactgtctggcccagttctggcgggtgttgaaacctgccggaagcctttacctgttctgtgggcatcgcctggcatctgatattgagatcatgatgcgtgaacgtttcaacgtgcttaaccatatcatctgggcgaagccgtccggacgttggaatgggtgtaataaagaaagtctgcgcgcatattttcctgccacagagcgcgttctgtttgctgaacattaccgggggccatatcgcggcaaaagtgacggctatgtggcaaaagaaagggaactcaaacagcacataatggcaccgctgatatcgtatttcagggatgctcgtgccgaactgggtataacggcaaaacaaattgccgaagccacaggtaagaaaaatatggtttcccactggtttggtgccagtcagtggcagttgccgaatgaggctgactaccggaagttacaggcactgttttcccgtatagcggcagagaagtttcaggaacaacaactggaacaaccacaccaccagttggtggcatcttatgattcactgaatcgcaaatattctgaattgctggatgagtttaaatctctccggcgctatttctccgtatcagtctccgtgccttataccgatgtctggatgcataaacccgttcagttctacccgggtaaacatccgtgtgagaaaccggcggatatgctcaggcaaataatcaatgccagtagtcgacccggcgatctggttgctgatttctttatgggatccggttccacaataaaagcagcaatggcgctggggcgtcgggcgttaggtgttgagcttgagacagagcggtttaatcagaccatccaggaaatcagtatgttatcagcaaatacaattttgtga

SEQ ID NO: 1294 - protein, 353 aa, Escherichia coli
MKNTVKINSIDLINADCLHFIQSLPDDSIDLIVTDPPYFKVKPNGWDNQWKGDEDYLKWLDHCLAQFWRVLKPAGSLYLFCGHRLASDIEIMMRERFNVLNHIIWAKPSGRWNGCNKESLRAYFPATERVLFAEHYRGPYRGKSDGYVAKERELKQHIMAPLISYFRDARAELGITAKQIAEATGKKNMVSHWFGASQWQLPNEADYRKLQALFSRIAAEKFQEQQLEQPHHQLVASYDSLNRKYSELLDEFKSLRRYFSVSVSVPYTDVWMHKPVQFYPGKHPCEKPADMLRQIINASSRPGDLVADFFMGSGSTIKAAMALGRRALGVELETERFNQTIQEISMLSANTIL

SEQ ID NO: 1295 - DNA, 288 bp, Escherichia coli
gtgattcaggccatcagagttttgctgatggccttttttctttccggtagcacaggtctgttggggcgggatatgtatcagatggaaaaaatatcaacaggcattgcctacggcacctccgcaggcagtgctggctactggtttttacaatggcttgatcaggttagtccgtctcagtgggctgcgattggtgtactgggaagtctggttctgggctttctgacttatctgacgaatctgtacttcaaaatcagagaagacagaagaaaggctgcgagaggagagtaa

SEQ ID NO: 1296 - protein, 95 aa, Escherichia coli
MIQAIRVLLMAFFLSGSTGLLGRDMYQMEKISTGIAYGTSAGSAGYWFLQWLDQVSPSQWAAIGVLGSLVLGFLTYLTNLYFKIREDRRKAARGE

SEQ ID NO: 1297 - DNA, 273 bp, Escherichia coli
atggacaatagcaccatttctctacaggagttgctcgactgcatttccaggcttcgggatgatgtaaatgcccttgctgtcgcattttcatatctggcattctcaattcccaaggaacaaatgcaaccaacactggcatcgctccagcttgaatcaatcaatcccaaatggtcccagcaacaacaaaattctttcaagtggctggcggtattactggaggaaaaatatgctggtgaaattaccatttcggcggagtcttcagtgaaccagtaa

SEQ ID NO: 1298 - protein, 90 aa, Escherichia coli
MDNSTISLQELLDCISRLRDDVNALAVAFSYLAFSIPKEQMQPTLASLQLESINPKWSQQQQNSFKWLAVLLEEKYAGEITISAESSVNQ

SEQ ID NO: 1299 - DNA, 345 bp, Escherichia coli
atggtccaaaactatgaaatgattgtgaaagggatccgcaattttgagaataaagttacggtaactttagcattacaggacaaagaacgctttgacggtgaaatttttgacctggacatctcgctggaccgtgttgaaggtgccgcgctggagttttatgaggcagcagccagaaggagcatcagacaggtcttcctggatgttgctgccgggttatgtggaggggatgagcagtcgccggaaaagcgccccataattttagaggcgcagagtgtgtggataacctacaaaggaaaactgccgggaagaattactggttcactgaagactccgccgaaatggtaa

SEQ ID NO: 1300 - protein, 114 aa, Escherichia coli
MVQNYEMIVKGIRNFENKVTVTLALQDKERFDGEIFDLDISLDRVEGAALEFYEAAARRSIRQVFLDVAAGLCGGDEQSPEKRPIILEAQSVWITYKGKLPGRITGSLKTPPKW

SEQ ID NO: 1301 - DNA, 534 bp, Escherichia coli
atgaacgcaaaaatcagatacagcctgtcggctactgtactagtgctgattggtgcaggcgcgtctgctcctcaaatacttgaccagtttctggacgaaaaagaaggtaaccacacaacggcataccgtgatggttccggcatctggaccatctgtcggggtgccacgatggtggatggaaaacccgtttttcccggtatgaaactgtcgaaggaaaaatgcgaccaggttaacgccatcgaacgtgataaggcgctggcatgggtggaacgtaatattaaagtaccactgaccgaaccacaaaaagcgggtatcgcgtcattttgcccctataacattggccccggtaagtgtttcccgtcgacgttttataagcggcttaatgccggtgatcgtaaaggtgcctgtgagtcgattcgctggtggattaaggacggtgggcgtgattgccgcacacgttcaaataactgctacggacaggttattcgtcgtgaccaggaaagcgcattagcctgttgggggatagatcagtga

SEQ ID NO: 1302 - protein, 177 aa, Escherichia coli
MNAKIRYSLSATVLVLIGAGASAPQILDQFLDEKEGNHTTAYRDGSGIWTICRGATMVDGKPVFPGMKLSKEKCDQVNAIERDKALAWVERNIKVPLTEPQKAGIASFCPYNIGPGKCFPSTFYKRLNAGDRKGACESIRWWIKDGGRDCRTRSNNCYGQVIRRDQESALACWGIDQ

SEQ ID NO: 1303 - DNA, 183 bp, Escherichia coli
atgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctga

SEQ ID NO: 1304 - protein, 60 aa, Escherichia coli
MRKLKMMLCVMMLPLVVVGCTSKQSVSQCVKPPPPPAWIMQPPPDWQTPLNGIISPSERG

SEQ ID NO: 1305 - DNA, 462 bp, Escherichia coli
gtgagaagagtagccgcgattatctccgctctggttatctgcatcatcgtctgcctgtcttgggctgttaatcattaccgtgataacgccattacctacaaagccctgcgcgacaaaaatgccagagaactgaagctggcgaacgcggcaattactgacatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctgatcactatgcaaaaacaactggaaggaacccagaagtatattaatgagcagtgcagatag

SEQ ID NO: 1306 - protein, 153 aa, Escherichia coli
MRRVAAIISALVICIIVCLSWAVNHYRDNAITYKALRDKNARELKLANAAITDMQMRQRDVAALDAKYTKELADAKAENDALRDDVAAGRRRLHIKAVCQSVREATTASGVDNAASPRLADTAERDYFTLRERLITMQKQLEGTQKYINEQCR

SEQ ID NO: 1307 - DNA, 342 bp, Escherichia coli
ttgttgtcacataggattctgccgtttttaacaatgcaggataataagatgaaaaaaatgttgttttctgccgctctggcaatgcttattacaggatgtgctcaacagacgtttactgttggaaacaaaccgacagcagtaacaccaaaggaaaccatcacccatcatttcttcgtttcgggaattgggcagaagaaaactgtcgatgcagcaaaaatttgtggtggtgcagaaaatgtggttaaaacagaaacccagcaaacattcgtaaatggattgctcggtttcatcacttttggcatttatactccgctggaagcgcgggtgtattgctcaaaataa

SEQ ID NO: 1308 - protein, 113 aa, Escherichia coli
MLSHRILPFLTMQDNKMKKMLFSAALAMLITGCAQQTFTVGNKPTAVTPKETITHHFFVSGIGQKKTVDAAKICGGAENVVKTETQQTFVNGLLGFITFGIYTPLEARVYCSK

SEQ ID NO: 1309 - DNA, 99 bp, Escherichia coli
atgattcgcgggtttatcccggtgcgatggtggaagaaacaggaagctgtattacagaaagtgctactactgtatcccgatgcgatgtatgtaatgtga

SEQ ID NO: 1310 - protein, 32 aa, Escherichia coli
MIRGFIPVRWWKKQEAVLQKVLLLYPDAMYVM

SEQ ID NO: 1311 - DNA, 228 bp, Escherichia coli
ccacgatatccggaatatgctgcagcaaattatatcaaggggctggttgaggttaagttcgatattggtgctgatgggactgtgacacggatcgtttttctccgctcagagcctcataatttgtttcgtgatgaagtggtgaaggccatggcgaaatggcgatttgaaaagaatcgcccctgtcagggagtgaagcgacaatttatctttacgccgtcacgtccctga

SEQ ID NO: 1312 - protein, 75 aa, Escherichia coli
PRYPEYAAANYIKGLVEVKFDIGADGTVTRIVFLRSEPHNLFRDEVVKAMAKWRFEKNRPCQGVKRQFIFTPSRP

SEQ ID NO: 1313 - DNA, 183 bp, Escherichia coli
atgctggcagttttccaactggtcaaaaatacctgctctcgtctgttgcaatgcctgcagcatgcggcggcaatgcgccttgcttttgctaaccatctttccttcctctatcagtcgctgcgtgaactcatcatggaataccaggtaaatgcggatgttatcggttttggctacgcagcatag

SEQ ID NO: 1314 - protein, 60 aa, Escherichia coli
MLAVFQLVKNTCSRLLQCLQHAAAMRLAFANHLSFLYQSLRELIMEYQVNADVIGFGYAA

SEQ ID NO: 1315 - DNA, 546 bp, Escherichia coli
atggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaagttgaagaactgcggcaggccagcgagacagatctccagccagggactattgagtacgaacgccaccgacttacgcgtgcgcaggccgacgcacaggagctgaaaaatgccagagactccgctgaagtggtggaaaccgcattctgtactttcgtgctgtcgcggatcgcaggtgaaattgccagtattctcgacgggatccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaa

SEQ ID NO: 1316 - protein, 181 aa, Escherichia coli
MEVNKKQLADIFGASIRTIQNWQEQGMPVLRGGGKGNEVLYDSAAVIKWYAERDAEIENEKLRREVEELRQASETDLQPGTIEYERHRLTRAQADAQELKNARDSAEVVETAFCTFVLSRIAGEIASILDGIPLSVQRRFPELENRHVDFLKRDIIKAMNKAAALDELIPGLLSEYIEQSG

SEQ ID NO: 1317 - DNA, 1926 bp, Escherichia coli
gtgaatatatcgaacagtcaggttaacaggctgcggcattttgtccgcgccgggcttcgctcactgttcaggccggagccacagaccgccgttgaatgggcggatgccagttactatctcccgaaagaatccgcataccaggaagggcgctgggaaacactgccctttcagcgggccatcatgaatgcgatgggcagcgactacatccgcgaggtgaatgtggtgaagtctgcccgtgttggttattccaaaatgctgttgggtgtttatgcctacttcatagagcataagcagcgcaacacacttatctggttgccgacggatggtgatgccgagaactttatgaaaacccacgttgagccgaccatccgtgatattccttcgctgctggcgctggccccgtggtatggcaaaaagcaccgggataacacgctcaccatgaagcgtttcaccaatgggcgtggcttctggtgcctgggcggtaaagcggcaaaaaactaccgtgaaaagtcagtggatgtggcgggttatgatgaacttgctgcctttgatgaggatattgaacaggaaggctctccgacgttcctgggcgataagcgtattgaaggctcggtctggccaaagtccatccgtggctccacgcccaaagtgagaggcacctgccagattgagcgtgcagccagtgaatccccgcattttatgcgttttcatgttgcctgcccgcactgcggggaggagcagtaccttaaatttggcgataaagagacgccgtttggcctcaaatggatgccggatgatccctccagcgtgttttatctctgtgagcataatgcctgcgtcatccgtcagcaggagctggactttactgatgcccgttatatctgcgaaaagaccgggatctggacccgtgatggcattctctggttttcgtcatccggtgaagagattgagccaccggacagtgtgacctttcacatctggacggcgtacagcccgttcaccacctgggttcagattgtcaaagactggatgaagacgaaaggggatacgggaaaacgtaaaactttcgtaaacaccacgctcggtgagacgtgggaggcgaaaatcggcgaacgtccggatgctgaagtgatggcagagcggaaagagcattattcagcgcccgttcctgaccgtgtggcttacctgaccgccggtatcgactcccagctggaccgctacgaaatgcgagtatggggatgggggccgggtgaggaaagctggctgattgaccggcagattattatgggccgccacgatgatgaacagacgctgctgcgtgtggatgaggccatcaataaaacctatacccgccggaatggtgcagaaatgtcggtatcccgtatctgctgggatactggcgggattgacccgaccattgtgtatgaacgctcgaaaaagcatgggctgttccgggtgatccccattaaaggggcatccgtctacggaaagccggtggccagcatgccacgtaagcgaaacaaaaacggggtttaccttaccgaaatcggtacggataccgcgaaagagcagatttataaccgcttcacactgacgccggaaggggatgaaccgcttcccggtgccgttcacttcccgaataacccggatatttttgatctgaccgaagcgcagcagctgactgctgaagagcaggtcgaaaaatggggggatggcaggaaaaaaatactgtgggacagcaaaaagcgacgcaatgaggcgctcgactgcttcgtttatgcgctggcggcgctgcgcatcagtatttcccgctggcagctggatctcagtgccctgctggtgagcctgcaggaagaggatagtgcaacaaccaacaagaaaacactggcagattacgcccgtgccttatccggagaggatgaatga

SEQ ID NO: 1318 - protein, 641 aa, Escherichia coli
MNISNSQVNRLRHFVRAGLRSLFRPEPQTAVEWADASYYLPKESAYQEGRWETLPFQRAIMNAMGSDYIREVNVVKSARVGYSKMLLGVYAYFIEHKQRNTLIWLPTDGDAENFMKTHVEPTIRDIPSLLALAPWYGKKHRDNTLTMKRFTNGRGFWCLGGKAAKNYREKSVDVAGYDELAAFDEDIEQEGSPTFLGDKRIEGSVWPKSIRGSTPKVRGTCQIERAASESPHFMRFHVACPHCGEEQYLKFGDKETPFGLKWMPDDPSSVFYLCEHNACVIRQQELDFTDARYICEKTGIWTRDGILWFSSSGEEIEPPDSVTFHIWTAYSPFTTWVQIVKDWMKTKGDTGKRKTFVNTTLGETWEAKIGERPDAEVMAERKEHYSAPVPDRVAYLTAGIDSQLDRYEMRVWGWGPGEESWLIDRQIIMGRHDDEQTLLRVDEAINKTYTRRNGAEMSVSRICWDTGGIDPTIVYERSKKHGLFRVIPIKGASVYGKPVASMPRKRNKNGVYLTEIGTDTAKEQIYNRFTLTPEGDEPLPGAVHFPNNPDIFDLTEAQQLTAEEQVEKWGDGRKKILWDSKKRRNEALDCFVYALAALRISISRWQLDLSALLVSLQEEDSATTNKKTLADYARALSGEDE

SEQ ID NO: 1319 - DNA, 207 bp, Escherichia coli
atgacgcgacaggaagaacttgccgctgcccgtgcggcactgcatgacctgatgacaggaaaacgggtggcaacggtacagaaagacggacggcgagtggagtttacgaccacttccgtgtctgacctgaaaaaatacattgctgagctggaagtgcagaccggcatgacacagcgacgcaggggacctgcaggattttatgtatga

SEQ ID NO: 1320 - protein, 68 aa, Escherichia coli
MTRQEELAAARAALHDLMTGKRVATVQKDGRRVEFTTTSVSDLKKYIAELEVQTGMTQRRRGPAGFYV

SEQ ID NO: 1321 - DNA, 1602 bp, Escherichia coli
atgaaaatgtccaccattcccacccttctggggccggacggcatgacatcgctgcgtgaatatgccggttatcacggcggtggcagcggatttggtgggcagttgcgggcgtggaacccatcgagtgaaagtgtggatgcagccctgctgcccaactttacccgtggcaatgcccgcgcagacgatctggtacgcaataacggctatgccgccaacgccatccagttgcatcaggatcatatcgtcgggtcttttttccgactcagtcatcgcccaagctggcgctatctgggcatcggggaggaagaagcccgtgccttttcccgcgaggttgaatcggcatggaaagagtttgccgaggatgactgctgctgcattgacgttgagcgaaaacgcacgtttaccatgatgattcgggaaggtgtggccatgcacgcctttaacggtgaactgttcgttcaggccacctgggataccagtccgtcgcggcttttccggacacagttccggatggtaagcccgaagcgcatcagcaacccgaacaataccggcgacagccggaactgccgtgccggtgtgcagattaatgacagcggtgcggcgctgggatattacgtcagcgaggacggctatcctggctggatgccgcagaaatggacatggataccccgtgagttacccggcgggcgcgcctcgttcattcacgtttttgaacccgtggaggacgggcagacccgcggtgcaaatgtgttttacagcgtgatggagcagatgaagatgctcgacacgctgcagaacacgcagctgcagagcgccattgtgaaggcgatgtatgccgccaccattgagagtgagctggatacgcagtcagcgatggattttattctgggcgcgaacagtcaggagcagcgggaaaggctgaccggctggattggtgaaattgccgcgtattacgccgcagcaccggtccggctgggaggcgcaaaagtgcctcacctgatgccgggggactcactgaacctgcagacggctcaggacacggataacggctactccgtgtttgagcagtcactgttgcggtatatcgctgccgggctgggtgtctcgtatgagcagctttcccggaattacgcccagatgagctactccacggcacgggccagtgcgaacgagtcgtgggcgtactttatggggcggcgaaaattcgtcgcatcccgtcaggcgagccagatgtttctgtgctggctggaagaggccatcgttcgccgcgtggtgacgttaccttcaaaagcgcgcttcagttttcaggaagcccgcagtgcctgggggaactgcgactggataggctccggtcgtatggccatcgatggtctgaaagaagttcaggaagcggtgatgctgatagaagccggactgagtacctacgagaaagagtgcgcaaaacgcggtgacgactatcaggaaatttttgcccagcaggtccgtgaaacgatggagcgccgtgcagccggtcttaaaccgcccgcctgggcggctgcggcatttgaatccgggctgcgacaatcaacagaggaggagaagagtgacagcagagctgcgtaa

SEQ ID NO: 1322 - protein, 533 aa, Escherichia coli
MKMSTIPTLLGPDGMTSLREYAGYHGGGSGFGGQLRAWNPSSESVDAALLPNFTRGNARADDLVRNNGYAANAIQLHQDHIVGSFFRLSHRPSWRYLGIGEEEARAFSREVESAWKEFAEDDCCCIDVERKRTFTMMIREGVAMHAFNGELFVQATWDTSPSRLFRTQFRMVSPKRISNPNNTGDSRNCRAGVQINDSGAALGYYVSEDGYPGWMPQKWTWIPRELPGGRASFIHVFEPVEDGQTRGANVFYSVMEQMKMLDTLQNTQLQSAIVKAMYAATIESELDTQSAMDFILGANSQEQRERLTGWIGEIAAYYAAAPVRLGGAKVPHLMPGDSLNLQTAQDTDNGYSVFEQSLLRYIAAGLGVSYEQLSRNYAQMSYSTARASANESWAYFMGRRKFVASRQASQMFLCWLEEAIVRRVVTLPSKARFSFQEARSAWGNCDWIGSGRMAIDGLKEVQEAVMLIEAGLSTYEKECAKRGDDYQEIFAQQVRETMERRAAGLKPPAWAAAAFESGLRQSTEEEKSDSRAA

SEQ ID NO: 1323 - DNA, 1320 bp, Escherichia coli
gtgacagcagagctgcgtaatctcccgcatattgccagcatggcttttaatgagccgctgatgcttgaacccgcctatgcgcgggttttcttttgtgcgcttgcaggccagcttgggatcagccgcctgacagatgcggtgtccggtgacagcctgactgccccggaggcacccgcgacgctggcgttatccggtgatgatgacggaccacgacaggcccgcagttatcaggtcatgaacggcatcgccgtgctgccggtgtccggcacgctggtcagccggacgcgggcgctgcagccgtattcggggatgaccggttacaacggcattatcgcccgtctgcaacaggctgccagcgacccgatggtggacggcattctgctcgatatggatacgccaggcgggatggtggcaggggcatttgactgcgctgacatcatcgcccgtgtgcgtgacataaagccggtatgggcgctggccaatgacatgaactgcagtgcagggcagctgcttgccagcgccgcctcccggcgtctggtcacgcagaccgcccggacaggctccatcggcgtcatgatggctcacagtaattacggtgctgcgctggagaaacagggcgtggaaatcacgctgatttacagcggcagccataaggtggatggcaacccctacagccatcttccggatgacgtccgggagacactgcagtcccggatggatgcaacccgccggatgtttgcgcagaaggtgtcggcatataccggcctgtccgtgcaggctgtgctggataccgaggctgcagtgtacagcggtcaggaggccattgatgccggactggctgatgaacttgtcaacagcaccgatgcgatcaccgttatgcgtgatgcactggatgcacgtaaatcccgtctctcaggagggcgaatgaccaaagagactcaatcaacaactgtttcagccactgcttcgcaggctgacgttactgacgtggtgccagcgacggagggcgaaaacgccagcgcggcgcagccggacgtgaacgcgcagatcaccgctgcggttgcggcagaaaacagccgcattatggggatcctcaactgtgaggaggctcacggacgcgaagaacaggctcgcgtgctggccgaaacccccggtatgaccgtggaaacggcccgccgcattctggccgcagcaccacagagtgcacaggcgcgcagtgacactgcgctggatcgtctgatgcagggggcaccggcaccgctggctgcaggtaacccggcatctgatgccgttaacgatttgctgaacacaccagtgtaa

SEQ ID NO: 1324 - protein, 439 aa, Escherichia coli
MTAELRNLPHIASMAFNEPLMLEPAYARVFFCALAGQLGISRLTDAVSGDSLTAPEAPATLALSGDDDGPRQARSYQVMNGIAVLPVSGTLVSRTRALQPYSGMTGYNGIIARLQQAASDPMVDGILLDMDTPGGMVAGAFDCADIIARVRDIKPVWALANDMNCSAGQLLASAASRRLVTQTARTGSIGVMMAHSNYGAALEKQGVEITLIYSGSHKVDGNPYSHLPDDVRETLQSRMDATRRMFAQKVSAYTGLSVQAVLDTEAAVYSGQEAIDAGLADELVNSTDAITVMRDALDARKSRLSGGRMTKETQSTTVSATASQADVTDVVPATEGENASAAQPDVNAQITAAVAAENSRIMGILNCEEAHGREEQARVLAETPGMTVETARRILAAAPQSAQARSDTALDRLMQGAPAPLAAGNPASDAVNDLLNTPV

SEQ ID NO: 1325 - DNA, 333 bp, Escherichia coli
atgacgagcaaagaaacctttacccattaccagccgctgggcaacagtgacccggctcataccgcaaccgcgcctggcggattgagtgcgaaagcgcctgcaatgaccccgctgatgcttgacaccgccacccgtaagctggttgcgtgggatggcaccaccgacggtgctgccgttggcattcttgcggttgctgctgaccagaccagcaccacactgacgttctacaagtccggcacgttccgttatgaggatgtgctctggccggaggctgccagcgacgagacgaaaaaacggaccgcgtttgccggaacggcaatcagcatcgtttaa

SEQ ID NO: 1326 - protein, 110 aa, Escherichia coli
MTSKETFTHYQPLGNSDPAHTATAPGGLSAKAPAMTPLMLDTATRKLVAWDGTTDGAAVGILAVAADQTSTTLTFYKSGTFRYEDVLWPEAASDETKKRTAFAGTAISIV

SEQ ID NO: 1327 - DNA, 1026 bp, Escherichia coli
atgtcgatgtacacaaccgcccagctgctggcggcaaatgagcagaaatttaagtttgatccgctgtttctgcgtctctttttccgtgagagctatcccttcaccacggagaaagtctatctctcacaaattccgggactggtaaacatggcgctgtacgtttcgccgattgtttccggtgaggttatccgttcccgtggcggctccacctctgaatttacgccgggatatgtcaagccgaagcatgaagtgaatccgcagatgaccctgcgtcgcctgccggatgaagatccgcagaatctggcggacccggcttaccgccgccgtcgcatcatcatgcagaacatgcgtgacgaagagctggccattgctcaggtcgaagagatgcaggccgtttctgccgtgcttaagggcaaatacaccatgaccggtgaagccttcgatccggttgaggtggatatgggccgcagtgcggcgaataacatcacgcagtccggcggcacggagtggagcaagcgtgacaagtccacgtatgacccgaccgacgatatcgaagcctacgcgctgaacgccagcggtgtggtgaatatcatcgtgtttgatccgaaaggctgggcgctgttccgttccttcaaagccgtcagggagaagctggatacccgtcgcggctctcattccgaactggagacagcggtaaaagacctgggtaaagcggtgtcctataaggggatgtatggcgatgtggccatcgtcgtgtattccggacagtacgtggaaaacggcgtcaaaaagaacttcctgccggacaacacgatggtgctgggtaacactcatgcacgcggtctgcgcacctatggctgcattcaggatgcggacgcacagcgcgaaggcattaacgcctctgcccgctacccgaaaaactgggtgaccaccggcgatccggcgcgtgagttcaccatgattcagtcagcaccgctgatgctgctggctgaccctgatgagttcgtgtccgtacaactggcgtaa

SEQ ID NO: 1328 - protein, 341 aa, Escherichia coli
MSMYTTAQLLAANEQKFKFDPLFLRLFFRESYPFTTEKVYLSQIPGLVNMALYVSPIVSGEVIRSRGGSTSEFTPGYVKPKHEVNPQMTLRRLPDEDPQNLADPAYRRRRIIMQNMRDEELAIAQVEEMQAVSAVLKGKYTMTGEAFDPVEVDMGRSAANNITQSGGTEWSKRDKSTYDPTDDIEAYALNASGVVNIIVFDPKGWALFRSFKAVREKLDTRRGSHSELETAVKDLGKAVSYKGMYGDVAIVVYSGQYVENGVKKNFLPDNTMVLGNTHARGLRTYGCIQDADAQREGINASARYPKNWVTTGDPAREFTMIQSAPLMLLADPDEFVSVQLA

SEQ ID NO: 1329 - DNA, 396 bp, Escherichia coli
atgacgaaagatgagctgattgcccgtctccgctcgctgggtgagcaactgaaccgtgatgtcagcctgacggggacgaaagaagaactggcactccgtgtggcagagctggaagaggagcttgatgacacggatgacgctgccggtcaggacacatctgtcaacccggaaaatgcgctgaccgggtatgaaaataacgtggtatcagcgcagccggataccgtgactgatacggctgctctggtcacggtcgtggcactggtgacgctgcatactgatgcacttcacgccacgcgggatgaacctgtggcatttgtgctgccgggaacggcgtttcgtgtctctgccggtgtggcagccgaaatgacagagcgcggcctggccagaatgcaataa

SEQ ID NO: 1330 - protein, 131 aa, Escherichia coli
MTKDELIARLRSLGEQLNRDVSLTGTKEELALRVAELEEELDDTDDAAGQDTSVNPENALTGYENNVVSAQPDTVTDTAALVTVVALVTLHTDALHATRDEPVAFVLPGTAFRVSAGVAAEMTERGLARMQ

SEQ ID NO: 1331 - DNA, 354 bp, Escherichia coli
gtggctgatttcgataacctgttcgatgctgccattgcccgcgccgatgaaacgatacgcgggtacatgggaacgtcagccaccatgacatccggtgagcagtccggtgctgtgatacgtggtgtttttgatgaccctgaaaatatcagctatgccggacagggcgtgcgcgttgaaggctccagcccgtccctgtttgtccggactgatgaggtgcggcagctgcggcgtggagacacgctgaccatcggtgaggaaaatttctgggtagaccgggtttcgccggatgatggcggaagctgtcatctctggcttgggcgtggcgtgccgcctgccgttaaccgtcgccgctga

SEQ ID NO: 1332 - protein, 117 aa, Escherichia coli
MADFDNLFDAAIARADETIRGYMGTSATMTSGEQSGAVIRGVFDDPENISYAGQGVRVEGSSPSLFVRTDEVRQLRRGDTLTIGEENFWVDRVSPDDGGSCHLWLGRGVPPAVNRRR

SEQ ID NO: 1333 - DNA, 579 bp, Escherichia coli
atggccataaaaggtcttgagcaggccgttgaaaacctcagccgtatcagcaaaacggcggtgcccggtgccgccgcaatggccattaaccgcgttgcttcatccgcgatatcgcagtctgcgtcacaggttgctcgtgagacaaaggtacgccggaaactggtaaaggaaagggccaggctgaaaagggccacggtcaaaaatccgcaggccagaatcaaagttaaccggggggatttgcccgtaatcaagctgggtaatgcgcgggttgtcctgtcccgccgcaggcgtcgtaaaaaggggcagcgttcatccctgaaaggtggcggcagcgtgcttgtggtgggtaaccgtcgtattcccggcgcgtttattcagcaactgaaaaacggccggtggcatgttatgcagcgtgtggccgggaaaaaccgttaccccattgatgtggtgaaaatcccgatggcggtgccgctgaccacggcgtttaaacagaatattgaacggatacggcgtgaacgtcttccgaaagagctgggctatgcgctgcagcatcaactgagaatggtaataaagcgatga

SEQ ID NO: 1334 - protein, 192 aa, Escherichia coli
MAIKGLEQAVENLSRISKTAVPGAAAMAINRVASSAISQSASQVARETKVRRKLVKERARLKRATVKNPQARIKVNRGDLPVIKLGNARVVLSRRRRRKKGQRSSLKGGGSVLVVGNRRIPGAFIQQLKNGRWHVMQRVAGKNRYPIDVVKIPMAVPLTTAFKQNIERIRRERLPKELGYALQHQLRMVIKR

SEQ ID NO: 1335 - DNA, 396 bp, Escherichia coli
atgaaacatactgaactccgtgcagccgtactggatgcactggagaagcatgacaccggggcgacgctttttgatggtcgccccgctgtttttgatgaggaagattttccggcaattgccgtttatctcaccggcgctgaatacacgggcgaagagctggacagcgatacctggcaggcggagctgcatattgaagttttcctgcctgctcaggtgccggattcagagctggattcgtggatggagtcccggatttatccggtgatgagcgatatcccggcactgtcagatttgatcaccagtatggtggccagcggctatgactaccggcgcgacgatgatgcgggcctgtggagttcagccgatctgacttatgtcattacctatgaaatgtga

SEQ ID NO: 1336 - protein, 131 aa, Escherichia coli
MKHTELRAAVLDALEKHDTGATLFDGRPAVFDEEDFPAIAVYLTGAEYTGEELDSDTWQAELHIEVFLPAQVPDSELDSWMESRIYPVMSDIPALSDLITSMVASGYDYRRDDDAGLWSSADLTYVITYEM

SEQ ID NO: 1337 - DNA, 741 bp, Escherichia coli
atgcctgtaccaaatcctgtaatgccggtgaaaggtgccgggaccaccctgtgggtttataaggggagcggtgacccttatgcgaacccgctttcagacgttgactggtcgcgtctggcaaaagttaaagacctgacgcccggcgaactgaccgctgagtcctatgacgacagctatctcgatgatgaagatgcagactggactgcgaccgggcaggggcagaaatctgccggagataccagcttcacgctggcgtggatgcccggagagcaggggcagcaggcgctgctggcgtggtttaatgaaggtgatacccgtgcctataaaatccgcttcccgaacggcacggtcgatgtgttccgtggctgggtcagcagtatcggtaaggcggtgacggcgaaggaagcgattacccgcacggtgaaggtcaccaatgtgggacgtccgtcgatggcagaagatcgcagcacggtgacggcgacgaccggcatgacggtgacacccgccagtgcttccgtagtgaaagggcagagcaccacgctgaccgtggcattccagccggatggcgcaaccgacaagagcttccgtgcggtgtctgcggataaaacaaaagccaccgtgtcggtcagtggtatgaccatcaccgtgaaaggtgttgctgcaggcaaggtcaacattccggtcgtatccggtaatggtgagtttgctgcggttgcagaaatcaacgtcaccgccagttaa

SEQ ID NO: 1338 - protein, 246 aa, Escherichia coli
MPVPNPVMPVKGAGTTLWVYKGSGDPYANPLSDVDWSRLAKVKDLTPGELTAESYDDSYLDDEDADWTATGQGQKSAGDTSFTLAWMPGEQGQQALLAWFNEGDTRAYKIRFPNGTVDVFRGWVSSIGKAVTAKEAITRTVKVTNVGRPSMAEDRSTVTATTGMTVTPASASVVKGQSTTLTVAFQPDGATDKSFRAVSADKTKATVSVSGMTITVKGVAAGKVNIPVVSGNGEFAAVAEINVTAS

SEQ ID NO: 1339 - DNA, 423 bp, Escherichia coli
atgttcctgaaaaccgaatcatttgaacataacggygtgaccgtcacgctttctgaactgtcagccctgcagcgtattgagcatctcgmcctgatgaaacrgcaggcagaacaggcggagtcagacagcaaccggmagkttactgtggaagacgccatcagaaccggygcktttstggtggcgatgtccctgtggcataaccatccgmagaagacaaagcwgccttccatgaatgaagccgttaaacagattgagcaggaagtgcttaccacctggcccrcggaggcaattkctcatgctgaaaacgtggtgtaccggctgtccggtatgtatgrgtttgtggtgaatgatgcycctgamcaggcagaggackccgggcctgcagagcctgtttctgcgggaaagtgttcgacggtgagctga

SEQ ID NO: 1340 - protein, 140 aa, Escherichia coli
  Xaa 30, 34, 46, 47, 59, 70, 74, 94, 98, 112, 120, 125: Xaa is any amino acid
MFLKTESFEHNGVTVTLSELSALQRIEHLXLMKXQAEQAESDSNRXXTVEDAIRTGAFXVAMSLWHNHPXKTKXPSMNEAVKQIEQEVLTTWPXEAIXHAENVVYRLSGMYXFVVNDAPXQAEDXGPAEPVSAGKCSTVS

SEQ ID NO: 1341 - DNA, 435 bp, Escherichia coli
gtgttcgacggtgagctgagttttgccctgaaactggcgcgagagatggggcgacctgactggcgcgccatgcttgccgggatgtcatccacggagtatgccgactggcaccgcttttacagtacccattattttcatgatgttctgctggatatgcacttttccgggctgacgtacacygtgctcagcctgtttttcagcgatccggatatgcatccgctggatttcagtytgctgaaccggcgygaggmtgacgaagagcctgaagatgatgtgctgatgcagaaagcggcagggcttrccggaggygtccgctttgrcccggacggraatgaagttatccccgcttccccggatrtggcggrcatgacggaggatgacgtaatgctgatgacagtatcagaagggatcgcaggaggagtccggtatggctga

SEQ ID NO: 1342 - protein, 144 aa, Escherichia coli
  Xaa 84, 101, 107, 120, 122: Xaa is any amino acid
MFDGELSFALKLAREMGRPDWRAMLAGMSSTEYADWHRFYSTHYFHDVLLDMHFSGLTYTVLSLFFSDPDMHPLDFSLLNRREXDEEPEDDVLMQKAAGLXGGVRFXPDGNEVIPASPDXAXMTEDDVMLMTVSEGIAGGVRYG

SEQ ID NO: 1343 - DNA, 1614 bp, Escherichia coli
atggctgaaccggtaggcgatctggtcgttgatttaagtctggatacggccagatttgacgagcagatggccagagtcaggcgtcatttttccggtacggaaagtgatgcgaaaaaaacagcggcagtcgttgaacagtcgctgagccgacaggcgctggctgcacagaaagcggggatttccgtcgggcagtataaagccgccatgcgtatgctgcctgcacagttcaccgacgtggccacgcagcttgcaggcgggcaaagtccgtggctgatcctgctgcaacagggtggtcaggttaaggactccttcggcgggatgatccccatgttcagggggcttgccggtgcgatcaccctgccgatggtgggggccacctcgctggcggtggcgaccggtgcgctggcgtatgcctggtatcagggcaactcaaccctgtccgatttcaacaaaacgctggtcctttccggcaatcagtcgggactgacggcagatcgtattctggccctgtccagagccgggcaggcggcagggctgacgtttaaccagaccagcgagtcactgacggcgctggtgaatgccggtgtgcgtggtggtgagcagtttgaggcgatcagccagagtgtggcgcgtttctcctctgcatccggcgtggaggtggacaaggtcgctgaagccttcgggaagctgaccacagacccgacgtcgggactgacagcgatggcacgtcagttccataacgtgacggcggagcagattgcgtatgttgctcagttgcagcgttccggagatgaagccggggcattgcaggcggcgaacgaggccgcaacgaaagggtttgatgaccagacccgccgcctgaaagagaacatgggcacgctggagacctgggcagacaggacagcacgggcattcaaatccatgtgggattcggtgctggatattggtcgcccggacactgcccagggaatgctggagaaagcagaaaaggcttttgatgaggcggacaaaaaatggcagtggtatcagagccggagccaccggcgcggtaaaacctcagcatttcttgccaatctccggggagcatgggaggacagagcgaatgcgcaacttggactttcagccgccacgttgcaggccgatcttgaaaaggccagagagatggcagcaaaggactgggccgagtctgaggcatcacggctgaaatataccgaagaggcgcagaaggcttacgaacgcctgcagacgccgctggagaaatataccgcccgtcaggaagaactgaataaggcactgaaagacgggaaaatcctgcaggcagattacaacacgctgatggcggcggcgaaaaaggattatgaagcgacgctgaaaaagctgaagcagtccggtgtgaaggtgtctgcgggcgatcgtcaggaagacagtgctcatgctgccctgctgacgcttcaggcagaactccggacgctggagaagcatgccggagcgaatgagaaaatcagccagcagcgccgggatttgtggaaggcagaaagtcagttcgcggtacttggaggaggcggcgcaacgtcgccagctgtctgcacaggagaaatccctgctggcgcataa

SEQ ID NO: 1344 - protein, 537 aa, Escherichia coli
MAEPVGDLVVDLSLDTARFDEQMARVRRHFSGTESDAKKTAAVVEQSLSRQALAAQKAGISVGQYKAAMRMLPAQFTDVATQLAGGQSPWLILLQQGGQVKDSFGGMIPMFRGLAGAITLPMVGATSLAVATGALAYAWYQGNSTLSDFNKTLVLSGNQSGLTADRILALSRAGQAAGLTFNQTSESLTALVNAGVRGGEQFEAISQSVARFSSASGVEVDKVAEAFGKLTTDPTSGLTAMARQFHNVTAEQIAYVAQLQRSGDEAGALQAANEAATKGFDDQTRRLKENMGTLETWADRTARAFKSMWDSVLDIGRPDTAQGMLEKAEKAFDEADKKWQWYQSRSHRRGKTSAFLANLRGAWEDRANAQLGLSAATLQADLEKAREMAAKDWAESEASRLKYTEEAQKAYERLQTPLEKYTARQEELNKALKDGKILQADYNTLMAAAKKDYEATLKKLKQSGVKVSAGDRQEDSAHAALLTLQAELRTLEKHAGANEKISQQRRDLWKAESQFAVLGGGGATSPAVCTGEIPAGA

SEQ ID NO: 1345 - DNA, 1029 bp, Escherichia coli
ttggaggaggcggcgcaacgtcgccagctgtctgcacaggagaaatccctgctggcgcataaagatgagacgctggagtacaaacgccagctggctgtacttggcgacaaggttacgtatcaggagcacctgaacgcgctggcgcagcaggcggataaattcgcacagcagcaacgggcaaaacgggccgctattgatgcgaaaaaccgggggctgactgaccggcaggcagaacgggaagccacggaacagcgcctgaaggaacagtatggcgataatcctctggcgctgaataacgtcatgtcagagcagaaaaagacctgggcggctgaagacctgcttcgcgggagctggatggcaggcctcaggtccggctggagcgagtgggaagagagcgccacggacagtatgtcgcaggttaaaagtgctgccacgcagacctttgatggtattgcgcagaatatggcggcgatgctgaccggcagtgaacagaactggcgcagcttcacccgttccgtgctgtccatgatgacagaaattctgcttaagcaggcaatggtggggattgtcgggagtatcggcagcgccattggcggggctgttggtggcggcgcatccgcgtcaggcggtacagccattcaggcagctgcggcgaaattccattttgcgaccgggggatttacgggaaccggcggcaaatatgagccagcggggattgttcaccgtggtgaatttgtcttcacgaaggaggcaaccagccggattggtgtcggcaacctgtaccgcctgatgcggggctatgcggaaggtggttatgtgggcggtgccggaagtccggcgcagatgcggcgggctgaaggcattaattttaatcagaacaatcacgtggtgattcagaacgacggtacgaatggtctgccaggtccacagatgatgaaggcggtgtatgacatggcccgcaagggtgcccgtgatgaaatccaggcacagatgcgcgatggtggtctgttctccggaggtggacgatga

SEQ ID NO: 1346 - protein, 342 aa, Escherichia coli
MEEAAQRRQLSAQEKSLLAHKDETLEYKRQLAVLGDKVTYQEHLNALAQQADKFAQQQRAKRAAIDAKNRGLTDRQAEREATEQRLKEQYGDNPLALNNVMSEQKKTWAAEDLLRGSWMAGLRSGWSEWEESATDSMSQVKSAATQTFDGIAQNMAAMLTGSEQNWRSFTRSVLSMMTEILLKQAMVGIVGSIGSAIGGAVGGGASASGGTAIQAAAAKFHFATGGFTGTGGKYEPAGIVHRGEFVFTKEATSRIGVGNLYRLMRGYAEGGYVGGAGSPAQMRRAEGINFNQNNHVVIQNDGTNGLPGPQMMKAVYDMARKGARDEIQAQMRDGGLFSGGGR

SEQ ID NO: 1347 - DNA, 699 bp, Escherichia coli
atgcaggatatccggcaggaaacactgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggaggcagtatcaggcgtatcccattcaggggagcggttttgaactgaatggcaaaggcaccagtacgcggcccacgctggcagtctctaacctgtacggcatggtcaccggtatggtggaagatatgcagagtctggtcggcggaacggtggtccggcgtaaggtttacgcccgttttctggatgcggtgaacttcgtcaacggaaacagagacgccgatccggagcaggaggtgatcagccgctggcgcatcgagcagtgcagcgaactgagcgcggtgagtgcctcctttgtactgtccacgccgacggaaacggatggcgctgtttttccggggcgtatcatgctggccaacacctgcacctggacctatcgcggtgatgagtgcggttatcacggtccggcagtcgcggatgaatatgaccagccgacgtccgatatcacgaaggataaatgcagcaaatgcctgagcggctgtaagtttcgcaataacgtcggcaactttggcggcttcctttccattaacaaactttcgcagtaa

SEQ ID NO: 1348 - protein, 232 aa, Escherichia coli
MQDIRQETLNECTRAEQSASVVLWEIDLTEVGGERYFFCNEQNEKGEPVTWQGRQYQAYPIQGSGFELNGKGTSTRPTLAVSNLYGMVTGMVEDMQSLVGGTVVRRKVYARFLDAVNFVNGNRDADPEQEVISRWRIEQCSELSAVSASFVLSTPTETDGAVFPGRIMLANTCTWTYRGDECGYHGPAVADEYDQPTSDITKDKCSKCLSGCKFRNNVGNFGGFLSINKLSQ

SEQ ID NO: 1349 - DNA, 786 bp, Escherichia coli
ttggcggcttcctttccattaacaaactttcgcagtaatcccatgacagagacagaatcagcgattctggcgcacgcccggcgatgtgcgccagcggagtcgtgcggcttcgtggtaagcacgccggagggggaaagatatttcccctgcgtgaatatctccggtgagccggaggcgtatttccggatggctccggaggactggctgcaggcagagatgcagggtgagattgtggcgctggtccacagccaccccggtggtctgccctggctgagtgaggctgaccggcggctgcaggtgcagagcgatttgccgtggtggctggtctgccggggggcgattcacaagttccgctgtgtgccgcatctcaccgggcggcgctttgagtacggggtgacagactgttacacactgttccgggatgcttaccatctggcggggattgagatgccggattttcatcgcggggatgactggtggcgtaacggtcagaatctctatcttgacaatatggaggcgactggtttttaccgtgtcgcactgacagaggcgcagccgggcgatgtgctgctgtgctgttttggttcatcggtgccgaatcacgccgccatttactgtggcgacggtgagctgctgcaccatattcctgaacaactgagtaaacgagagaggtataccgacaaatggcagcgacgcacacactccctctggcgtcaccgggcatggcacgcatctgcctttacggggatttacaacgatttggccgccgcatcgaccttcgtgtga

SEQ ID NO: 1350 - protein, 261 aa, Escherichia coli
MAASFPLTNFRSNPMTETESAILAHARRCAPAESCGFVVSTPEGERYFPCVNISGEPEAYFRMAPEDWLQAEMQGEIVALVHSHPGGLPWLSEADRRLQVQSDLPWWLVCRGAIHKFRCVPHLTGRRFEYGVTDCYTLFRDAYHLAGIEMPDFHRGDDWWRNGQNLYLDNMEATGFYRVALTEAQPGDVLLCCFGSSVPNHAAIYCGDGELLHHIPEQLSKRERYTDKWQRRTHSLWRHRAWHASAFTGIYNDLAAASTFV

SEQ ID NO: 1351 - DNA, 549 bp, Escherichia coli
gtgaaaacgggggctgaagccatccgggcgctggccacgcagcttccgtcgtttcgccagaaactgaatgagggctggtatcaggtgcgcattgccgggcgtgatgcaggcgaaaatgaattatctgcccgtcttaatgaaccgctggcaaatggtgccgtgattcacatcgtgccgcgtctggcgggagctaaaagtggcggtgtgtttcaggtggtgctgggggcggcgctgattgcggtggcatggtggaaccctgtgggctggctgggtgctgcggctgtatcgggcatgtatgcggcaggggccagtatgattctgggtggtgtggcccagatgctggcaccgaaagccaggacgcccacggcagccagtacagataacggcaaacagaacacctatttctcctcactggataacatggttgctcagggcaatgttctgcctgttctgtacggtgaaatgcgcgtggggtcgcgcgtggtttctcaggagatcagcacggcagacgaaggtgacggtggtcaggttgtggtgattggtcgctga

SEQ ID NO: 1352 - protein, 182 aa, Escherichia coli
MKTGAEAIRALATQLPSFRQKLNEGWYQVRIAGRDAGENELSARLNEPLANGAVIHIVPRLAGAKSGGVFQVVLGAALIAVAWWNPVGWLGAAAVSGMYAAGASMILGGVAQMLAPKARTPTAASTDNGKQNTYFSSLDNMVAQGNVLPVLYGEMRVGSRVVSQEISTADEGDGGQVVVIGR

SEQ ID NO: 1353 - DNA, 1653 bp, Escherichia coli
atgggtaaaggcagcagtaaggggcataccccgcgcgaagcgaaggacaacctgaagtccacgcagttgctgagtgtgatcgatgccatcagcgaagggccggttgaaggtccggtggatgggttaaaaagcgtgctgctgaacagtacgccggtgctggacagtgaggggaataccaatatctccggtgtcacggtggtgttccgggcaggtgagcaggagcagacaccgccggagggatttgaatcctccggctccgagacggtgctgggtacggaagtgaaatatgacacgccgatcacccgcaccattacgtcggcaaacatcgaccgtctgcgctttaccttcggtgtgcaggcactggtggaaaccacctcaaagggtgaccggaatccgtcggaagtccgcctgctggttcagatacagcgtaacggtggctgggtgacggaaaaagacatcaccattaagggcaaaaccacctcgcagtatctggcctcggtggtggtggataacctgccgccgcgcccgtttaatatccggatgcgcaggatgacgccggacagcaccacagaccagctgcagaacaaaacgctctggtcgtcatacaccgaaatcatcgatgtgaaacagtgctacccgaacacggcactggtcggcgtgcaggtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacgttcgtgcaggaccgaccgtcggataaggtgtggacctataaccgcagtaatgtggtgatgccggatgatggcgcgccgttccgctacagcttcagcgccctgaaggaccgccataatgccgttgaggtgaactggattgacccggataacggctgggagacggcgacagagcttgtggaggacacgcaggccattgcccgttacggtcgtaacgtcacgaagatggatgcctttggctgtaccagccgggggcaggcacaccgcgccgggctgtggctgattaaaacggaactgctggagacgcagaccgtggayttcagcgtgggtgctgaagggcttcgccatgtaccgggcgatgtcattgaaatctgygatgatgactatgcsggkakcagcaccggyggkcgygtgctggcggtgaacagccagacccggacgctgacgctcgaccgtgaaatcacgctgccatcctccggtaccacgctgataagyctggttgacggtmagtggyaatccggtcagcgtggaggtycagtccgtcaccgacggcgtgaaggtgaaagtgagccgtgttcctga

SEQ ID NO: 1354 - protein, 550 aa, Escherichia coli
  Xaa 489, 527, 529, 536: Xaa is any amino acid
MGKGSSKGHTPREAKDNLKSTQLLSVIDAISEGPVEGPVDGLKSVLLNSTPVLDSEGNTNISGVTVVFRAGEQEQTPPEGFESSGSETVLGTEVKYDTPITRTITSANIDRLRFTFGVQALVETTSKGDRNPSEVRLLVQIQRNGGWVTEKDITIKGKTTSQYLASVVVDNLPPRPFNIRMRRMTPDSTTDQLQNKTLWSSYTEIIDVKQCYPNTALVGVQVDSEQFGSQQVSRNYHLRGRILQVPSNYNPQTRQYSGIWDGTFKPAYSNNMAWCLWDMLTHPRYGMGKRLGAADVDKWALYVIGQNCDQSVPDGFGGTEPRITCNAWLTTQRKAWDVLSDFCSAMRCMPVWNGQTLTFVQDRPSDKVWTYNRSNVVMPDDGAPFRYSFSALKDRHNAVEVNWIDPDNGWETATELVEDTQAIARYGRNVTKMDAFGCTSRGQAHRAGLWLIKTELLETQTVDFSVGAEGLRHVPGDVIEICDDDYAGXSTGGRVLAVNSQTRTLTLDREITLPSSGTTLISLVDGXWXSGQRGGXVRHRRREGESEPCS

SEQ ID NO: 1355 - DNA, 1911 bp, Escherichia coli
ttgacggtmagtggyaatccggtcagcgtggaggtycagtccgtcaccgacggcgtgaaggtgaaagtgagccgtgttcctgacggcgttgcmgratacagcgtgtgggggctgaagctgccgacgctgcgccagcgcctgttccgctgcgtgagtatccgtgagaacgaygacggcacgtatgccatcacygccgtgcagcatgtrccggaraaagargccatcgtggataacggggcgcactttgacggygaccagagcggcacggtgaatggtgtcacgccgccagcagtgcagcayctgaccgccgaagtcactgcagacagcggggaatatcaggtgctggcgcgatgggacacaccgaaggtggtgaagggcgtgagcttcctgctccgtctgaccgtracagcggaygacggcagtgagcgrctgrtcagcacrgccmggacgacggaaaccacataccgcttcacrcaactggcgytggggaactacaggctgacagtccgggcggtaaatgcmyggggrcagcagggcgatccggcrtcggtatcgttccggattgccgcaccggcagcrccgtckmggattgagctgacrccgggctattttcagataaccgccacgccgcatcttgcggtttatgatccgacggtacagtttgagttctggttctcggaaaagcggattgcggatatcaggcaggttgaaaccacagcccgctatcttggtacggcgctgtactggatagccgccagtatcaatatcaaaccgggccatgattattacttttatatccgcagtgtgaacaccgtaggcaaatcggcatttgtggaggccgtcggtcgggcgagcgatgatgcatccggctatctggattttttcaaaggcgagatagggaaaacccatctggctcaggagctgtggacgcagattgataacggtcagcttgcgcctgacctggctgaaatcaggacgtccattacggatgtcagcaatgaaatcacgcagaccgtcaataagaaactggaagaccagagtgcggcaattcagcagatacagaaggttcaggttgatacaaataataacctgaacagcatgtgggctgtgaagctgcagcagatgcaggacggacgcctttatatcgcgggtattggtgccggtattgagaacacccctgacggcatgcagagtcaggtgctgctggcggcggacaggattgcgatggttaatcctgcgaatggcaacacaaaaccgatgtttgttggtcagggcgatcagatattcatgaacgacgtgttcctgaaacgcctgacggctcccaccattaccagcggtggaaatccaccggcattttccctgacaccggacgggcgactgacggcgaaaaatgcggatatcagtggcagtgtgaatgcgaacgccgggacgctcaacaatgtcacgattaatgaaaactgtcgggttctgggaaaactgtctgcgaaccagattgaaggcgatctcgttaaaacagtgggcaaagctttcccccgggactcccgtgcaccggagcggtggccatcagggaccattaccgtcagggtttatgacgatcagccgtttgaccggcagattgttattcccgcggtggcgtttcgtggcgctaaacatgagcgggagaataacgatatttattcgtcatgccgcctgatagtgaagaaaaacggtgctgaaatttataaccgtaccgcgctggataatacgctggtttatacaggtgttattgatatgcctgctggtcgcggtcacatgacgctggagttttcggtatcagcgtggctggtaaatgactggtatcccacagccagtatcagtgatttgctggttgtggtgatgaagaaatccacagcaggtatcacgattagctga

SEQ ID NO: 1356 - protein, 636 aa, Escherichia coli
  Xaa 32, 145, 175: Xaa is any amino acid
MTVSGNPVSVEVQSVTDGVKVKVSRVPDGVAXYSVWGLKLPTLRQRLFRCVSIRENDDGTYAITAVQHVPEKEAIVDNGAHFDGDQSGTVNGVTPPAVQHLTAEVTADSGEYQVLARWDTPKVVKGVSFLLRLTVTADDGSERLXSTARTTETTYRFTQLALGNYRLTVRAVNAXGQQGDPASVSFRIAAPAAPSRIELTPGYFQITATPHLAVYDPTVQFEFWFSEKRIADIRQVETTARYLGTALYWIAASINIKPGHDYYFYIRSVNTVGKSAFVEAVGRASDDASGYLDFFKGEIGKTHLAQELWTQIDNGQLAPDLAEIRTSITDVSNEITQTVNKKLEDQSAAIQQIQKVQVDTNNNLNSMWAVKLQQMQDGRLYIAGIGAGIENTPDGMQSQVLLAADRIAMVNPANGNTKPMFVGQGDQIFMNDVFLKRLTAPTITSGGNPPAFSLTPDGRLTAKNADISGSVNANAGTLNNVTINENCRVLGKLSANQIEGDLVKTVGKAFPRDSRAPERWPSGTITVRVYDDQPFDRQIVIPAVAFRGAKHERENNDIYSSCRLIVKKNGAEIYNRTALDNTLVYTGVIDMPAGRGHMTLEFSVSAWLVNDWYPTASISDLLVVVMKKSTAGITIS

SEQ ID NO: 1357 - DNA, 600 bp, Escherichia coli
atgcgtaaagtttgtgcagccattttgtccgcagccatctgtctggccgtatccggtgcgcctgcatgggcgtctgagcagcaggccacactgagcgcagggtatcttcatgcccgtacgaacgctcccggcagcgataatctgaacgggattaacgtgaaataccgttatgagtttacggacacgctggggctgattacgtcattcagttatgccaacgctgaagatgagcaaaaaacgcattacagcgatacccgctggcatgaggattccgtgcgtaaccgctggttcagcgtgatggcggggccgtctgtacgcgtgaatgaatggttcagcgcgtatgcgatggcaggcgtggcttacagccgtgtgtcgactttttccggggattatctccgcgtaactgacaacaagggaaaaacgcacgacgtgctgaccggaagtgatgacgctcgccacagtaacacctctctggcgtggggagctggcgtgcagtttaacccgaccgaatccgtggccgttgatgtcgcttatgaaggctccggcagtggcaactggcgcactgacgggttcatcgtgggtgtcggttataagttctga

SEQ ID NO: 1358 - protein, 199 aa, Escherichia coli
MRKVCAAILSAAICLAVSGAPAWASEQQATLSAGYLHARTNAPGSDNLNGINVKYRYEFTDTLGLITSFSYANAEDEQKTHYSDTRWHEDSVRNRWFSVMAGPSVRVNEWFSAYAMAGVAYSRVSTFSGDYLRVTDNKGKTHDVLTGSDDARHSNTSLAWGAGVQFNPTESVAVDVAYEGSGSGNWRTDGFIVGVGYKF

SEQ ID NO: 1359 - DNA, 285 bp, Escherichia coli
ttggcttcactgtctttggcattcgtctcactggttttcgctgccgtctggctggattttgcgtttttttcgctggcctttgtggctgtctcgctatttttcgcgctggtttctgattttttggctgctgtcgcggagtttgccgatgcagtctgcgaggccgctgccgcctgtgcgctgttagctgcattcgtttctgaggttttcgccgcattcttcgatgaggctgctgccgtttcggatttctttgccgccgctgcactctgtgatgacgctccggcatga

SEQ ID NO: 1360 - protein, 94 aa, Escherichia coli
MASLSLAFVSLVFAAVWLDFAFFSLAFVAVSLFFALVSDFLAAVAEFADAVCEAAAACALLAAFVSEVFAAFFDEAAAVSDFFAAAALCDDAPA

SEQ ID NO: 1361 - DNA, 2061 bp, Escherichia coli
atggcagtaaagatttcaggtgtactgaaagacggtgcaggtaaaccggtacagaactgcacaatccagctgaaagcaaaacgtaacagcaccacggtggtggtgaacacggtggcctcagaaaatccggatgaagccgggcgttacagcatggatgttgagtatggccagtacagcgtcaccctgctggttgaaggttttccaccttcacatgccgggaccattaccgtctatgaaggttccagaccaggtacgctgaatgattttctcggtgccatgacggaggatgatgcccgtccggaggcactgcgccgttttgagctgatggtgaatgaagtggcacgtcatgccggagcgtcatcacagagtgcagcggcggcaaagaaatccgaaacggcagcagcctcatcgaagaatgcggcgaaaacctcagaaacgaatgcagctaacagcgcacaggcggcagcggcctcgcagactgcatcggcaaactccgcgacagcagccaaaaaatcagaaaccagcgcgaaaaatagcgagacagccacaaaggccagcgaaaaaaacgcaaaatccagccagacggcagcgaaaaccagtgagacgaatgccaaagacagtgaagccaacgcaaaggtgagcgaaacagcggcggcgaactcggcgaaagcatcggcagcaagccagacggcagcaaaagcaagtgaagatgctgccagagaatacgcaaaccagacagcagagccgtacagatatgttttacagccgctgccggatgtgtggataccctttaatgattcgctggatatgattacgggctattctccgggttataaaaaagtgaagattggtgataatgtggttcaggttgccagtgataaacaggttaatttcagtcgcgcatcaacggcaacatatatcaacaaatctggcgaactgaaaacggcggaaattaatgagccacgatttgaaaaagaaggtttattgattgaaggtcagcgaaccaactacatgttgaattcaacaactccagcttcttggggtaaatctgcaaatatgaatgtcgctgaggttggaactgatagttttggttttacttatggaaagtttgtttgtaatgaatcattaattgggcaaagtacaacccttaatatggcagtagtttcaacctcgggggctgtcgatgtatcaggcgataataagtgtgtgacgacatcgtgcagatttaaaacggatttggaactcctgttaaggatcaggtttgaagccttcgatggcagcgcttcatctaatcttggatatgccattgttaatacgcggtctttattggttgaaatcaccggtgtagctgccgacaggctcaccgcacgagttaacaaagatgaagctacgggctggatttttgtagaggcaacgattcaagcaagtaaagaaacttacataacctctgcaatacaatacgcaccaaaaaaaggtggtgtcgttgaatctggtgactatatttatctggccacccctcaggttgaggatggttcgtgtgtatcatcttttattatatcaggaacgacggcggcgacgcgcgcaagcgatatggttacagttccgattaagaataatctttataatcttccttttacggttctttgtgaggtacataagaactggtataaaacgccaaatgcagcgccacgtgtttttgataccggcggtcatcaaaccggagcggctattattcttggcttcggatcttcggcagatgggccagacggatttccttattgcgatattggtggatcaaataggcgtgttaacgaaaacgcatcgttgaaaaaaatggttatggggatgcgtgtaaagtcagatcagtctacatgtgcagtaagtaacgggcgtatatccagcgaaacaaaaaccacatgggaatatatccggagtacagcaaccattcgcattggtggacaaactacagcaggattacgccatttatttgggcatgtgaggaattttcgtctctggcataaagagctaacagatgcgcagcttggggaggttgtggcgtga

SEQ ID NO: 1362 - protein, 686 aa, Escherichia coli
MAVKISGVLKDGAGKPVQNCTIQLKAKRNSTTVVVNTVASENPDEAGRYSMDVEYGQYSVTLLVEGFPPSHAGTITVYEGSRPGTLNDFLGAMTEDDARPEALRRFELMVNEVARHAGASSQSAAAAKKSETAAASSKNAAKTSETNAANSAQAAAASQTASANSATAAKKSETSAKNSETATKASEKNAKSSQTAAKTSETNAKDSEANAKVSETAAANSAKASAASQTAAKASEDAAREYANQTAEPYRYVLQPLPDVWIPFNDSLDMITGYSPGYKKVKIGDNVVQVASDKQVNFSRASTATYINKSGELKTAEINEPRFEKEGLLIEGQRTNYMLNSTTPASWGKSANMNVAEVGTDSFGFTYGKFVCNESLIGQSTTLNMAVVSTSGAVDVSGDNKCVTTSCRFKTDLELLLRIRFEAFDGSASSNLGYAIVNTRSLLVEITGVAADRLTARVNKDEATGWIFVEATIQASKETYITSAIQYAPKKGGVVESGDYIYLATPQVEDGSCVSSFIISGTTAATRASDMVTVPIKNNLYNLPFTVLCEVHKNWYKTPNAAPRVFDTGGHQTGAAIILGFGSSADGPDGFPYCDIGGSNRRVNENASLKKMVMGMRVKSDQSTCAVSNGRISSETKTTWEYIRSTATIRIGGQTTAGLRHLFGHVRNFRLWHKELTDAQLGEVVA

SEQ ID NO: 1363 - DNA, 279 bp, Escherichia coli
gtgagagatttcacgttgcgtttcagtgataaagcagatttcagggcatttctcaggaaacttaactgggaagaggacgaagagctgcagaatgccgttctggttgatgagattggttttacgttcagggagacagatgtttctgatgacggagaaccagaatacacgcgaaacgaagggtactttgttaatatccgtcttcttgacgatggatttgatgattccgtgttccgtgagtgggtggttacaccagagcgcccgctcagggagtggttttaa

SEQ ID NO: 1364 - protein, 92 aa, Escherichia coli
MRDFTLRFSDKADFRAFLRKLNWEEDEELQNAVLVDEIGFTFRETDVSDDGEPEYTRNEGYFVNIRLLDDGFDDSVFREWVVTPERPLREWF

SEQ ID NO: 1365 - DNA, 294 bp, Escherichia coli
atggatatcacgtcgatacttcatgcgctttgtgccgtggcggtgcaggtactggctggtctttttaccggaaactgggcttacggggcgatagccggttgtacgttcttcattgcgcgtgaacacacccaggcagaatatcgctggattgaaatgttcgggcatggcaagcggattaacatgccgtggtggggcggttttgatccacgtgcatgggatgtggcaagcctgatggattttgctgtgccggtggtggcgtgtctgctggtctggctgttggttaatcgtgggtga

SEQ ID NO: 1366 - protein, 97 aa, Escherichia coli
MDITSILHALCAVAVQVLAGLFTGNWAYGAIAGCTFFIAREHTQAEYRWIEMFGHGKRINMPWWGGFDPRAWDVASLMDFAVPVVACLLVWLLVNRG

SEQ ID NO: 1367 - DNA, 306 bp, Escherichia coli
atgctgccgcagcatagcgatattgaaatagcctggtatgcttcgatacagcaggagccgaatggctggaagaccgtcactacacagttctacatccaggaattcagtgagtatattgcgccactgcaggatgctgtagatctggaaatcgcaacggaggaagaaagatcgttgctggaggcatggaataaatatcgggtattgttgaatcgtgttgatacatcagtagctctgggtatgaagctgtttgtaactcatgttacagtaacagccattactatctcgaaggtgcaaaatgtatattga

SEQ ID NO: 1368 - protein, 101 aa, Escherichia coli
MLPQHSDIEIAWYASIQQEPNGWKTVTTQFYIQEFSEYIAPLQDAVDLEIATEEERSLLEAWNKYRVLLNRVDTSVALGMKLFVTHVTVTAITISKVQNVY

SEQ ID NO: 1369 - DNA, 1485 bp, Escherichia coli
atgcgaaaaataattactcatttcaaagttgttttaacgttacttctaccagtaaccgtatctgcccagcagatacagtggcaatcctgtatggccagtcaattcaaccactggtttggtgaggaaaaaccgtctcctgacttactatgtggttatttgtctgttccattaaaatatacagacacaggcggagatgcttcttatgaaaaaaaatcacaagtcaaactagcgttgacaaaattgccggcaaaaagcaagcataaaggaagtatcctgataataagtggtggtcccgggttaccaggcataaatccttatattaactttgactggccagtcacaaatcttcgtgagtcatgggatattattggatttgatcctcgaggcgtcggacagtccactccgacaataaactgccggcaatcagatacagagactcaggaaaacataaccgaaaagcaacaagtattaaataaaattaatgcctgtatccataataccggagccgaagtcattcgccatatcggctctaacgaggctgtatacgatattgatcgtattaggcaagccttgggggataaacaactgacagccgtggcgtattcgtatggaactcaaattgcagccttatatgcagaacgttttccctacaacgtaagatctatcgttcttgatggagtcgtcgatatcgatgacctggaggacaacttcacatggcaactcaaacaggcacagagttatcaggaaacgtttgatcgctttgcatcctggtgtgcgcgtacaaaaagttgcccgctttcttcagacagagataaggcaataactcagttccatgagctattatcaaaattacatcacaaacctttattagacagtaagggagaaaatatatcttcagatgaactcatatcattaacaacagaccttctgctatggcgttcatcatggccaacccttgcaactgccatacgccagttctctcaggggattgtcagtaatgaaattgaaactgcgctcagtgctccgatagcctcagaagagtcaagcaatgcttcgggggtaatcctctgtgtagatcagggggatgagcaattaacaccagaagagcgaaaatcccgaaaagacgctcttgcgaatgccttcccggctattaactttgacaatggacgttccgattcacctgatttttgtgaattatggccaatacatagcgacctgaacaaaactcgcctgaaaaatactgttctgccctctggtttactgtttgtagcacacaaatacgacccaacaacgccctggattaatgcccgtaagatggcagagaaattttccagcccgttactaacaataaatggtgatgggcatacattagctctcaccggagttaatttatgtgtagataaagcagttgtacatcacctgatcactccacaaaaaccagaaaatatatactgcccaggaaattctgaagcagaaatacaataa

SEQ ID NO: 1370 - protein, 494 aa, Escherichia coli
MRKIITHFKVVLTLLLPVTVSAQQIQWQSCMASQFNHWFGEEKPSPDLLCGYLSVPLKYTDTGGDASYEKKSQVKLALTKLPAKSKHKGSILIISGGPGLPGINPYINFDWPVTNLRESWDIIGFDPRGVGQSTPTINCRQSDTETQENITEKQQVLNKINACIHNTGAEVIRHIGSNEAVYDIDRIRQALGDKQLTAVAYSYGTQIAALYAERFPYNVRSIVLDGVVDIDDLEDNFTWQLKQAQSYQETFDRFASWCARTKSCPLSSDRDKAITQFHELLSKLHHKPLLDSKGENISSDELISLTTDLLLWRSSWPTLATAIRQFSQGIVSNEIETALSAPIASEESSNASGVILCVDQGDEQLTPEERKSRKDALANAFPAINFDNGRSDSPDFCELWPIHSDLNKTRLKNTVLPSGLLFVAHKYDPTTPWINARKMAEKFSSPLLTINGDGHTLALTGVNLCVDKAVVHHLITPQKPENIYCPGNSEAEIQ

SEQ ID NO: 1371 - DNA, 954 bp, Escherichia coli
atgcgggcaaaacttctgggaatagttctgacaacccctattgcgatcagctcttttgcttctaccgagactatatcgtttactcctgacaacataaatgcggacattagtcttggaactctgagcggaaaaacaaaagagcgcgtttatctagctgaagaaggaggccgaaaagtcagtcaactcgactggaaattcaataacgctgcaattattaaaggtgcaattaattgggatttgatgccccagatatctattggggctgcgggctggactactctcgacagccgaggtggcaatatggtcgatcaggactggatggattccagtaaccccggaacctggacagatgaaagtaggcaccctgatacacaactcaattatgccaacgaatttgatctgaatatcaaaggctggctcctcaacgaacccaattaccgcctgggactcatggccggatatcaggaaagccgttatagctttacagccagaggtggttcctatatctacagttctgaggagggattcagagatgatatcggctccttcccgaatggagaaagagcaatcggctacaaacaacgttttaaaatgccctacattggcttgactggaagttatcgttatgaagattttgagctaggtggcacatttaaatacagcggctgggtggaagcatctgataacgatgagcactatgacccaggaaaaagaatcacttatcgcagtaaagtcaaagaccaaaattactattctgttgcagtcaatgcaggttattacgtaacacctaacgcaaaggtttatgttgaaggcgcatggaatcgggttacgaataaaaaaggtaatacttcactttatgatcacaatgataacacttcagactacagcaaaaatggtgcaggcatagaaaactataacttcatcactactgctggtcttaagtacaccttttaa

SEQ ID NO: 1372 - protein, 317 aa, Escherichia coli
MRAKLLGIVLTTPIAISSFASTETISFTPDNINADISLGTLSGKTKERVYLAEEGGRKVSQLDWKFNNAAIIKGAINWDLMPQISIGAAGWTTLDSRGGNMVDQDWMDSSNPGTWTDESRHPDTQLNYANEFDLNIKGWLLNEPNYRLGLMAGYQESRYSFTARGGSYIYSSEEGFRDDIGSFPNGERAIGYKQRFKMPYIGLTGSYRYEDFELGGTFKYSGWVEASDNDEHYDPGKRITYRSKVKDQNYYSVAVNAGYYVTPNAKVYVEGAWNRVTNKKGNTSLYDHNDNTSDYSKNGAGIENYNFITTAGLKYTF

SEQ ID NO: 1373 - DNA, 378 bp, Escherichia coli
atcaaacaggcaagcatcacaaatgtgggtgtacataccagggcggctaagcgagcagatggaacatcaatgcctgcgctcaggaagatgcgcattgacagcaagacagcatggctatcagcttgtcgtcgtgcaggagttgaaaatttccgtttccatgacctctggcatacccgggcaagcaggttgattccgtcaggcgtcccattatcagtgcttcaggaaatgggcggatgggagtccagagaaatggttcgtagatatgctcaccttgcgcctaatcatttgactgagcacgcgaggaaaatagacgacatttttggtgataatgtcccactctggaattatagaagaaataaagaaggcgtaactgattga

SEQ ID NO: 1374 - protein, 125 aa, Escherichia coli
IKQASITNVGVHTRAAKRADGTSMPALRKMRIDSKTAWLSACRRAGVENFRFHDLWHTRASRLIPSGVPLSVLQEMGGWESREMVRRYAHLAPNHLTEHARKIDDIFGDNVPLWNYRRNKEGVTD

SEQ ID NO: 1375 - DNA, 357 bp, Escherichia coli
ttgcctgcaaacagtactgatattgcaccgccagatattccggctggcttcgtggttgttttcaacagtgatgaggcatcgtggcatctcgttgaagaccatcggggtaaaacggtttatgacgtggcatcaggggacgcgttatttatttctgagctcggtccgttaccggaaaatgttacctggttatccccggcaggggagtttcagaagtggaacggcacatcatggataaaggatacggaggaagaaacctcgttgctggaagcctgtaagatgtatcgggtgttgctgaaccgagttgatacatcaactgcccctgatattgagtggcctgtgaaccctgtcagagagtaa

SEQ ID NO: 1376 - protein, 118 aa, Escherichia coli
MPANSTDIAPPDIPAGFVVVFNSDEASWHLVEDHRGKTVYDVASGDALFISELGPLPENVTWLSPAGEFQKWNGTSWIKDTEEETSLLEACKMYRVLLNRVDTSTAPDIEWPVNPVRE

SEQ ID NO: 1377 - DNA, 954 bp, Escherichia coli
atgcgggcgaaacttctgggaatagtcctgacaccccctattgcgatcagctcttttgcttctaccgagactttatcgtttactcctgacaacataaatgcggacattagtcttggaactctgagcggaaaaacaaaagagcgtgtttatctagccgaagaaggaggccgaaaagtcagtcaacttgactggaaattcaataacgctgcaattattaaaggtgcaattaattgggatttgatgccccagatatctatcggggctgctggctggacaacactcggcagccgaggtggcaatatggtcgatcaggactggatggattccagtaaccccggaacctggacggatgaaagtagacaccctgatacacaactcaattatgccaacgaatttgatctgaatatcaaaggctggctcctcaacgaacccaattaccgcctgggactcatggccggatatcaggaaagccgttatagctttacagccagaggtggttcctatatctacagttctgaggagggattcagagatgatatcggctccttcccgaatggagaaagagcaatcggctacaaacaacgttttaaaattccctacattggcttgactggaagttatcgttatgaagattttgagctaggtggcacatttaaatacagcggctgggtggaagcatctgataacgatgagcactatgacccaggaaaaagaatcacttatcgcagtaaagtcaaagaccaaaattactattctgttgcagtcaatgcaggttattacgtaacacctaacgcaaaagtttatgttgaaggcgcatggaatcgggttacgaataaaaaaggtaatacttcactttatgatcacaatgataacacttctgactacagcaaaaatggtgcaggcatagaaaactataacttcatcactactgctggtcttaagtacaccttttaa

SEQ ID NO: 1378 - protein, 317 aa, Escherichia coli
MRAKLLGIVLTPPIAISSFASTETLSFTPDNINADISLGTLSGKTKERVYLAEEGGRKVSQLDWKFNNAAIIKGAINWDLMPQISIGAAGWTTLGSRGGNMVDQDWMDSSNPGTWTDESRHPDTQLNYANEFDLNIKGWLLNEPNYRLGLMAGYQESRYSFTARGGSYIYSSEEGFRDDIGSFPNGERAIGYKQRFKIPYIGLTGSYRYEDFELGGTFKYSGWVEASDNDEHYDPGKRITYRSKVKDQNYYSVAVNAGYYVTPNAKVYVEGAWNRVTNKKGNTSLYDHNDNTSDYSKNGAGIENYNFITTAGLKYTF

SEQ ID NO: 1379 - DNA, 891 bp, Escherichia coli
atgcgtaagttcattttcgtattgctgacactgcttttggtcagccctttttcctttgcgatgaaaggtattatctggcaaccacaaaaccgtgatagtcaggttaccgatacccagtggcaggggctgatgagtcagttacgtttgcaaggcttcgataccctggttttgcaatggacccgttacggcgatgcattcacccagccagaacagcgcgcgttattgtttaagcgtgccgcagctgcgcaacaggctggcctgaagctgattgtcgggctgaacgccgatccggaattttttatgcaccagaaacagtcgtccgcagcgctggaaagctatcttaatcgcctgctggctgccgatctccagcaagccagattatggagcgccgtgcctggcgtaacgccggatggctggtacatcagcgcggaaattgacgacctgaactggtgcagcgaagccgcccgtcagcctttgctaacatggttaaacaacgcgcagcggttgattagcgatgtttcagcaaaaccggtttatatcagtagttttttcgccggaaacatgtcgccagatggctatcgccaactgctggaacaagttaaagcaaccggtgttaatgtctgggtacaggatggcagcggcgtggataaactgaccgctgaacagcgtgaacgttatctacaggccagcgccgattgccaaagttccgccccagcaagcggcattgtttatgaactgtttgtcgctggtaaaggtaaaacgtttacagcgaaaccgaaaccggatgcagagatcgcctcgctgttagcgaaacgttcctcttgcggtaaagacacgctctatttctctctgcgctatttgcccgtcgcgcagagtatccttgagtattaa

SEQ ID NO: 1380 - protein, 296 aa, Escherichia coli
MRKFIFVLLTLLLVSPFSFAMKGIIWQPQNRDSQVTDTQWQGLMSQLRLQGFDTLVLQWTRYGDAFTQPEQRALLFKRAAAAQQAGLKLIVGLNADPEFFMHQKQSSAALESYLNRLLAADLQQARLWSAVPGVTPDGWYISAEIDDLNWCSEAARQPLLTWLNNAQRLISDVSAKPVYISSFFAGNMSPDGYRQLLEQVKATGVNVWVQDGSGVDKLTAEQRERYLQASADCQSSAPASGIVYELFVAGKGKTFTAKPKPDAEIASLLAKRSSCGKDTLYFSLRYLPVAQSILEY

SEQ ID NO: 1381 - DNA, 2973 bp, Escherichia coli
atgaaggagaataaccttaatcgcgtcatcggatggtctggtttactgctgacatctttattgagtaccagcgcactcgcagacaatatcggcaccagcgcagaagagctggggctgagcgattatcgccattttgttatttatccccgtctcgataaggcgctgaaggcacagaaaaataacgacgaagcaaccgccatccgcgaatttgaatatatacaccagcaggtgccggataatattccgctgactttataccttgcggaagcctatcgccattttggtcatgatgaccgggcgcggctgttgcttgaggatcaactgaaacgtcaccctggagatgaccggcttgagcgcagtctggtggctattccagttgaagtgaaaagcgttacgactgttgaagaactgcttgcccagcaaaaagcgtgcgatgctgcgccgaccctgcgttgtcgcagtgaagtcgggcagaatgccctgcggctggcacaattacctgtcgccagagcgcaactaaacgatgcgacgtttgctgcatcgccggaaggaaaaacgttgcgaaccgatctgctgcaacgggcaatctacctgaaacaatggtcccaggcagatacgctatataatgaagcacgccagcagaacacattaagtgcggcagaacgccgtcagtggtttgacgtgcttcttgccgcgcagctggatgatcggatcctggcgctgcaatcacaggggatcttcaccgatcctcagtcatatattacttacgcgaccgcgctggcttatcgtggcgaaaaagcacgcctccagcattatctcattgaaaatacgccgctatttaccacggacgcacaagagaaaagttggctctatctgttatctaaatacagcggcaaccccgttcaggcgttggcgaattatacggtacagtttgccgacaaccgccagtatgttgttggcgcgacgctaccggtgctgttaaaagaaggtcagtacggcgcagcgcaaaaactgctcgccaccctccccgccaatgaaatgcttgaggagcgttatgccgttagcgtagcgacccgtaacaaggctgaagctctgcgtctggcacgattgctgtatcagcaagaaccggcaaatcttacccgcctggatcaactgacctggcaactgatgcagaacgaacagtcacgcgaagctgccgatttattgctgcaacgctatcctttccagggcgatgcgcgtgtcagccagacgttaatggcgcgactggcgtctctgctggaaagtcatccttacctggcaacgccggcgaaggtggcgattttatcgaaacccttaccgctggcggagcaacgtcagtggcaaagtcagttgccgggtattgcagataattgcccggcaatagttcgcttgctgggcgatatgtcgccttcctacgatgccgccgcctggaaccgtctggcaaagtgttatcgggacacgctacccggtgtggcgttgtatgcatggcttcaggccgaacaacgacaaccggacgcctggcaacatcgtgcggtagcctatcaggcgtatcaggttgaggactacgccaccgcactggcggcctggcagaaaatcagtcttcacgacatgagcaatgaggatctgcttgctgctgccaataccgcccaggcggcaggaaatggtgcggctcgcgatcgctggcttcagcaggcagaacaacgtgggctgggaaacaatgccctctactggtggctgcatgcgcaacgttacattcctggtcagccggaactcgcactgaacgatctcacgcgctcaatcaatattgcgccttctgccaacgcttacgttgcgcgggcgacaatttatcgccaacgtcataatgtcccggcggcggtgagtgatttgcgcgccgcgctggaactggaaccgaataatagcaacacccaggcagcgctcggttacgccttgtgggatagcggtgatatcgcacagtcgcgggaaatgctcgaacaggcgcataaagggctaccggacgatccggcacttatccgacaactggcctacgtgaaccagcgtctggatgacatgcctgcgacgcagcactacgcccggctggtgattgatgacattgataatcaggcgctgataaccccactgaccccagagcaaaatcagcaacgcttcaatttccgccgtctgcatgaggaggtcggtcgccgctggacgttcagtttcgattcttctatcggcttgcgttccggcgcaatgagtaccgctaacaataatgtcggcggcgcagcgccagggaaaagctatcgtagctacgggcaactggaagccgagtaccgcctcggacgcaatatgctgctggaaggcgacctgctctcagtttatagccgcgtctttgccgataccggagaaaacggggtgatgatgccggtgaaaaatccgatgtccggcaccggtctgcgctggaagccgctgcgcgatcagatctttttcctcgccgtcgaacagcagttgccgctgaacgggcaaaatggcgcatccgataccatgctgcgcgccagcgcctcattctttaatggcggcaaatacagcgacgaatggcacccgaacggttcaggctggtttgcccaaaacctgtacctcgatgcggcgcaatatgtccgccaggatattcaggcgtggacggcagattatcgcgtaagctggcatcagaaggtggcgaacggacagactattgagccttatgctcaccttcaggacaacggttatcgtgataaaggcactcagggcgcgcagcttggcggtgtcggggtccgctggaatatctggaccggcgagacgcactacgacgcctggccgcacaaagtcagtctcggcgtcgaatatcaacatacctttaaggcgattaatcaacgtaacggagagcgcaacaacgcgtttctcaccattggagtgcactggtaa

SEQ ID NO: 1382 - protein, 990 aa, Escherichia coli
MKENNLNRVIGWSGLLLTSLLSTSALADNIGTSAEELGLSDYRHFVIYPRLDKALKAQKNNDEATAIREFEYIHQQVPDNIPLTLYLAEAYRHFGHDDRARLLLEDQLKRHPGDDRLERSLVAIPVEVKSVTTVEELLAQQKACDAAPTLRCRSEVGQNALRLAQLPVARAQLNDATFAASPEGKTLRTDLLQRAIYLKQWSQADTLYNEARQQNTLSAAERRQWFDVLLAAQLDDRILALQSQGIFTDPQSYITYATALAYRGEKARLQHYLIENTPLFTTDAQEKSWLYLLSKYSGNPVQALANYTVQFADNRQYVVGATLPVLLKEGQYGAAQKLLATLPANEMLEERYAVSVATRNKAEALRLARLLYQQEPANLTRLDQLTWQLMQNEQSREAADLLLQRYPFQGDARVSQTLMARLASLLESHPYLATPAKVAILSKPLPLAEQRQWQSQLPGIADNCPAIVRLLGDMSPSYDAAAWNRLAKCYRDTLPGVALYAWLQAEQRQPDAWQHRAVAYQAYQVEDYATALAAWQKISLHDMSNEDLLAAANTAQAAGNGAARDRWLQQAEQRGLGNNALYWWLHAQRYIPGQPELALNDLTRSINIAPSANAYVARATIYRQRHNVPAAVSDLRAALELEPNNSNTQAALGYALWDSGDIAQSREMLEQAHKGLPDDPALIRQLAYVNQRLDDMPATQHYARLVIDDIDNQALITPLTPEQNQQRFNFRRLHEEVGRRWTFSFDSSIGLRSGAMSTANNNVGGAAPGKSYRSYGQLEAEYRLGRNMLLEGDLLSVYSRVFADTGENGVMMPVKNPMSGTGLRWKPLRDQIFFLAVEQQLPLNGQNGASDTMLRASASFFNGGKYSDEWHPNGSGWFAQNLYLDAAQYVRQDIQAWTADYRVSWHQKVANGQTIEPYAHLQDNGYRDKGTQGAQLGGVGVRWNIWTGETHYDAWPHKVSLGVEYQHTFKAINQRNGERNNAFLTIGVHW

SEQ ID NO: 1383 - DNA, 2238 bp, Escherichia coli
gtggactggcttcttgatgtttttgctacctggctctacggcttaaaagtaatcgcgataacgttagcggtcattatgttcatcagcgggctggacgatttttttattgatgtcgtctactgggtacgccgcattaaacgcaagttgagtgtttatcgccgctacccgcgaatgagttaccgcgaactgtataaaccagatgaaaaaccgttagcgattatggttccggcgtggaatgaaacgggcgtcatcggcaatatggccgagctggcggcgaccacgctcgactacgaaaactatcatatctttgttggcacctaccccaacgaccccgatactcagcgtgatgttgacgaagtgtgcgctcgcttcccgaacgtgcataaggtagtctgcgcgcgtcctggccccaccagcaaagccgactgtctgaacaacgtgctggacgccatcacccagtttgaacgtagcgccaatttcgcttttgctggttttattctgcatgacgccgaagatgtgatttcaccgatggaattgcgtctgttcaactatctggtcgagcgtaaagatctgattcagatcccagtgtatccgttcgaacgcgaatggacgcacttcaccagcatgacctacattgatgagttttcagaactgcatggcaaagatgttccggtgcgtgaagccctcgccggacaggtgcccagcgcaggcgtcggcacctgtttcagccgccgcgccgtgaccgcactgttagctgacggtgacggtattgctttcgacgtgcagagtctgactgaagattacgacattggcttccgcctgaaagagaaaggtatgacggaaatttttgtccgttttccggtggtggacgaagccaaagaacgcgagcagcgtaaatttttacagcatgcacggacgtcaaacatgatctgcgtgcgcgaatatttccccgataccttttcgactgcggttcggcaaaaatctcgctggatcatcggcattgttttccagggctttaaaacccacaaatggacctccagcctgacgctgaactactttctctggcgcgaccgcaaaggggcaatcagtaactttgtcagcttcctcgcgatgctggtgatgatccagcttttgctgttgctggcgtatgaaagtttgtggcccgatgcctggcatttcctttctattttcagcggcagcgcatggttaatgactctgctgtggctaaactttggcttgatgattaaccgcatcgtgcagcgggtgattttcgttactggctactacggcctgacgcaggggctgctatctgtcctgcgtcttttctggggcaacctgattaacttcatggccaactggcgcgcgttaaaacaggtacttcaacacggcgatccacgtcgcgtcgcgtgggataaaacaacgcatgacttccccagcgtgactggcgatacccgctcgttgcgtccgttaggtcaaatcctgctggaaaatcaggtcatcactgaagaacaactcgatgcagcactgcgtaatcgcgtcgaaggtctacgcctgggcggttcaatgctgatgcaggggctgattagcgccgagcaactggcacaggcgctggcagagcaaaacggcgtggcgtgggaatccatcgatgcctggcagatcccttcctcgctgattgccgaaatgccggcctccgtggcgttgcattatgcggtactgccgctgcgtctggacaatgatgagttaattgtcggcagtgaagatggtattgacccggtttcgctggcggccctgacgcgtaaagtcggacgcaaagtgcgttacgtcattgttctgcggggacaaattgtcaccggattacgccactggtatgcacgccgacgcggtcacgatccgcgggcaatgttgtacaatgcagttcagcatcagtggctcacggaacagcaggccggtgaaatctggcggcaatatgtgccgcatcagttcctgttcgcagaaatactgaccacgctcggtcatattaatcgttcagcaattaacgtgttgttattgcgccatgaacgcagttctctgccgctcggcaagtttttggtcaccgaaggcgttatcagccaggaaacgttggatcgcgtcctgacaattcaacgcgaattacaagtttcgatgcaatcactattactcaaagcaggtttaaacactgaacaggttgcacaactggagtccgaaaatgaaggagaataa

SEQ ID NO: 1384 - protein, 745 aa, Escherichia coli
MDWLLDVFATWLYGLKVIAITLAVIMFISGLDDFFIDVVYWVRRIKRKLSVYRRYPRMSYRELYKPDEKPLAIMVPAWNETGVIGNMAELAATTLDYENYHIFVGTYPNDPDTQRDVDEVCARFPNVHKVVCARPGPTSKADCLNNVLDAITQFERSANFAFAGFILHDAEDVISPMELRLFNYLVERKDLIQIPVYPFEREWTHFTSMTYIDEFSELHGKDVPVREALAGQVPSAGVGTCFSRRAVTALLADGDGIAFDVQSLTEDYDIGFRLKEKGMTEIFVRFPVVDEAKEREQRKFLQHARTSNMICVREYFPDTFSTAVRQKSRWIIGIVFQGFKTHKWTSSLTLNYFLWRDRKGAISNFVSFLAMLVMIQLLLLLAYESLWPDAWHFLSIFSGSAWLMTLLWLNFGLMINRIVQRVIFVTGYYGLTQGLLSVLRLFWGNLINFMANWRALKQVLQHGDPRRVAWDKTTHDFPSVTGDTRSLRPLGQILLENQVITEEQLDAALRNRVEGLRLGGSMLMQGLISAEQLAQALAEQNGVAWESIDAWQIPSSLIAEMPASVALHYAVLPLRLDNDELIVGSEDGIDPVSLAALTRKVGRKVRYVIVLRGQIVTGLRHWYARRRGHDPRAMLYNAVQHQWLTEQQAGEIWRQYVPHQFLFAEILTTLGHINRSAINVLLLRHERSSLPLGKFLVTEGVISQETLDRVLTIQRELQVSMQSLLLKAGLNTEQVAQLESENEGE

SEQ ID NO: 1385 - DNA, 96 bp, Escherichia coli
atgtgcgggggacaaggtttgttatcatattacccgcttaatccttcagcaaacggcaacttttataaccagtgtaaaaataacatgccgcaatag

SEQ ID NO: 1386 - protein, 31 aa, Escherichia coli
MCGGQGLLSYYPLNPSANGNFYNQCKNNMPQ

SEQ ID NO: 1387 - DNA, 1443 bp, Escherichia coli
atggtcagtaaaccatttcagcgcccgttttcgctggcaactcgcctgaccttttttatcagcctcgccaccatcgcggcgtttttcgcctttgcatggatcatgatccactcggtaaaagtgcattttgccgagcaggatattaatgatttaaaagagattagcgccacccttgaacgggtacttaatcaccctgacgaaacgcaagcccgacgcttaatgacgctggaagatatcgtcagtggttattccaatgtgttgatctctctggcagatagccacggtaaaacggtgtatcactcccccggtgcgccggatatccgcgagtttacgcgtgacgccatacccgataaagacgcgcagggcggcgaggtgtatctcctttccggcccaacgatgatgatgccagggcacggtcacgggcatatggaacacagcaactggcggatgattaacttgccggttggcccgctggttgacggcaaaccgatttatacgctctacatcgcgctttcgatcgattttcatcttcattacatcaatgatttgatgaataaacttattatgaccgcatcggtaatcagcatcctgatcgtctttatcgtgctgttggcggtacataaaggtcacgcgccgatccgcagcgtcagccgtcaaatccagaatatcacctcgaaagatctcgacgttcgccttgacccgcagaccgtgcccattgagctggaacagctggtactgtcgttcaaccatatgatcgagcgtattgaggatgtctttacccgccagtccaatttctcagcggatatcgcccacgaaattcgcacacctattactaatctcattacgcaaacggaaatcgccctcagccagtcgcgcagccagaaggagctggaagatgtgctctactctaatctcgaagagctgacgcgaatggcgaaaatggtcagcgatatgctgtttctcgctcaggccgataacaaccagctaatccccgaaaagaaaatgctcaacctggcggatgaagtcggcaaagtgttcgattttttcgaggcgttagcagaagatcgcggcgtggagctgcggtttgttggcgacgagtgtcaggttgcgggcgatccgctgatgctgcgtcgggcgttaagcaatctgctttctaatgcccttcgttatacgccaaccggagagacaattgtcgtgcgctgccagacggtcgatcacctggtgcaagttaccgtcgaaaaccccggtacgcccattgcgcccgaacacttaccgcgattgtttgaccgtttctaccgcgttgatccttcccgccagcgaaaaggcgaaggtagcggcattggcctggcgatagtgaaatcgattgttgtcgcgcataaaggcacagttgcagtaacgtcagatgtgcgggggacaaggtttgttatcatattacccgcttaa

SEQ ID NO: 1388 - protein, 480 aa, Escherichia coli
MVSKPFQRPFSLATRLTFFISLATIAAFFAFAWIMIHSVKVHFAEQDINDLKEISATLERVLNHPDETQARRLMTLEDIVSGYSNVLISLADSHGKTVYHSPGAPDIREFTRDAIPDKDAQGGEVYLLSGPTMMMPGHGHGHMEHSNWRMINLPVGPLVDGKPIYTLYIALSIDFHLHYINDLMNKLIMTASVISILIVFIVLLAVHKGHAPIRSVSRQIQNITSKDLDVRLDPQTVPIELEQLVLSFNHMIERIEDVFTRQSNFSADIAHEIRTPITNLITQTEIALSQSRSQKELEDVLYSNLEELTRMAKMVSDMLFLAQADNNQLIPEKKMLNLADEVGKVFDFFEALAEDRGVELRFVGDECQVAGDPLMLRRALSNLLSNALRYTPTGETIVVRCQTVDHLVQVTVENPGTPIAPEHLPRLFDRFYRVDPSRQRKGEGSGIGLAIVKSIVVAHKGTVAVTSDVRGTRFVIILPA

SEQ ID NO: 1389 - DNA, 684 bp, Escherichia coli
atgaaactgttgattgtcgaagatgaaaagaaaaccggagaatacttgaccaaagggttaaccgaagccggttttgtggtcgatttggccgacaacgggctgaatggctaccatctggcgatgaccggtgattatgatctgataatcctcgatattatgctgccggacgtgaacggctgggatatcgtgcgcatgttgcgttccgccaataaggggatgccgattctgttgcttaccgcgcttggcaccattgaacatcgcgtcaaggggctggagttgggggcggatgactatctggtgaagccgttcgcttttgctgaactgctggcgcgggtgcgcactctactgcggcgcggggcggcggtgattatcgaaagtcagtttcaggttgccgatctgatggtcgatctcgtcagccgcaaagtcacccgcagcggcacgcgcatcactctgaccagtaaagaatttactctgctggagtttttcctccgccatcagggcgaagtgctgccccgctcgcttatcgcctcgcaggtatgggacatgaattttgacagcgataccaacgccattgatgtggcggtgaagcggctgcgcggcaaaatcgacaacgactttgagccaaagttgattcagaccgtgcgcggcgtgggttacatgctagaggtgccggatggtcagtaa

SEQ ID NO: 1390 - protein, 227 aa, Escherichia coli
MKLLIVEDEKKTGEYLTKGLTEAGFVVDLADNGLNGYHLAMTGDYDLIILDIMLPDVNGWDIVRMLRSANKGMPILLLTALGTIEHRVKGLELGADDYLVKPFAFAELLARVRTLLRRGAAVIIESQFQVADLMVDLVSRKVTRSGTRITLTSKEFTLLEFFLRHQGEVLPRSLIASQVWDMNFDSDTNAIDVAVKRLRGKIDNDFEPKLIQTVRGVGYMLEVPDGQ

SEQ ID NO: 1391 - DNA, 1383 bp, Escherichia coli
atgtctccttgtaaacttctgccattttgtgtggcccttgcgctaaccggttgttcactggcaccggattatcagcgtccggcaatgcccgtgccgcagcagttctcactcagccagaacggcctggttaacgcagcagataactatcagaacgcgggctggcgcaccttttttgttgataatcaggtgaagacgctgattagcgaggcgttggtgaataaccgggatttgcgcatggcggcgctgaaagtgcaggaagcgcgggcgcaatatcgtctgaccgatgccgaccgctacccacagctcaatggcgaggacagcggcagctggagcggcaatcttaaaggcgattcagccacgacgcgggagttctcgactggccttaacgccagctttgatctcgattttttcgggcgcttaaagaacatgagcgaagccgagcgccaaaattatttagccactgaggaagctcagcgcgcggtgcatattttgctggtttctaatgtcgcgcaaagctatttcaatcagcaactggcgtatgcgcaattgcaaatagccgaagaaacgctgcgtaattatcagcagtcatatgcgtttgtcgaaaaacaactgttgaccggtagcagcaatgttctggcgctggaacaggctcgcggggtgatagaaagtacccgcagcgacatcgctaaacgtcagggggaactggcgcaggcgaataatgcattgcaactgttattgggaagctacggcaagctgccgcaagcgcagacagtaaacagcgacagcctgcaaagcgttaaattaccggcgggcttgccgtcgcaaatcttattgcagcgccctgatattatggaagctgaacacgcgttaatggcggctaatgccaatattggtgctgcgcgtgcggcatttttcccgtctatcagcctgaccagcggaatatcaaccgccagcagcgatctgtcgtcattatttaatgccagcagcgggatgtggaattttattcctaaaattgagatccccatttttaatgctggacgcaaccaggccaatctggatatcgccgaaattcgccagcagcagtcggtggtgaattatgaacagaaaatccagaacgcctttaaagaagtggcagatgcgctggcattacgtcaaagcctgaacgatcaaatcagcgcccagcagcgttatcttgcgtcgctgcaaattactttgcaacgggcgcgggcattatatcagcacggcgcggtaagttatctggaagtgctggatgccgagcgttctttatttgcaacccgacaaactttacttgacctgaattatgcccgtcaggttaacgaaatttctttatataccgccttaggcggcggttggcagcaataa

SEQ ID NO: 1392 - protein, 460 aa, Escherichia coli
MSPCKLLPFCVALALTGCSLAPDYQRPAMPVPQQFSLSQNGLVNAADNYQNAGWRTFFVDNQVKTLISEALVNNRDLRMAALKVQEARAQYRLTDADRYPQLNGEDSGSWSGNLKGDSATTREFSTGLNASFDLDFFGRLKNMSEAERQNYLATEEAQRAVHILLVSNVAQSYFNQQLAYAQLQIAEETLRNYQQSYAFVEKQLLTGSSNVLALEQARGVIESTRSDIAKRQGELAQANNALQLLLGSYGKLPQAQTVNSDSLQSVKLPAGLPSQILLQRPDIMEAEHALMAANANIGAARAAFFPSISLTSGISTASSDLSSLFNASSGMWNFIPKIEIPIFNAGRNQANLDIAEIRQQQSVVNYEQKIQNAFKEVADALALRQSLNDQISAQQRYLASLQITLQRARALYQHGAVSYLEVLDAERSLFATRQTLLDLNYARQVNEISLYTALGGGWQQ

SEQ ID NO: 1393 - DNA, 333 bp, Escherichia coli
atgaaaaaagcactgcaagtcgcaatgtttagtctgtttaccgttattggctttaatgcccaggctaacgaacatcatcatgaaaccatgagcgaagcacaaccacaggttattagcgccactggtgtggtaaaaggtgttgatctggaaagcaaaaaaatcaccatccatcacgatccgattgctgccgtgaactggccggagatgaccatgcgctttaccatcaccccgcagacgaaaatgagcgaaattaaaaccggcgacaaagtggcgtttaattttgtccagcagggcagcctttctttattacaggatattaaagtcagccagtaa

SEQ ID NO: 1394 - protein, 110 aa, Escherichia coli
MKKALQVAMFSLFTVIGFNAQANEHHHETMSEAQPQVISATGVVKGVDLESKKITIHHDPIAAVNWPEMTMRFTITPQTKMSEIKTGDKVAFNFVQQGSLSLLQDIKVSQ

SEQ ID NO: 1395 - DNA, 1224 bp, Escherichia coli
atgaaaaaaatcgcgcttattatcggcagcatgatcgcgggcggtattatttctgcggcaggttttacctggtttgcaaaggctgaactgcccgcagaaaaaacgtcgaccgcagaacgtaaagtcttattctggtacgacccgatgtatcccaatacgcggttcgataaaccagggaaatcgccgtttatggatatggatctggtgccgaaatatgccgatgaagagagttctgcatctggtgtgcgcattgacccgactcagacgcagaatctgggggtgaaaacggcgaccgtcacgcgtgggccgctgacttttgcccagagtttcccggcaaatgtcagttacaacgagtatcagtatgccattgtgcaggcccgcgccgccgggtttatcgacaaggtgtatccgcttaccgtgggcgataaagtgcaaaagggcgcgccgcttctcgacctgaccattcccgactgggtggaagcgcagagtgagtatttactgctgcgcgaaaccggcggtacggcgacccagactgaaggcattcttgagcgactgcgactggcgggaatgccggaggctgatattcgccgtctgatcgccacgcaaaaaatccagactcgctttacgctcaaagcgcccattgatggcgtgatcaccgcgtttgatctgcgcgcgggaatgaatatcgccaaagataacgtggtcgcgaaaattcagggtatggacccggtgtgggtcactgctgcgatcccggagtccatcgcctggctggtgaaagatgcctcgcagtttacgctcaccgttccggcgcgacctgataaaacactcaccatccgcaaatggacgctgctacctggcgtggatgctgcgacccgcacgctgcaactgcgtctggaagtcgacaacgccgacgaggcgctaaaaccgggcatgaacgcctggttgcaactcaataccgccagcgaaccgatgctgctcattccgtcacaggcgctgattgataccggcaacgaacagcgggtgattaccgttgatgctgacgggcgctttgtaccgaaacgcgttgccgttttccaggcatcgcaaggcgtcaccgcgttacgctctggtctggcggaaggtgaaaaggtggtttccagcggcctgttcctgattgattctgaagccaatatttctggcgcactggagcggatgcgctctgaaagtgctacccatgcgcattga

SEQ ID NO: 1396 - protein, 407 aa, Escherichia coli
MKKIALIIGSMIAGGIISAAGFTWFAKAELPAEKTSTAERKVLFWYDPMYPNTRFDKPGKSPFMDMDLVPKYADEESSASGVRIDPTQTQNLGVKTATVTRGPLTFAQSFPANVSYNEYQYAIVQARAAGFIDKVYPLTVGDKVQKGAPLLDLTIPDWVEAQSEYLLLRETGGTATQTEGILERLRLAGMPEADIRRLIATQKIQTRFTLKAPIDGVITAFDLRAGMNIAKDNVVAKIQGMDPVWVTAAIPESIAWLVKDASQFTLTVPARPDKTLTIRKWTLLPGVDAATRTLQLRLEVDNADEALKPGMNAWLQLNTASEPMLLIPSQALIDTGNEQRVITVDADGRFVPKRVAVFQASQGVTALRSGLAEGEKVVSSGLFLIDSEANISGALERMRSESATHAH

SEQ ID NO: 1397 - DNA, 3144 bp, Escherichia coli
atgattgaatggattattcgtcgctcggtggcgaaccgttttctggtgctgatgggcgcgttgtttctgagtatctggggcacctggaccatcattaacacgccagtggatgcactgccggatctttccgatgtacaggtgattattaaaaccagctatcccggtcaggcaccgcaaatcgttgaaaatcaggtgacttatccgctaaccaccaccatgttgtcggtgcctggcgcgaagactgtgcgcggtttctcgcagtttggcgactcttatgtgtatgtcattttcgaagatggcaccgatccgtactgggcgcgctcgcgggtgctggagtacctcaaccaggtacagggtaagctgcctgcgggagtcagcgccgagctggggccagatgccacgggtgttggctggatctatgaatatgcactggtggatcgcagcggtaagcacgatctggccgatttacgctcattgcaggactggtttctcaaatatgagctaaaaaccatccctgacgttgcggaagtggcgtcggtgggcggtgtggtgaaagagtatcaggtggttatcgatcctcagcgcctggcgcagtatggcatcagtctcgccgaagtaaaaagcgcgctggatgcttcaaaccaggaagcgggcggttcgtcgatcgaactggcggaagcggaatatatggtgcgcgccagcggctatctgcaaacgctcgacgactttaatcacatcgttttaaaagccagtgaaaatggcgtgcccgtttatctgcgtgatgttgcgaaggtccaggttggcccggagatgcgccggggcattgccgaactgaacggcgaaggcgaagtggcgggcggggtggtgatcctgcgttccggcaaaaacgcccgtgaagtgatcgccgccgtgaaggacaaactggaaacgctgaaaagcagtctgccggaaggcgtggagatagttacaacatacgatcgcagtcagctcattgaccgcgccattgacaacctcagcggcaagttgctggaagagtttattgtggtggcggtagtctgtgcgctgtttctctggcatgtgcgctcggcgctggtggcgattatttcgttgccgctggggttgtgtattgcttttattgtcatgcactttcagggactgaacgccaatattatgtcgttgggtggcattgcgattgccgtcggggcgatggtcgatgccgctatcgtcatgatcgagaatgcgcataaacggctggaagagtggcagcaccagcatcctgacgccacgctggataataaaacgcgctggcaggtgatcaccgatgcatctgttgaagtggggccggcgctgtttatcagtctgctgattatcacgctgtcgtttatcccgattttcaccctggaagggcaggaaggtcgtctgtttggcccgctggcgttcaccaaaacctatgcgatggcgggcgcggcgctactggcgatcgtagtgatcccgatcctgatgggctactggatccgtggcaaaattccgccagaaagcagtaacccgctcaatcgctttttgattcgtgtttatcatccgctgttgctgaaagtactgcactggccgaaaaccacgctgttggtggcagcgctttcggtgctgacggttctctggccgctcaataaagttggcggggaatttttaccgcagatcaatgaaggcgacttgttgtatatgccatcgacgctgccggggatttccgcagcggaggcggcgagcatgctgcaaaaaaccgacaagctgattatgagcgtaccggaagtggcgcgggtatttggcaaaaccgggaaagcggaaaccgccaccgattcagctccactggagatggtagaaacgactatccagcttaagccgcaggatcagtggcggcctggcatgacgatggacaaaatcattgaggaactggataacaccgtgcgtctgccggggctggcgaatctgtgggtgccgccaattcgtaaccgtatcgatatgctctcgactggcattaaaagccctattggcattaaagtttccggcactgtgctggcggatatcgacacgatggcggagcaaattgaagaagtggcgcgaacggtgccaggcgtggcttctgcgcttgctgagcgtctggaaggtgggcgttatatcaacgttgagattaaccgtgaaaaagccgcgcgttacggtatgacggtggcggatgtgcagttgtttgtgacttctgcggtgggcggggcgatggttggcgaaacggtggaagggattgctcgttatccaattaatctgcgttatccgcaaagctggcgcgatagcccgcaggcactgcgccagttgccgatcctcacgccgatgaagcagcaaatcactctggcggacgtggccgacgttaaagtctctaccggaccgtcgatgctgaaaaccgagaatgcgcgcccgacgagctggatttatatcgatgcccgcgatcgtgacatggtgtcggtggttcacgatctgcaaaaagcgatagctgaaaaagtgcagttaaaaccgggcaccagcgtggcattctccgggcagttcgagctactggagcgcgccaaccataagctgaaactgatggtgccgatgacgctgatgatcatcttcgtgctgttgtatctggcgttccgtcgggtgggcgaagcgttgctgattatcagcagcgtaccgtttgcgctggtgggcggcatctggttgctgtggtggatgggctttcatctttccgtggcgatgggcaccggttttattgcccttgccggggtcgccgccgaatttggcgtggtgatgctgatgtatttacgtcacgccatagaggccgagccgtcgttgaataatccgcaaacattcagcgagcagaagctggatgaggcgttatatcacggcgcggtactgcgcgtgcgcccaaaagcgatgacggtggcggtgattatcgctggtctgctgccgattctgtggggaacaggagcagggtcagaggtgatgagccggattgccgcgccgatgattggcggcatgatcaccgcgcctttgctgtcgctgtttattatcccggcggcgtataagctgatgtggctgcaccgacatcgggtacggaaataa

SEQ ID NO: 1398 - protein, 1047 aa, Escherichia coli
MIEWIIRRSVANRFLVLMGALFLSIWGTWTIINTPVDALPDLSDVQVIIKTSYPGQAPQIVENQVTYPLTTTMLSVPGAKTVRGFSQFGDSYVYVIFEDGTDPYWARSRVLEYLNQVQGKLPAGVSAELGPDATGVGWIYEYALVDRSGKHDLADLRSLQDWFLKYELKTIPDVAEVASVGGVVKEYQVVIDPQRLAQYGISLAEVKSALDASNQEAGGSSIELAEAEYMVRASGYLQTLDDFNHIVLKASENGVPVYLRDVAKVQVGPEMRRGIAELNGEGEVAGGVVILRSGKNAREVIAAVKDKLETLKSSLPEGVEIVTTYDRSQLIDRAIDNLSGKLLEEFIVVAVVCALFLWHVRSALVAIISLPLGLCIAFIVMHFQGLNANIMSLGGIAIAVGAMVDAAIVMIENAHKRLEEWQHQHPDATLDNKTRWQVITDASVEVGPALFISLLIITLSFIPIFTLEGQEGRLFGPLAFTKTYAMAGAALLAIVVIPILMGYWIRGKIPPESSNPLNRFLIRVYHPLLLKVLHWPKTTLLVAALSVLTVLWPLNKVGGEFLPQINEGDLLYMPSTLPGISAAEAASMLQKTDKLIMSVPEVARVFGKTGKAETATDSAPLEMVETTIQLKPQDQWRPGMTMDKIIEELDNTVRLPGLANLWVPPIRNRIDMLSTGIKSPIGIKVSGTVLADIDTMAEQIEEVARTVPGVASALAERLEGGRYINVEINREKAARYGMTVADVQLFVTSAVGGAMVGETVEGIARYPINLRYPQSWRDSPQALRQLPILTPMKQQITLADVADVKVSTGPSMLKTENARPTSWIYIDARDRDMVSVVHDLQKAIAEKVQLKPGTSVAFSGQFELLERANHKLKLMVPMTLMIIFVLLYLAFRRVGEALLIISSVPFALVGGIWLLWWMGFHLSVAMGTGFIALAGVAAEFGVVMLMYLRHAIEAEPSLNNPQTFSEQKLDEALYHGAVLRVRPKAMTVAVIIAGLLPILWGTGAGSEVMSRIAAPMIGGMITAPLLSLFIIPAAYKLMWLHRHRVRK

SEQ ID NO: 1399 - DNA, 1377 bp, Escherichia coli
gtgaaaaacgcgtcaaccgtatcggaagatactgcgtcgaatcaagagccgacgcttcatcgcggattacataaccgtcatattcaactgattgcgctgggtggcgcaattggtactggtctgtttcttggcattggcccggcgattcagatggcgggtccggctgtattgctgggctacggcgtcgccgggatcatcgctttcctgattatgcgccagctcggcgagatggtggtcgaagagccggtatccggttcatttgcccactttgcctataaatactggggaccgtttgcgggcttcctctctggctggaactactgggtaatgttcgtgctggtgggaatggcagagctgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgctgattaaagtgctggcgatcatcggtatgatcggctttggcctgtggctgctgttttctgggcacggcggtgagaaagccagtatcgataacctctggcgctatggcggtttctttgccaccggctggaatggactgattttgtcgctggcggtaattatgttctccttcggcggtctggagctgattgggattactgcggctgaagcgcgcgatccggaaaaaagcatccctaaagcagtgaatcaggtggtgtatcgcatcctgctgttttatatcggttcactggtggttttactggcgctctacccgtgggtggaagtgaaatccaacagtagcccgtttgtgatgattttccataatctcgacagcaacgtggtagcttctgcgctgaacttcgtcattctggtggcatcgctgtcggtgtataacagcggggtttactctaacagccgcatgctgtttggcctttctgtgcagggtaatgcgccaaagtttttgactcgcgtcagccgtcgcggcgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgcctggcgcatctgcgttttcgtgcagcgatgcgtcgtcaggggcgtgaaacacagtttaaggcgctgctctatccgttcggcaactatctttgcatcgccttcctcggcatgattttgctgctgatgtgcacgatggatgatatgcgcttgtcagcgattctgctgccggtgtggattgtattcctgtttgtagcatttaaaacgctgcgtcggaaataa

SEQ ID NO: 1400 - protein, 458 aa, Escherichia coli
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRK

SEQ ID NO: 1401 - DNA, 1248 bp, Escherichia coli
atgcaggatttaatatcccaggttgaagatttagcgggtattgagattgatcacaccacctcgatggtgatgattttcggtattatttttctgaccgccgtcgtggtgcatatttttttgcactgggtggtactgcggaccttcgaaaaacgcgccatcgccagttcacggctttggttgcaaatcattacccagaataaactcttccaccgtttagcttttaccttgcaggggattatcgtcaatattcaggcggtattctggctacaaaaaggcaccgaagcggcagatattctgactacctgcgcgcagttgtggatcatgatgtatgcgctgctttcagtcttctcgttgctggatgtgattttgaatctggcgcagaaattcccggcggcatctcagttaccgctgaaagggatttttcaggggattaaactgatcggcgcgattctggtcggcattttgatgatctcgctgctgattggtcagtcgccagcgattctgatcagcggtcttggtgcaatggctgccgtgctaatgttggtatttaaagatccgattcttggtctggtggcaggtattcagctttccgcgaacgatatgctgaaactgggcgactggctggagatgccgaaatacggcgcggatggcgcggtgatcgatattgggttaaccaccgtcaaagtacgtaactgggacaataccattaccactattcccacctggtctctggtttctgactcctttaaaaactggagcgggatgtcagcatctggcgggcgacgtattaagcgcagtatcagtattgatgtcaccagtattcgttttcttgatgaagacgaaatgcaacgtctgaataaagcgcatttgttaaagccttatttaaccagccgccatcaggaaattaatgagtggaatcgccagcaaggttctacggagtcggtattaaacctgcgccgaatgaccaatattggaacctttcgtgcctatctgaacgaatatctgcggaatcatccgcggattcgcaaagatatgaccttaatggtgcgccaattagctccgggcgacaacggtttaccgcttgagatctacgcgtttaccaacaccgtggtgtggctggaatatgaaagcattcaggctgatatattcgatcacatatttgcgattgtcgaagagtttggtctgcgacttcatcagtcgccaaccggcaatgatattcgctctctggcgggtgcatttaagcagtaa

SEQ ID NO: 1402 - protein, 415 aa, Escherichia coli
MQDLISQVEDLAGIEIDHTTSMVMIFGIIFLTAVVVHIFLHWVVLRTFEKRAIASSRLWLQIITQNKLFHRLAFTLQGIIVNIQAVFWLQKGTEAADILTTCAQLWIMMYALLSVFSLLDVILNLAQKFPAASQLPLKGIFQGIKLIGAILVGILMISLLIGQSPAILISGLGAMAAVLMLVFKDPILGLVAGIQLSANDMLKLGDWLEMPKYGADGAVIDIGLTTVKVRNWDNTITTIPTWSLVSDSFKNWSGMSASGGRRIKRSISIDVTSIRFLDEDEMQRLNKAHLLKPYLTSRHQEINEWNRQQGSTESVLNLRRMTNIGTFRAYLNEYLRNHPRIRKDMTLMVRQLAPGDNGLPLEIYAFTNTVVWLEYESIQADIFDHIFAIVEEFGLRLHQSPTGNDIRSLAGAFKQ

SEQ ID NO: 1403 - DNA, 654 bp, Escherichia coli
atggatatcatttctgtcgccttaaagcgtcattccactaaggcatttgatgccagcaaaaaacttaccccggaacaggccgagcagatcaaaactctactgcaatacagcccatccagcaccaactcccagccgtggcattttattgttgccagcacggaagaaggtaaagcgcgtgttgccaaatccgctgccgataattacgtgttcaacgagcgtaaaatgcttgatgcctcgcacgtcgtggtgttctgtgcaaaaaccgcgatggacgatgcctggctgaagctggttgttgaccaggaagatgccgatggccgctttgccacgccggaagcgaaagccgcgaacgataaaggtcgcaagttcttcgccgatatgcaccgtaaagatctgcatgatgatgcagagtggatggcaaaacaggtttatctcaacgtcggtaacttcctgctgggcgtggcggcgctgggtctggacgcggtgcccatcgaaggttttgacgccgccatcctcgatgaagaatttggtctgaaagagaaaggctacaccagtctggtggttgttccggtgggtcatcacagcgttgaagattttaacgctacgctgccgaaatctcgtctgccgcagaacattaccttaaccgaagtgtaa

SEQ ID NO: 1404 - protein, 217 aa, Escherichia coli
MDIISVALKRHSTKAFDASKKLTPEQAEQIKTLLQYSPSSTNSQPWHFIVASTEEGKARVAKSAADNYVFNERKMLDASHVVVFCAKTAMDDAWLKLVVDQEDADGRFATPEAKAANDKGRKFFADMHRKDLHDDAEWMAKQVYLNVGNFLLGVAALGLDAVPIEGFDAAILDEEFGLKEKGYTSLVVVPVGHHSVEDFNATLPKSRLPQNITLTEV

SEQ ID NO: 1405 - DNA, 384 bp, Escherichia coli
atggataagcaatcactgcacgaaacggcgaaacgcctggctcttgagttaccctttgtcgagctttgctggccttttggcccggagttcgatgtttttaaaattggcggcaagatttttatgctgtcgtcggagctgcgcggcgtcccctttatcaatctgaagtccgatccacaaaaatccctgctaaatcagcaaatatacccaagcatcaagcttgggtatcacatgaataaaaagcactggatttcggtgtatcccggcgaggaaatctctgaagcgttacttcgcgatctgatcaacgattcgtggaatctggtggttgatggtctggctaaacgcgatcaaaaaagagtgcgtcctgactcaaccgtaaatcaatag

SEQ ID NO: 1406 - protein, 127 aa, Escherichia coli
MDKQSLHETAKRLALELPFVELCWPFGPEFDVFKIGGKIFMLSSELRGVPFINLKSDPQKSLLNQQIYPSIKLGYHMNKKHWISVYPGEEISEALLRDLINDSWNLVVDGLAKRDQKRVRPDSTVNQ

SEQ ID NO: 1407 - DNA, 249 bp, Escherichia coli
atgaaacaccctttagaaaccttgaccaccgcagcaggcattttgctgatggctttcctctcttgcctgctgctgcccgcccccgcactggggctaacgttggcacaaaaactggtgaccacgttccatctgatggatcttagccagctttacactttattgttttgtctgtggtttttagtgctgggcgctattgagtattttgttctacgctttatctggcgacgctggttctcgctggcggattaa

SEQ ID NO: 1408 - protein, 82 aa, Escherichia coli
MKHPLETLTTAAGILLMAFLSCLLLPAPALGLTLAQKLVTTFHLMDLSQLYTLLFCLWFLVLGAIEYFVLRFIWRRWFSLAD

SEQ ID NO: 1409 - DNA, 1119 bp, Escherichia coli
atgccattacccgattttcatgtttctgaaccttttaccctcggtattgaactggaaatgcaggtggttaatccgccgggctatgacttaagccaggactcatcaatgctgattgacgcggttaaaaatcagatcacggccggagaggtaaagcacgatatcaccgaaagtatgctggagctggcgacggatgtttgccgtgatatcaaccaggctgccgggcaattttcagcgatgcagaaagtcgtattgcaggcagccgcagaccatcatctggaaatttgcggcggtggcacgcatccgtttcagaaatggcagcgtcaggaggtatgcgataacgaacgctatcaacgaacgctggaaaactttggctatctcatccagcaggcgaccgtttttggtcagcatgtccatgttggctgcgccagtggcgatgacgccatttatttgctgcacggcttgtcacggtttgtgccgcactttatcgccctttccgccgcgtcgccatatatgcaaggaacggatacgcgttttgcctcctcacgaccgaatattttttccgcctttcctgataatggcccgatgccgtgggtcagtaactggcaacaatttgaagccctgtttcgctgcctgagttacaccacgatgatcgacagcattaaagatctgcactgggatattcgccccagcccccattttggtacggtggaagttcgggtgatggataccccgttaacccttagccacgcggtaaatatggcgggattaattcaggccaccgcccactggttactgacggaacgcccgtttaaacatcaggagaaagattacctgctgtataaattcaaccgtttccaggcctgtcgctatgggctggaaggcgtcattaccgatccgcatactggcgatcgtcggtcactaacggaagccaccttgcgtttactggaaaaaatcgccccttctgcacataaaattggcgcatcgagcgcaattgaagcactgcaccgtcaggtcgtcagtggtctgaatgaagcgcagctaatgcgtgatttcgtcgccgatggtggctcgctaattgggctggtgaaaaagcattgtgagatctgggccggggaataa

SEQ ID NO: 1410 - protein, 372 aa, Escherichia coli
MPLPDFHVSEPFTLGIELEMQVVNPPGYDLSQDSSMLIDAVKNQITAGEVKHDITESMLELATDVCRDINQAAGQFSAMQKVVLQAAADHHLEICGGGTHPFQKWQRQEVCDNERYQRTLENFGYLIQQATVFGQHVHVGCASGDDAIYLLHGLSRFVPHFIALSAASPYMQGTDTRFASSRPNIFSAFPDNGPMPWVSNWQQFEALFRCLSYTTMIDSIKDLHWDIRPSPHFGTVEVRVMDTPLTLSHAVNMAGLIQATAHWLLTERPFKHQEKDYLLYKFNRFQACRYGLEGVITDPHTGDRRSLTEATLRLLEKIAPSAHKIGASSAIEALHRQVVSGLNEAQLMRDFVADGGSLIGLVKKHCEIWAGE

SEQ ID NO: 1411 - DNA, 771 bp, Escherichia coli
gtgcgcgtagttcatgccggatgcggcgtgaacgccttatccggcctacaaaaatcttgccaattcaatatattgcaggaccacgtaggcctgataagcgtagcgcatcaggcagttttgcgtttgtcatcattctctaatatggttgacatgaaaactacgcatacctccctcccctttgccggacatacgctgcattttgttgagtttgatccggcgagttttcgcgagcaggatttactctggctgccgcactacgcacaacttcaacacgctggacgtaaacgtaaaacagagcatttagccgggcggatcgctgcaatttatgcgctgcgggaatatggctataaatgtgtgcctgcaatcggcgagctacgccaacctgtgtggcctgcgggggtatacggcagcattagtcactgtgggactacggcattagccgtggtttcccgtcaaccaattggcattgatattgaagagattttctctgcacaaaccgcaagagaattgacagacaacattattacaccagcggaacacaagcgacttgcagactgcggtttagcctttcctctggcgctgacactggcattttccgccaaagagagcgcatttaaggcaagtgagatacaggccgctcaaggttttctggattatcagataattagctggaataaacagcagatcatcattcgactagaggatgagcagtttgctgtgcactggcagataaaagaaaaaatagtcataacgctgtgccaacacgattaa

SEQ ID NO: 1412 - protein, 256 aa, Escherichia coli
MRVVHAGCGVNALSGLQKSCQFNILQDHVGLISVAHQAVLRLSSFSNMVDMKTTHTSLPFAGHTLHFVEFDPASFREQDLLWLPHYAQLQHAGRKRKTEHLAGRIAAIYALREYGYKCVPAIGELRQPVWPAGVYGSISHCGTTALAVVSRQPIGIDIEEIFSAQTARELTDNIITPAEHKRLADCGLAFPLALTLAFSAKESAFKASEIQAAQGFLDYQIISWNKQQIIIRLEDEQFAVHWQIKEKIVITLCQHD

SEQ ID NO: 1413 - DNA, 2241 bp, Escherichia coli
atgaacaagaagattcattccctggccttgttggtcaatctggggatttatggggtagcacaggcacaagagccgaccgatactcctgtttcacatgacgatactattgttgttaccgccgccgagcagaacttgcaggcacctggcgtttcgaccatcaccgcagatgaaatccgcaaaaacccggttgcccgcgatgtatcggagatcattcgtaccatgcctggcgttaacctgaccggtaactccaccagtggtcagcgtggtaataaccgccagattgatattcgcggcatgggtccggaaaacacgctgattttgattgacggcaagccggtaagcagccgtaactctgtgcgtcagggctggcgtggcgagcgcgatacccgtggtgatacctcctgggtgccgcctgaaatgattgaacgtattgaagttctacgtggtccggcagctgcgcgttatggcaacggcgcggcgggcggcgtggttaacatcattaccaaaaaaggcagtggtgagtggcacggctcctgggatgcttatttcaatgcgccagaacataaagaggaaggtgccaccaaacgcaccaacttcagcctgaccggtccgctgggcgacgaattcagcttccgcttgtatggcaacctcgacaaaacccaggctgacgcgtgggatatcaaccagggccatcagtccgcgcgtgccggaacgtatgccacgacgttaccagccgggcgcgaaggggtgatcaacaaagatattaatggcgtggtgcgctgggacttcgcgcctctgcagtcactcgaactggaagcgggctacagccgccagggtaacctgtatgcgggtgatacgcagaacaccaactctgacgcttacactcgctcgaaatatggcgatgaaaccaaccgcctgtatcgccagaactactcgctgacctggaacggtggctgggataacggcgtgaccaccagcaactgggtgcagtacgaacacacccgtaactcgcgtattccggaaggtctggcgggcggtaccgaagggaaatttaacgaaaaagcggcacaggattttgtagatatcgatcttgatgacgtgatgctgcacagcgaagttaacctgccgattgatttcctcgttaaccaaacgctgacgctgggtacagagtggaatcagcaacggatgaaggacttgagttccaacacccaggcactgaccggaacgaataccggcggtgctattgatggcgtgagtgccaccgaccgtagcccatattcaaaagcagaaattttctcgctgtttgccgaaaacaatatggagctgactgacagcaccatcgtaacgccggggctgcgtttcgatcatcacagtattgtcggcaataactggagcccggcgctgaacatatcgcaaggtttaggcgatgacttcacgctcaaaatgggcatcgcccgcgcctataaagcgccgagcctgtaccagactaacccaaactacattctctacagtaaaggtcagggctgctatgccagcgcgggcggctgctatctgcaaggtaacgatgacctgaaagcagaaaccagcatcaacaaggagattggtctggagttcaaacgcgacggctggctggcgggcgtgacctggttccgtaacgattatcgcaataagattgaagcgggctatgtggctgtagggcaaaacgcagtcggcaccgatctctatcagtgggataacgtaccgaaagcggtggttgaaggtctggaaggatcgttaaacgtaccggttagcgaaacggtgatgtggaccaataacatcacttatatgctgaagagtgaaaacaaaaccacgggcgaccgtttgtcgatcatcccggagtatacgttgaactcaacgctgagctggcaggcacgggaagatttgtcgatgcaaacgaccttcacctggtacggcaaacagcagccgaagaagtacaactataaaggtcagccagcggttggaccggaaaccaaagaaatcagtccgtacagcattgttggcctgagcgcgacctgggatgtgaccaagaatgtcagtctgaccggcggcgtggacaacctgttcgacaaacgtttgtggcgtgcgggtaatgcccagaccacgggcgatctggcaggagccaactatatcgcaggtgccggggcgtatacctataacgagccgggacgtacgtggtatatgagcattaatactcacttctga

SEQ ID NO: 1414 - protein, 746 aa, Escherichia coli
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 1415 - DNA, 132 bp, Escherichia coli
ttgttcattgttttattcctgcatttttgccacgaattgcaactgtcgggcatggtcgtcatcaacacgacgcatcccgctaccgcgaaaacctttgatcctgaaagacacgcagtgcagctgattaattaa

SEQ ID NO: 1416 - protein, 43 aa, Escherichia coli
MFIVLFLHFCHELQLSGMVVINTTHPATAKTFDPERHAVQLIN

SEQ ID NO: 1417 - DNA, 1203 bp, Escherichia coli
gtgacggcgttaaaagtaggaagtgagagctggtggcagtcgaaacatggcccggaatggcaacgtctgaatgacgaaatgtttgaggtcactttctggtggcgtgatccccagggttctgaagaatactcgacgataaagcgcgtatgggtctatatcactggcgtgaccgatcaccatcagaacagccagccccggtcgatgcagcgaattgcaggaaccgatgtttggcagtggacgacacaactcaatgccaactggcgtggcagctactgctttattcctactgaacgcgatgacattttttctgcaccatcccccgatcgcctcgaattacgcgaaggctggcgaaaactattaccccaggcgatagccgatccgctgaatccacaaagctggaaaggcgggcgagggcacgctgtttctgcactcgaaatgccgcaagcgtctctgcaaccgggatgggattgtccgcaagcgccagaaacgcctgccaaagaaattatctggaaaagtgaacggttgaaaaattcacgccgtgtatggatttttaccaccggcgatgcaacagcagaagaacgcccgctggcagttttgcttgatggcgaattttgggcgcagagtatgcccgtctggcctgcgctgacttcgctgacccatcgtcggcaacttccgcccgccgtgtatgtgttgatcgacgctatcgacaccacgcaccgcgcccacgaactgccgtgtaatgcggatttctggctggcagtacagcaagagttattaccccaggtgaaagctattgccccttttagcgatcgcgccgatcgcaccgtggtcgccggacagagttttggtgggctttccgcgctgtatgccggactgcactggcctgaacgctttggctgtgtattaagccagtcaggttcgtactggtggccgcatcggggcgggcaccaagagggcatgttacttgaacagctaaatactggtgaagttagcgccgaaggtctgcgcattgtgctggaagcgggtgttcgcgagccgatgatcatgcaggccaatcaggcgctgtatgcgcaattacaccccctaaaagaatccattttctggcgtcaggttgacggcggacatgatgcgctttgttggcgcggtggcttgatgcaggggctaatcgacctctggcaaccacttttccatgacaggagttga

SEQ ID NO: 1418 - protein, 400 aa, Escherichia coli
MTALKVGSESWWQSKHGPEWQRLNDEMFEVTFWWRDPQGSEEYSTIKRVWVYITGVTDHHQNSQPRSMQRIAGTDVWQWTTQLNANWRGSYCFIPTERDDIFSAPSPDRLELREGWRKLLPQAIADPLNPQSWKGGRGHAVSALEMPQASLQPGWDCPQAPETPAKEIIWKSERLKNSRRVWIFTTGDATAEERPLAVLLDGEFWAQSMPVWPALTSLTHRRQLPPAVYVLIDAIDTTHRAHELPCNADFWLAVQQELLPQVKAIAPFSDRADRTVVAGQSFGGLSALYAGLHWPERFGCVLSQSGSYWWPHRGGHQEGMLLEQLNTGEVSAEGLRIVLEAGVREPMIMQANQALYAQLHPLKESIFWRQVDGGHDALCWRGGLMQGLIDLWQPLFHDRS

SEQ ID NO: 1419 - DNA, 219 bp, Escherichia coli
atggcattcagtaatcccttcgatgatccacagggagcgttttacattttgcgcaatgcgcaggggcaattcagtctgtggccgcaacaatgcgccttaccggcaggctgggacgttgtgtgtcagccgcagtcacaggcgtcctgccagcagtggctggaagcccactggcgtactctgacaccggcgaatttcacccagttgcaggaggcacaatga

SEQ ID NO: 1420 - protein, 72 aa, Escherichia coli
MAFSNPFDDPQGAFYILRNAQGQFSLWPQQCALPAGWDVVCQPQSQASCQQWLEAHWRTLTPANFTQLQEAQ

SEQ ID NO: 1421 - DNA, 3882 bp, Escherichia coli
atgagccagcatttacctttggtcgccgcacagcccggcatctggatggcagaaaaactgtcggatttaccctccgcctggagcgtggcgcattacgttgagttaaccggagaggttgatgcgccactactggcccgcgcggtggttgccggactagcgcaagcagatacgttgcggatgcgttttacggaagataacggcgaagtctggcagtgggtcgatgatgcgcagacgttcgaactgccagaaattatcgacctgcgaaccaacattgatccgcacggtactgcgcgggcattaatgcaggcggatttgcaacaagatctgcgcgtcgatagtggtaaaccactggtctttcatcaactgatacaggtggcggataaccgctggtactggtatcagcgttatcaccatttgctggtcgatggcttcagtttcccggccattacacgccagatcgccaacatttactgcgcattgctgcgtggcgaaccaacgcctgcttcgccgtttacgcctttcgctgatgtagtggaagagtatcagcagtaccgcgaaagtgaagcctggcagcgtgatgcggcattctgggcggaacagcgtcgtcaactaccaccgcccgcgtcactttctccggcacctttaccggggcgcagcgcttcggcagatattttgcgcctgaaactggaatttaccaacggggaattccgccagctggctacgcaactttcaggtgtgcagcgtaccgatttagcacttgcgttggcagccttgtggctggggcgattgtgcaaccgcatggactacgctgccggatttatctttatgcgtcgactgggctcggcggcgctgacggctaccggacccgtgctcaacgttttgccattgggtattcacattgcggcgcaagaaacgctgccgcaactggcaacccgactggcggctcaactgaaaaaaatgcgtcgccatcaacgttacgatgccgaacaaattgtccgtgacagcgggcgagcggcaggagaggaaccgctgttcggtccggtactcaatatcaaggtatttgattaccaactggatattcctggtgttcaggcgcaaacccataccctggcaaccggtccggttaatgaccttgaactggccctgttcccggatgaacacggtgatttgagtattgagatcctcgccaataaacagcgttacgatgagccaacgttaattcaacacgctgaacgcctgaaaatgctgattgcgcagttcgccgcggatccgtcgctgttgtgcggcgatgtcgatattatgttgccaggcgagtatgcgcagctggcgcagatcaacgccactcaggttgagattccagaaaccacgctgagcgcgctggtggcagaacaagcggcaaaaacaccggatgctccggcgctggcagatgcgcgttaccagttcagctatcgggaaatgcgcgagcaggtggtggcgctggcgaatctgctgcgtgagcgcggcgttaaaccgggcgacagcgtggcggtggcgctaccgcgctcggtctttttgaccctggcgctacatgcgatagttgaagctggtgcggcctggctaccgttggataccggctatccggacgatcgcctgaaaatgatgctggaagatgcgcgtccgtcgctgttaatcaccactgacgatcaactgccgcgctttagcgatatccctaatttaaccagcctttgctataacgccccgcttaccccacagggcagtgcgccgctgcagctttcacaaccgcaccacacggcttatatcatcttcacctccggttccaccggcagaccaaaaggggtaatggtcgggcagacggctatcgttaatcgcctgctttggatgcaaaaccattacccgcttacaggcgaagatgtcgttgcccaaaaaacgccgtgcagttttgatgtctcggtgtgggagtttttctggccgtttattgccggggcgaaacttgtgatggctgaaccggaagcgcaccgcgacccgctcgctatgcagcaattctttgccgaatatggcgtaacgaccacgcactttgtgccgtcgatgctggcggcatttgttgcatcgctgacgccgcaaaccgctcgccagagttgcgcgacgttgaaacaggttttctgtagtggtgaagccttaccggctgatttatgccgcgaatggcaacagttaaccggcgcgccgttgcataatctatatggcccgacggaagcggcggtagatgtcagttggtatccggcttttggcgaggaactggcagaggtgcgcggcagcagtgtgccgattggttatccggtgtggaatacgggcctgcgcattctcgatgcgatgatgcatccggtgccgccgggtgtggtgggagatctctatctcaccggtattcaactggcgcaggggtatcttggacgacccgatctgaccgccagccgctttattgccgatccttttgccccaggtgaacggatgtaccgtaccggcgatgtggctcgctggctggataacggcgcagtggagtacctcgggcgcagtgacgatcagctaaaaattcgcgggcagcgtatcgaactgggcgaaattgatcgcgtgatgcaggcgctgccggatgtcgaacaagccgttacccacgcctgtgtgattaaccaggcggcagccactggtggtgatgcgcgtcagttggtgggctatctggtgtcgcaatcaggtctgccgttggataccagcgcattacaggcgcagcttcgtgaaacattgccaccacatatggtaccggtggttctgctgcaacttccacagttaccacttagcgccaacggcaagctggatcgcaaagccttaccgttgcctgaactgaaggcacaagcgcctgggcgtgcgccgaaagcgggcagtgaaacgattatcgccgcggcattctcgtcgttgctgggttgtgacgtgcaggatgccgatgctgatttctttgcgcttggcggtcattcgctactggcaatgaaactggcagcgcagttaagtcgacagtttgctcgtcaggtgacgccggggcaggtgatggtcgcgtcaactgtcgccaaactggcaacgattattgatggtgaagaagacagcacccagcgcatgggattcgaaaccattctgccgttgcgtgaaggtaatggtccgacgctgttttgtttccatccggcatccggttttgcctggcagttcagcgtgctctcgcgttatctcgatccacaatggtcgattatcggcattcagtcgccgcgccctcatggccccatgcagacgtcagcgaatctggatgaagtctgcgaagcgcatctggcaacgttacttgaacaacaaccgcacggcccatattacctgctgggttattcgctgggcggtacgctggcgcagggcattgcggcgcgactgcgtgcccgtggcgaacaggtggcatttcttggcttgctggatacctggccgccagaaacgcaaaactggcaggaaaaagaagccaatggtctggacccggaagtgctggcggagattaaccgcgagcgcgaagccttcctggcggcacagcagggaagtacttcaacggagttgtttaccaccattgaaggcaactacgctgatgctgtgcgcctgctgacgacagctcatagcgtaccgtttgatggtaaagcgacgctatttgttgccgaacgcacgcttcaggaaggtatgactcctgaacaggcctgggcaccgtggattgctgggctggatatctatcgtcaggattgtgcgcatgtggatattatctctccggtggcgtttgaaaaaattgggccgattattcgtgcgacgctaaataagtaa

SEQ ID NO: 1422 - protein, 1293 aa, Escherichia coli
MSQHLPLVAAQPGIWMAEKLSDLPSAWSVAHYVELTGEVDAPLLARAVVAGLAQADTLRMRFTEDNGEVWQWVDDAQTFELPEIIDLRTNIDPHGTARALMQADLQQDLRVDSGKPLVFHQLIQVADNRWYWYQRYHHLLVDGFSFPAITRQIANIYCALLRGEPTPASPFTPFADVVEEYQQYRESEAWQRDAAFWAEQRRQLPPPASLSPAPLPGRSASADILRLKLEFTNGEFRQLATQLSGVQRTDLALALAALWLGRLCNRMDYAAGFIFMRRLGSAALTATGPVLNVLPLGIHIAAQETLPQLATRLAAQLKKMRRHQRYDAEQIVRDSGRAAGEEPLFGPVLNIKVFDYQLDIPGVQAQTHTLATGPVNDLELALFPDEHGDLSIEILANKQRYDEPTLIQHAERLKMLIAQFAADPSLLCGDVDIMLPGEYAQLAQINATQVEIPETTLSALVAEQAAKTPDAPALADARYQFSYREMREQVVALANLLRERGVKPGDSVAVALPRSVFLTLALHAIVEAGAAWLPLDTGYPDDRLKMMLEDARPSLLITTDDQLPRFSDIPNLTSLCYNAPLTPQGSAPLQLSQPHHTAYIIFTSGSTGRPKGVMVGQTAIVNRLLWMQNHYPLTGEDVVAQKTPCSFDVSVWEFFWPFIAGAKLVMAEPEAHRDPLAMQQFFAEYGVTTTHFVPSMLAAFVASLTPQTARQSCATLKQVFCSGEALPADLCREWQQLTGAPLHNLYGPTEAAVDVSWYPAFGEELAEVRGSSVPIGYPVWNTGLRILDAMMHPVPPGVVGDLYLTGIQLAQGYLGRPDLTASRFIADPFAPGERMYRTGDVARWLDNGAVEYLGRSDDQLKIRGQRIELGEIDRVMQALPDVEQAVTHACVINQAAATGGDARQLVGYLVSQSGLPLDTSALQAQLRETLPPHMVPVVLLQLPQLPLSANGKLDRKALPLPELKAQAPGRAPKAGSETIIAAAFSSLLGCDVQDADADFFALGGHSLLAMKLAAQLSRQFARQVTPGQVMVASTVAKLATIIDGEEDSTQRMGFETILPLREGNGPTLFCFHPASGFAWQFSVLSRYLDPQWSIIGIQSPRPHGPMQTSANLDEVCEAHLATLLEQQPHGPYYLLGYSLGGTLAQGIAARLRARGEQVAFLGLLDTWPPETQNWQEKEANGLDPEVLAEINREREAFLAAQQGSTSTELFTTIEGNYADAVRLLTTAHSVPFDGKATLFVAERTLQEGMTPEQAWAPWIAGLDIYRQDCAHVDIISPVAFEKIGPIIRATLNK

SEQ ID NO: 1423 - DNA, 1254 bp, Escherichia coli
gtgaatgttgcattcagtgggagtaatttacaaacttcagcttcggataaatctcaccaactggtagagtgggggccgtggagatttactcttattggactcattttcaggttataccccatgtcatcactgaatattaaacagggaagtgaagctcattttcccgagtatcctctggcgtcgcccagtaataatgaaattgatttacttagtctaattgaagttttatggcgggccaaaaaaacggtcatggcggtcgtttttgcgtttgcctgcgcagggttactgatctctttcatcctgccgcaaaaatggaccagctcagccgtcattactcccgccgaagccattcagtggcaggacctggagaaaacctttaccaaactccgcgttcttgatctcgatattaatatcgaccgtggcggtgcatttaacctgtttatcaagaggtttcagtctgttagcttactagaagagtacctgcgctcatcaccttatgtgatggaccaattaaaagaggcgaaaatcgacgaactggatttgcatcgagctatcgtcgcattgagcgaaaaaatgaaagcggttgatgacaatgccagtaagaaaaaagatgaaccgtcactgtatacctcctggacgctaagttttaccgcgcccaccagtgaagaggcacagaaagtgttggccgggtatatcgattatatctctgcgttggtggtgaaagagtcgatagaaaacgtccgtaataaactggagatcaaaacccagtttgaaaaagaaaaactggctcaggatcgcattaaaacgaaaaatcaacttgatgcaaacattcagcgcctcaattattcactcgacattgccaacgcggcaggaattaaaaagcccgtatacagtaatggtcaggccgttaaagatgaccccgatttctctatttctctcggtgctgacggtattgaacgcaaactggaaattgaaaaagcggttactgacgttgcggaactgaacggcgaattacgtaatcgccagtatcttgttgagcagttaacaaaagcaaatatcaacgatgtgaattttacgccgtttaaatatcagttaagaccgtcattgccagtaaaaaaagacggtccgggtaagtcgattattgtgatcctttccgcgttgatcggcgggatggtggcttgtggtggtgtgctgttgcgccatgcgatggcatccagaaaacaggatgccatgatggcagaccacttagtttaa

SEQ ID NO: 1424 - protein, 417 aa, Escherichia coli
MNVAFSGSNLQTSASDKSHQLVEWGPWRFTLIGLIFRLYPMSSLNIKQGSEAHFPEYPLASPSNNEIDLLSLIEVLWRAKKTVMAVVFAFACAGLLISFILPQKWTSSAVITPAEAIQWQDLEKTFTKLRVLDLDINIDRGGAFNLFIKRFQSVSLLEEYLRSSPYVMDQLKEAKIDELDLHRAIVALSEKMKAVDDNASKKKDEPSLYTSWTLSFTAPTSEEAQKVLAGYIDYISALVVKESIENVRNKLEIKTQFEKEKLAQDRIKTKNQLDANIQRLNYSLDIANAAGIKKPVYSNGQAVKDDPDFSISLGADGIERKLEIEKAVTDVAELNGELRNRQYLVEQLTKANINDVNFTPFKYQLRPSLPVKKDGPGKSIIVILSALIGGMVACGGVLLRHAMASRKQDAMMADHLV

SEQ ID NO: 1425 - DNA, 816 bp, Escherichia coli
atgaccgaatcagtagcccgtttgcgcggcgaacagttaaccctcggatatggcaaatataccgttgcggaaaatctgactgtagaaatacctgatggtcacttcacggcaattatcgggccaaatggctgcggtaaatccacgttactgcgtaccttaagccgcctgatgacgcctgctcacgggcatgtctggctggatggcgagcacattcaacattacgccagtaaagaggttgcacgccggattggtctgttggcgcaaaacgccaccacaccgggcgatatcaccgtgcaggagctggtggcgcgtgggcgttacccgcatcaaccgctgtttacccgctggcgcaaagaagatgaagacgcggtaacaaaagcgatgcaggccacgggaataactcatctggcggatcaaagcgtggacaccctttctggcggacaacgccagcgagcgtggatcgcgatggtgctggcccaggaaacggcaattatgctgctcgatgaacccacgacctggctggatatcagtcatcagattgatttgctggaactgttaagcgaactgaaccgcgagaaaggctataccctggcggcggtgctgcacgatcttaatcaggcctgtcgttacgccagccatttgattgcattgcgggaagggaaaattgttgctcagggagcaccgaaggagattgtcactgctgaactgatcgagcgcatttatggtctgcgctgcatgattattgacgatccggttgccggaacgccgctcgtggtgccgctcggacgaacggcaccttcaaccgcaaagatttaa

SEQ ID NO: 1426 - protein, 271 aa, Escherichia coli
MTESVARLRGEQLTLGYGKYTVAENLTVEIPDGHFTAIIGPNGCGKSTLLRTLSRLMTPAHGHVWLDGEHIQHYASKEVARRIGLLAQNATTPGDITVQELVARGRYPHQPLFTRWRKEDEDAVTKAMQATGITHLADQSVDTLSGGQRQRAWIAMVLAQETAIMLLDEPTTWLDISHQIDLLELLSELNREKGYTLAAVLHDLNQACRYASHLIALREGKIVAQGAPKEIVTAELIERIYGLRCMIIDDPVAGTPLVVPLGRTAPSTAKI

SEQ ID NO: 1427 - DNA, 993 bp, Escherichia coli
atgatttacgtctctcgccgattaattatcacctgtctgctgttgctaatagcttgtgtgatggcaggcgtgtggggattacgtagcggtgccgtcacgctggaaacttcgcaggtattcgccgcgttgatgggcgacacgccgcgcagtatgacgatggtggtcaccgaatggcgtttaccacgcgtgctgatggcgctgttgattggcgcggcgctgggcgtcagcggcgcgatttttcagtcgctgatgcgtaacccgcttggcagccctgacgtaatgggctttaacaccggggcgtggagcggcgtgctggtggcgatggtgctgtttggtcaggacctgacggctatcgcgctggcagcaatggtgggcggcattgtcacttcgctgctggtctggctgctcgcctggcgtaacggtatcgacacctttcggttgattattatcggtattggtgttcgcgccatgctggtggcctttaatacctggctgttgctgaaagcgtctttagaaacggcgctaacagcgggtttgtggaatgccggatcgctcaatggcctgacgtgggcaaaaacctcgccttccgcacccatcattatattaatgttaattgccgccgccttgctggtgcggcgaatgcgcttgctggaaatgggcgatgataccgcatgtgcgctgggcgtcagcgtcgaacgttcgcggctgttaatgatgctggtcgccgtagtgcttaccgcagctgccactgccctggcggggccaatttcctttattgctttagtcgcgccgcacattgcccgccgcatcagtggcaccgctcgctgggggctaacccaggcggcgctgtgcggggcgctgttactgctggtggccgatctctgcgcccaacaactgtttatgccgtatcaacttccggttggcgtcgttaccgtcagcctcggcggtatttaccttatcgtcttgttaattcaggagtctcgcaaaaaatga

SEQ ID NO: 1428 - protein, 330 aa, Escherichia coli
MIYVSRRLIITCLLLLIACVMAGVWGLRSGAVTLETSQVFAALMGDTPRSMTMVVTEWRLPRVLMALLIGAALGVSGAIFQSLMRNPLGSPDVMGFNTGAWSGVLVAMVLFGQDLTAIALAAMVGGIVTSLLVWLLAWRNGIDTFRLIIIGIGVRAMLVAFNTWLLLKASLETALTAGLWNAGSLNGLTWAKTSPSAPIIILMLIAAALLVRRMRLLEMGDDTACALGVSVERSRLLMMLVAVVLTAAATALAGPISFIALVAPHIARRISGTARWGLTQAALCGALLLLVADLCAQQLFMPYQLPVGVVTVSLGGIYLIVLLIQESRKK

SEQ ID NO: 1429 - DNA, 1005 bp, Escherichia coli
atgtctggttctgttgccgtgacacgcgccattgccgtgcccggattgctgttattactgattatcgcgacggcattaagcctactcattggggcaaaatcactccccgcttccgtagtgctggaggcgctctccggcacctgccagagcgccgactgcaccattgtgctcgacgcccgtctgccgcgcacccttgccggtttattggcaggcggtgcgcttggccttgccggggcgttaatgcaaaccctcacccgaaacccgcttgccgatcctggtttgcttggcgtgaacgccggtgccagttttgccattgtgctgggcgcggcgctgtttggttactcttccgcgcaggaacaactggcgatggccttcgccggggcgctggtggcctcgttgattgttgcctttaccggcagccagggcggcgggcagttaagtccggtgcgtttaaccctggcaggcgtggcgctggcggcggtgctggaagggctgaccagcggcatcgccctgcttaatcccgacgtctacgatcaactgcgtttctggcaagccggttcgctggatattcgcaatctacataccttaaaagtggtgctaatcccggtgcttaccgctggagcaactgcgctattactgagccgcgcgctgaacagtttaagccttggcagtgacaccgcgacggcactgggcagtcgcgtagcgcgcacacagttgattggtctgctggcaattaccgtgctttgtggtagtgcgacggcggtagttggcccgattgcctttattggcctgatgatgccgcacatggcgcgctggctggtaggtgccgatcatcgctggtcgctgcccgtcacgctactcgctacccctgccctgctgctgtttgccgatatcattgggcgggtgattgttcccggcgaactgcgcgtttctgtagtcagtgcctttattggcgcaccagtgctgatcttcctcgtacgacgtaaaacgcgaggtggcgcatga

SEQ ID NO: 1430 - protein, 334 aa, Escherichia coli
MSGSVAVTRAIAVPGLLLLLIIATALSLLIGAKSLPASVVLEALSGTCQSADCTIVLDARLPRTLAGLLAGGALGLAGALMQTLTRNPLADPGLLGVNAGASFAIVLGAALFGYSSAQEQLAMAFAGALVASLIVAFTGSQGGGQLSPVRLTLAGVALAAVLEGLTSGIALLNPDVYDQLRFWQAGSLDIRNLHTLKVVLIPVLTAGATALLLSRALNSLSLGSDTATALGSRVARTQLIGLLAITVLCGSATAVVGPIAFIGLMMPHMARWLVGADHRWSLPVTLLATPALLLFADIIGRVIVPGELRVSVVSAFIGAPVLIFLVRRKTRGGA

SEQ ID NO: 1431 - DNA, 1251 bp, Escherichia coli
atgaataaacaatcctggctgcttaacctcagcctgttgaaaacgcacccggcgtttcgcgcagtattcctcgctcgttttatctcaattgtttctctgggtttgctcggcgtcgcggtgccggtgcagatccagatgatgacgcattccacctggcaggtggggctttcggtgacgctgaccggcggcgcgatgtttgttggcctgatggtcggcggtgtgctggcggatcgctatgagcgtaaaaaagtgattttgctggcgcgcggcacctgtggcattggcttcattggactgtgcctgaatgcgctgctgccggagccgtctttgctggcaatctatttacttggtttatgggatggttttttcgcatcacttggcgttacggcgctactggcggcgacacctgcactggtagggcgtgaaaacctaatgcaggccggggcgatcaccatgttgactgtgcgtctgggatcggtgatttcgcccatgattggcggtttactgctggcgaccggaggcgtagcctggaactacgggctggcggcggcgggcacatttattaccttgctaccgttgttaagccttccggcgttgccaccaccgccgcagccgcgtgagcatccgttgaaatcattactggcaggatttcgttttctactcgccagcccgctggtgggagggattgcgttgctggggggtttattgacgatggcgagcgcggtgcgggtactgtatccggcgctggctgacaactggcagatgtcggcggcgcaaattggctttctctatgcggcaatcccgctcggtgcggctattggcgcgttaaccagtggaaaactggcgcatagcgtacggccaggtctgttgatgttgctctccacattgggggcgttcctcgccattggtctgtttggcctgatgccgatgtggattttaggcgtggtttgtctggcgctgttcggctggctgagcgcggttagttcgttgctgcaatatacaatgctgcaaacgcaaaccccggaagcgatgttagggcggattaacggtttgtggacggcgcaaaacgtgacgggcgatgccataggcgcggcgctgctgggcggtttgggagcgatgatgacaccggttgcttccgcaagcgcgagcggttttggtttgttgattatcggcgtgttgttgctgctggtgctggtggagttgcgacgttttcgccagacgccgccgcaggtgacagcgtccgacagttaa

SEQ ID NO: 1432 - protein, 416 aa, Escherichia coli
MNKQSWLLNLSLLKTHPAFRAVFLARFISIVSLGLLGVAVPVQIQMMTHSTWQVGLSVTLTGGAMFVGLMVGGVLADRYERKKVILLARGTCGIGFIGLCLNALLPEPSLLAIYLLGLWDGFFASLGVTALLAATPALVGRENLMQAGAITMLTVRLGSVISPMIGGLLLATGGVAWNYGLAAAGTFITLLPLLSLPALPPPPQPREHPLKSLLAGFRFLLASPLVGGIALLGGLLTMASAVRVLYPALADNWQMSAAQIGFLYAAIPLGAAIGALTSGKLAHSVRPGLLMLLSTLGAFLAIGLFGLMPMWILGVVCLALFGWLSAVSSLLQYTMLQTQTPEAMLGRINGLWTAQNVTGDAIGAALLGGLGAMMTPVASASASGFGLLIIGVLLLLVLVELRRFRQTPPQVTASDS

SEQ ID NO: 1433 - DNA, 957 bp, Escherichia coli
gtgagactcgccccgctctaccgcaacgcccttctattaacaggacttttgctttcaggaatagccgcagttcaggccgccgactggccgcgtcagattactgacagccgtggcactcataccctggaaagccagccgcagcgtatagtttccaccagcgtcaccctgaccggctcactgctggcgattgatgctccggtgatcgccagcggcgcgaccacgccaaataaccgcgtcgcggatgaccagggctttttacgccagtggagcaaggtggcgaaagaacgcaaactgcaacggctctatatcggcgaaccgagtgcagaagccgttgccgcgcaaatgccggatctgattttaattagcgcaaccggcggcgattcggcgctggcgctgtacgatcagctttctaccatcgccccaacattaatcatcaattacgacgacaaaagctggcagtcgctgttaacgcagcttggcgaaattaccgggcatgagaaacaagcggcagagcggattgcacagtttgataagcaactggcggcggcgaaagagcaaatcaaattaccgccgcagccggtcactgccatcgtctataccgccgctgcacacagtgccaatctctggacgccggaatcagcacaagggcagatgctggaacaactcggctttacgctggcgaagttgcccgcaggcttaaacgccagccaaagccagggcaaacgccatgacatcattcagcttggtggagaaaatctggctgcagggttaaatggcgagtcactattcctgttcgccggtgatcagaaagacgccgatgctatttatgctaatccgctgctcgcgcacctgcctgcagtacaaaacaagcaggtttatgcgctgggaaccgagacgttccgcctggattactacagcgccatgcaagtgctggatagacttaaggcgctgttttaa

SEQ ID NO: 1434 - protein, 318 aa, Escherichia coli
MRLAPLYRNALLLTGLLLSGIAAVQAADWPRQITDSRGTHTLESQPQRIVSTSVTLTGSLLAIDAPVIASGATTPNNRVADDQGFLRQWSKVAKERKLQRLYIGEPSAEAVAAQMPDLILISATGGDSALALYDQLSTIAPTLIINYDDKSWQSLLTQLGEITGHEKQAAERIAQFDKQLAAAKEQIKLPPQPVTAIVYTAAAHSANLWTPESAQGQMLEQLGFTLAKLPAGLNASQSQGKRHDIIQLGGENLAAGLNGESLFLFAGDQKDADAIYANPLLAHLPAVQNKQVYALGTETFRLDYYSAMQVLDRLKALF

SEQ ID NO: 1435 - DNA, 1176 bp, Escherichia coli
atggatacgtcactggctgaggaagtacagcagaccatggcaacacttgcgcccaatcgctttttctttatgtcgccgtaccgcagttttacgacgtcaggatgtttcgcccgcttcgatgaaccggctgtgaacggggattcgcccgacagtcccttccagcaaaaactcgccgcgttgtttgccgatgccaaagcgcagggcatcaaaaatccggtgatggtcggggcgattcccttcgatccacgtcagccttcgtcgctgtatatacctgaatcctggcagtcgttctcccgtcaggaaaaacaagcttccgcacgccgtttcacccgcagccagtcgctgaacgtggtggaacgtcaggccattccggaacaaaccacgtttgaacagatggttgcccgtgctgccgcacttaccgccacgccgcaggtcgacaaagtggtgttgtcacggttgattgatatcactactgacgccgccattgatagtggcgtattgctggaacggttgattgcgcaaaacccggttagttacaacttccatgttccgttggctgatggtggcgttctgctgggggccagcccggaactgctgctacgtaaagacggcgagcgttttagctccattccgttagccggttccgcgcgtcgtcagccggatgaagtgctcgatcgcgaagcgggtaatcgtctgctggcgtcagaaaaagatcgccatgaacatgaactggtgactcaggcgatgaaagaggtactgcgcaaacgcagtagtgagttacacgttccctcctctccacaattgattaccacgccgacgctgtggcatctcgcaactccctttgaaggtaaagcgaattcgcaagaaaacgcactgactttggcttgtctgctgcatccgacccccgcgctgagcggtttcccgcatcaggccgcgactcaggttattgctgaactggagccgttcgaccgcgaactgtttggcggcattgtgggttggtgtgacagcgaaggtaacggtgaatgggtggtgaccatccgctgcgcgaagctgcgggaaaatcaggtgcgtctgtttgccggagcggggattgtgcctgcgtcctccccgttgggtgagtggcgcgaaacgggcgtcaaactttctaccatgttgaacgtttttggattgcattaa

SEQ ID NO: 1436 - protein, 391 aa, Escherichia coli
MDTSLAEEVQQTMATLAPNRFFFMSPYRSFTTSGCFARFDEPAVNGDSPDSPFQQKLAALFADAKAQGIKNPVMVGAIPFDPRQPSSLYIPESWQSFSRQEKQASARRFTRSQSLNVVERQAIPEQTTFEQMVARAAALTATPQVDKVVLSRLIDITTDAAIDSGVLLERLIAQNPVSYNFHVPLADGGVLLGASPELLLRKDGERFSSIPLAGSARRQPDEVLDREAGNRLLASEKDRHEHELVTQAMKEVLRKRSSELHVPSSPQLITTPTLWHLATPFEGKANSQENALTLACLLHPTPALSGFPHQAATQVIAELEPFDRELFGGIVGWCDSEGNGEWVVTIRCAKLRENQVRLFAGAGIVPASSPLGEWRETGVKLSTMLNVFGLH

SEQ ID NO: 1437 - DNA, 1611 bp, Escherichia coli
atgagcattccattcacccgctggccggaagagtttgcccgtcgctatcgggaaaaaggctactggcaggatttgccactgaccgacattctgactcgccacgctgcgagtgacagcatcgcggttatcgacggcgagcggcagttgagttatcgggagctgaatcaggcggcggataacctcgcctgtagtttgcgccgtcagggcattaaacctggtgaaaccgcgctggtacaactgggtaacgtcgctgaactttacattacctttttcgcgctgctgaaactgggcgttgcgccggtgctggcgctgttcagccatcagcgtagtgaactgaacgcctatgccagccagattgaaccggcgttactgattgccgatcgccaacatgcgctatttagcggggatgatttcctcaacacatttgttgcagagcattcttccattcgcgtggtgcagctgctcaacgacagcggcgagcataacttgcaggatgcgattaaccatccggctgaggattttactgccacgccgtcacctgccgatgaagtggcctattttcagctttccggcggcaccaccggcacaccgaaactgatcccgcgcactcataacgactactactacagcgtgcgtcgtagcgtcgagatttgtcagttcacacaacagacgcgctacctgtgcgcgatcccggcggctcataactacgccatgagttcaccgggatcgttgggggtatttctcgctggcggcactgtcgttctggctgccgaccccagcgccacgctttgcttcccattgattgaaaaacatcaggtgaacgtcaccgcgctggtgccgccagcagtcagcctgtggttgcaggcactggctgaaggcgaaagccgggcgcagcttgcctcgctgaaactgttacaggtcggcggcgcccgtctttctgccacccttgcggcgcgtattcccgctgagattggctgtcagttgcagcaggtgtttggcatggcggaagggctggtgaactacacccgtcttgatgatagtgcggagaaaattatccatacccagggttacccaatgtgcccggacgatgaagtatgggttgccgatgccgaaggaaatccactgccgcaaggggaagttggacgcctgatgacgcgcgggccgtacaccttccgtggctattacaaaagcccgcagcacaatgccagcgcctttgatgccaacggtttttactgttccggcgatctgatctctattgatccagagggttacatcactgtgcaggggcgcgagaaagatcagatcaaccgtggcggcgagaagatcgctgccgaagagatcgaaaaccagctgctgcgccatccggcggtgatctacgccgcactggtgagcatggaagatgagctgatgggcgaaaaaagctgtgcttatctggtggtaaaagagccgctgcgcgcggtgcaggtgcgtcgtttcctgcgtgaacagggtattgccgaatttaaattaccggatcgcgtggagtgtgtagattcacttccgctgacggcggtcgggaaagtcgataaaaaacaattacgtcagtggctggcgtcacgcacatcagcctga

SEQ ID NO: 1438 - protein, 536 aa, Escherichia coli
MSIPFTRWPEEFARRYREKGYWQDLPLTDILTRHAASDSIAVIDGERQLSYRELNQAADNLACSLRRQGIKPGETALVQLGNVAELYITFFALLKLGVAPVLALFSHQRSELNAYASQIEPALLIADRQHALFSGDDFLNTFVAEHSSIRVVQLLNDSGEHNLQDAINHPAEDFTATPSPADEVAYFQLSGGTTGTPKLIPRTHNDYYYSVRRSVEICQFTQQTRYLCAIPAAHNYAMSSPGSLGVFLAGGTVVLAADPSATLCFPLIEKHQVNVTALVPPAVSLWLQALAEGESRAQLASLKLLQVGGARLSATLAARIPAEIGCQLQQVFGMAEGLVNYTRLDDSAEKIIHTQGYPMCPDDEVWVADAEGNPLPQGEVGRLMTRGPYTFRGYYKSPQHNASAFDANGFYCSGDLISIDPEGYITVQGREKDQINRGGEKIAAEEIENQLLRHPAVIYAALVSMEDELMGEKSCAYLVVKEPLRAVQVRRFLREQGIAEFKLPDRVECVDSLPLTAVGKVDKKQLRQWLASRTSA

SEQ ID NO: 1439 - DNA, 858 bp, Escherichia coli
atggctattccaaaattacaggcttacgcactgccggagtctcatgatattccgcagaataaagtcgactgggcctttgaaccgcaacgtgccgcgttgttaatccatgatatgcaggactattttgtcagcttctggggtgagaactgcccgatgatggagcaggtgatcgcgaatattgcggcactacgcgactactgcaaacagcacaatatcccggtttattacaccgcccagccgaaagagcagagcgatgaagatcgggcgctgttgaatgatatgtgggggcctggcctgacccgttcgccggaacagcaaaaggtggtggatcgcctgacgccagatgccgacgacacggtgctggtgaaatggcgctacagcgcatttcatcgttctccgctggagcaaatgctcaaagagagtggacgtaaccagctgattattaccggggtatatgcccacattggctgtatgaccaccgcaacggacgcatttatgcgcgatattaaaccgtttatggtggcggatgcgctggccgatttcagccgtgacgagcatttgatgtcgctgaaatatgtggccggacgttctggtcgggtggtgatgaccgaagaattgctgccagcacctatccccgccagcaaagcggcgctgcgtgaggtgatcctgccgttgctggacgagtccgatgaacccttcgatgacgacaacctgatcgactacggtctggattcggtgcggatgatggcgctggcggcgcgctggcgcaaagtgcatggcgatatcgactttgtcatgctggcgaaaaacccgaccatcgacgcctggtggaagctactctcccgcgaggtgaaataa

SEQ ID NO: 1440 - protein, 285 aa, Escherichia coli
MAIPKLQAYALPESHDIPQNKVDWAFEPQRAALLIHDMQDYFVSFWGENCPMMEQVIANIAALRDYCKQHNIPVYYTAQPKEQSDEDRALLNDMWGPGLTRSPEQQKVVDRLTPDADDTVLVKWRYSAFHRSPLEQMLKESGRNQLIITGVYAHIGCMTTATDAFMRDIKPFMVADALADFSRDEHLMSLKYVAGRSGRVVMTEELLPAPIPASKAALREVILPLLDESDEPFDDDNLIDYGLDSVRMMALAARWRKVHGDIDFVMLAKNPTIDAWWKLLSREVK

SEQ ID NO: 1441 - DNA, 747 bp, Escherichia coli
atggatttcagcggtaaaaatgtctggataactggcgcggggaaaggtatcggctatgccacggcgctggcatttgttgaggcgggggcgaaagttacaggttttgatcaagcgtttactcaggagcaatatccttttgcgaccgaagtaatggatgttgccgatgctgcgcaggtggcgcaggtatgtcagcgactgttagctgaaacggagcgactggacgtgctggtcaatgcggcgggaattttgcgcatgggcgcgaccgatcagctcagtaaagaggactggcagcagacttttgcggtcaacgtcggcggtgcatttaacctgtttcagcagaccatgaaccagtttcgccgtcagcggggcggggcgattgttactgttgcgtccgacgccgcacacacgccgcgcattggtatgagtgcttatggcgcgtcgaaagcggcgctgaaaagcctggcgttgagcgtcgggctggaactggcgggtagcggcgtgcgctgtaatgtggtttcgccgggctccaccgacactgatatgcaacgcacgctgtgggtgagcgatgacgccgaagagcagcgtattcgcggctttggcgagcagtttaaactcggcattccgctggggaaaatcgcccgtccgcaggagattgccaatacgattttgttcctcgcctctgacctcgccagccatattaccctacaggatattgtggtcgatggcggctcaacgctgggggcataa

SEQ ID NO: 1442 - protein, 248 aa, Escherichia coli
MDFSGKNVWITGAGKGIGYATALAFVEAGAKVTGFDQAFTQEQYPFATEVMDVADAAQVAQVCQRLLAETERLDVLVNAAGILRMGATDQLSKEDWQQTFAVNVGGAFNLFQQTMNQFRRQRGGAIVTVASDAAHTPRIGMSAYGASKAALKSLALSVGLELAGSGVRCNVVSPGSTDTDMQRTLWVSDDAEEQRIRGFGEQFKLGIPLGKIARPQEIANTILFLASDLASHITLQDIVVDGGSTLGA

SEQ ID NO: 1443 - DNA, 414 bp, Escherichia coli
atgatctggaaacgccatttaacgctcgacgagctgaacgccaccagcgataacacaatggtggcgcatctgggaattgtgtatacccgtctgggcgatgatgtactcgaagccgaaatgccggttgatacccgtactcatcagccgtttggcctgctgcatggcggcgcgtcggcggcgctggcggaaacgctgggatcgatggccggatttatgatgacccgcgacggacagtgtgtggtgggcacggaacttaacgccacacatcatcgcccggtgtctgagggaaaggtgcgcggtgtctgccagccgctgcatcttggacgacaaaatcagagctgggaaatcgtcgttttcgatgaacaggggcggcgttgctgcacctgtcggctgggcacagcggttttgggatga

SEQ ID NO: 1444 - protein, 137 aa, Escherichia coli
MIWKRHLTLDELNATSDNTMVAHLGIVYTRLGDDVLEAEMPVDTRTHQPFGLLHGGASAALAETLGSMAGFMMTRDGQCVVGTELNATHHRPVSEGKVRGVCQPLHLGRQNQSWEIVVFDEQGRRCCTCRLGTAVLG

SEQ ID NO: 1445 - DNA, 2106 bp, Escherichia coli
atgaacaaatcagggaaatacctcgtctggacagtgctctctgtaatgggagcatttgctctgggatacattgctttaaatcgtggggaacagatcaacgcgctgtggattgtggtggcgtcggtctgtatctatctgatcgcttaccgtttttatgggctgtatatcgccaaaaatgtgctggcggttgacccgacgcgtatgacgccagcggtgcgccataacgacgggctggactatgtgccgacggacaaaaaagtgctgttcggtcaccattttgcggccattgccggagcaggtccgttggttgggccggtactggcggcgcaaatgggttacctgccagggatgatctggctgctcgcaggggtggttctcgccggtgcggtgcaggatttcatggtgctgtttgtttccacgcgccgtgacggtcgctcgctgggtgagctggtcaaagaagagatggggccaaccgccggggtgatagcgctggtggcctgctttatgatcatggtcattatccttgccgtgctggcgatgatcgtggttaaagccctgactcatagcccgtggggaacgtataccgttgcgttcaccattccgctggcgctgtttatggggatctacttgcgttatctgcgtccggggcgtattggcgaagtgtcggtgattggtctggtgttcctgattttcgccattatctctggcggctgggtggcagaaagtccgacctgggcaccgtactttgactttaccggcgtgcagctgacctggatgctggtgggttacggttttgtggcggcggtgctgccggtgtggttgctgctggctccgcgtgactacctctcaaccttcctgaaaatcgggactatcgtcggtctggcggtgggcattttgattatgcgcccgacgctgaccatgcctgcgctaactaaatttgtcgatggcactggcccggtatggaccggtaacctgttcccgttcctgtttatcaccatcgcctgtggcgcggtgtctggcttccatgcgctgatctcttccggcactacaccgaagatgctggcgaacgaagggcaggcgtgctttatcggctacggtgggatgttgatggaatccttcgtggcgattatggcgctggtttccgcctgtatcatcgatccgggtgtgtacttcgccatgaacagcccgatggcggtgctggctccggcagggacggcggatgtggttgcttctgccgcgcaggtggtgagtagctggggctttgcgattaccccggatacgctaaaccagattgccagcgaagtgggtgaacagtcgatcatttctcgtgcgggcggtgcgccgaccctggcggtggggatggcctacattctgcacggtgcgctgggcggcatgatggatgtggcgttctggtatcacttcgccattctgtttgaagcactgtttattcttacggcggtggatgcgggtacgcgtgctgcgcgctttatgttgcaggatctgctgggcgtggtgtctccgggcctgaaacggaccgattcactgcctgctaacctgctggcaacggcgctgtgcgtgctggcgtggggctacttcctgcatcagggcgtggtcgatccgctgggcggtattaacaccttgtggccgctgtttggtattgccaaccagatgctggcagggatggcgctgatgctttgtgctgtggtgctgttcaaaatgaaacgtcaacgttacgcctgggtggcgctggtaccaacggcctggctgctgatttgtaccttgaccgcaggctggcagaaagcgtttagcccggatgcgaaagtcggcttcctggcgattgctaacaagttccaggcaatgatcgacagcggcaatattccatcgcagtatactgagtcacaactggcgcaactggtgttcaacaaccgtcttgatgccgggttaaccatcttctttatggtggtcgtggtggttctggcgctgttctcgattaagacggcactggcggcattgaaagagccgaagccaacggcgaaagaaacgccatatgagccgatgccggaaaatgtcgaggagatcgtggcgcaggcgaaaggcgcgcactaa

SEQ ID NO: 1446 - protein, 701 aa, Escherichia coli
MNKSGKYLVWTVLSVMGAFALGYIALNRGEQINALWIVVASVCIYLIAYRFYGLYIAKNVLAVDPTRMTPAVRHNDGLDYVPTDKKVLFGHHFAAIAGAGPLVGPVLAAQMGYLPGMIWLLAGVVLAGAVQDFMVLFVSTRRDGRSLGELVKEEMGPTAGVIALVACFMIMVIILAVLAMIVVKALTHSPWGTYTVAFTIPLALFMGIYLRYLRPGRIGEVSVIGLVFLIFAIISGGWVAESPTWAPYFDFTGVQLTWMLVGYGFVAAVLPVWLLLAPRDYLSTFLKIGTIVGLAVGILIMRPTLTMPALTKFVDGTGPVWTGNLFPFLFITIACGAVSGFHALISSGTTPKMLANEGQACFIGYGGMLMESFVAIMALVSACIIDPGVYFAMNSPMAVLAPAGTADVVASAAQVVSSWGFAITPDTLNQIASEVGEQSIISRAGGAPTLAVGMAYILHGALGGMMDVAFWYHFAILFEALFILTAVDAGTRAARFMLQDLLGVVSPGLKRTDSLPANLLATALCVLAWGYFLHQGVVDPLGGINTLWPLFGIANQMLAGMALMLCAVVLFKMKRQRYAWVALVPTAWLLICTLTAGWQKAFSPDAKVGFLAIANKFQAMIDSGNIPSQYTESQLAQLVFNNRLDAGLTIFFMVVVVVLALFSIKTALAALKEPKPTAKETPYEPMPENVEEIVAQAKGAH

SEQ ID NO: 1447 - DNA, 198 bp, Escherichia coli
atgtttgattcactggcaaaagccggaaaatatttaggtcaggcggcgaaactgatgattggtatgcctgattacgacaactatgtcgaacatatgcgggttaaccatcccgatcaaacgccgatgacctacgaggagtttttccgtgagcggcaggacgcgcgctacggtggaaaaggcggcgcgcgctgctgctaa

SEQ ID NO: 1448 - protein, 65 aa, Escherichia coli
MFDSLAKAGKYLGQAAKLMIGMPDYDNYVEHMRVNHPDQTPMTYEEFFRERQDARYGGKGGARCC

SEQ ID NO: 1449 - DNA, 1089 bp, Escherichia coli
atgcctcacaatcctatccgcgtggtagtcggcccggctaactacttttcacatcccggaagtttcaatcacctgcacgattttttcactgatgaacaactttctcgcgcggtgtggatctacggcgaacgcgccattgctgcggcacaaaccaaactgccgccagcgtttgaactgccaggggtaaagcatattttgtttcgcggccattgcagcgaaagcgatgtacaacaactggcggctgagtccggtgacgatcgcagcgtggtgattggcgtcggcggcggcgcactgctcgacaccgcaaaagccctcgcccgccgtctcggtctgccgtttgttgccgttccgacgatcgccgccacctgcgccgcctggacaccgctctccgtctggtataacgatgccggacaggcgctgcattatgagattttcgacgacgccaattttatggtgctgctggagccagagattatcctcaatgcgccgcaagaatatctgctggcggggatcggtgacacgctggcgaaatggtatgaagcggtggtgctggctccgcaaccagaaacgttgccactaaccgtgcggctgggaatcaataatgcgcaggccattcgcgacgtcttgttaaacagtagcgaacaggcgcttgccgatcagcaaaatcagcaattaacgcaatcattttgcgatgtggtggatgccattattgctggtggtgggatggtcggtggtctgggcgatcgttttacgcgtgtggcggcggcccatgccgtgcataacggtcttaccgttttgccacaaaccgagaagtttctccacggcaccaaagtcgcctacggaattctggtgcaaagcgccttgctgggtcaggatgatgtgctggcgcaattaaccggggcgtatcagcgttttcatctgccgactacgctggcggagctggaagtggatatcaataatcaggtggagatcgacaaaatgattgcccacaccctacgtccggtggaatccattcattacctgccagtcacgctgacaccagataccttgcgtgcagcgttcgaaaaagtggaatcgtttaaagcctga

SEQ ID NO: 1450 - protein, 362 aa, Escherichia coli
MPHNPIRVVVGPANYFSHPGSFNHLHDFFTDEQLSRAVWIYGERAIAAAQTKLPPAFELPGVKHILFRGHCSESDVQQLAAESGDDRSVVIGVGGGALLDTAKALARRLGLPFVAVPTIAATCAAWTPLSVWYNDAGQALHYEIFDDANFMVLLEPEIILNAPQEYLLAGIGDTLAKWYEAVVLAPQPETLPLTVRLGINNAQAIRDVLLNSSEQALADQQNQQLTQSFCDVVDAIIAGGGMVGGLGDRFTRVAAAHAVHNGLTVLPQTEKFLHGTKVAYGILVQSALLGQDDVLAQLTGAYQRFHLPTTLAELEVDINNQVEIDKMIAHTLRPVESIHYLPVTLTPDTLRAAFEKVESFKA

SEQ ID NO: 1451 - DNA, 1209 bp, Escherichia coli
gtgccttcaacacgcaaccaacacgcaacttcgtcaggtacaataaaaatgacaaataaccctctgattccacaaagcaaacttccacaacttggcaccactattttcacccggatgagcgcgctggcgcagcaacaccaggcgattaacctttcgcaaggctttcctgattttgatggtccgcgctatttacaggagcggctggcgtaccacgttgcccagggggcaaaccaatacgcgcccatgaccggcgtgcaggccttgcgcgaggcgattgctcagaaaacggaacgtctgtatggctatcaaccggatgtcgacagcaatatcaccgtgacggcaggggcgacggaggcgttatacgcggcgataaccgcattggtgcgcaatggcgacgaagtgatttgttttgatcccagctatgacagttacgcccccgccatcgcactttcggggggaatagtgaaacgtattgcactgcaaccgccgcattttcgcgttgactggcaggaatttgccgcattgttaagcgagcgcacccgactggtgatcctcaacaccccgcataaccccagtgcaactgtctggcagcagactgatttcgccgctctgtggcaggcgatcgccgggcacgagatttttgtcattagcgatgaagtctacgagcacatcaatttttcacaacagggccatgccagcgtgctggcgcatccgcaattgcgtgagcgagcggtggcggtgtcatcgtttggcaagacctatcatatgaccggctggaaagtgggttattgcgttgcgcctgcgcccatcagcgccgagatccgcaaagtgcatcagtatctgaccttttcggtgaataccccggcacaactggcgcttgccgatatgctacgtgcagaacctgagcattatcttgcgttaccggacttttatcgccagaagcgcgatattctggtgaatgccttaaatgaaagtcggctggagattttaccgtgcgaaggtacatactttttgctggtggattacagcgccgtatctacgatggatgatgttgagttttgccagtggctgacgcgggagcacggtgtagcggcgattccgctgtcggtgttttgcgccgatcccttcccacataaactgattcgtctctgttttgccaagaaggaatcgacgttgctggcagcagcagaacgcctgcgccagctgtag

SEQ ID NO: 1452 - protein, 402 aa, Escherichia coli
MPSTRNQHATSSGTIKMTNNPLIPQSKLPQLGTTIFTRMSALAQQHQAINLSQGFPDFDGPRYLQERLAYHVAQGANQYAPMTGVQALREAIAQKTERLYGYQPDVDSNITVTAGATEALYAAITALVRNGDEVICFDPSYDSYAPAIALSGGIVKRIALQPPHFRVDWQEFAALLSERTRLVILNTPHNPSATVWQQTDFAALWQAIAGHEIFVISDEVYEHINFSQQGHASVLAHPQLRERAVAVSSFGKTYHMTGWKVGYCVAPAPISAEIRKVHQYLTFSVNTPAQLALADMLRAEPEHYLALPDFYRQKRDILVNALNESRLEILPCEGTYFLLVDYSAVSTMDDVEFCQWLTREHGVAAIPLSVFCADPFPHKLIRLCFAKKESTLLAAAERLRQL

SEQ ID NO: 1453 - DNA, 618 bp, Escherichia coli
atgcaacaacgattaacgcaggatttaacccaatttctcgccagcttgccggaagatgatcgcatcaaagcgattaatgaaatccgcatggcgatccatcaggttagcccctttcgtgaagagccagtggattgcgttctgtgggttaaaaacagccaacttatgcctaatgattacaacccaaacaacgtggcaccacccgaaaaaaaactgctgaaaaaatccattgaaatagatggttttacccaacccattgtggtcacgcatacggataaaaatgctctggaaatcgtggatggttttcaccgccatgaaattggtaaaggctcatcatcgttaaaattacgcttaaaaggttatttgccggtgacctgtctggaaggtacgcgtaatcaacgcatcgccgcgactattcgtcataatcgcgctcgtggacgtcaccaaatcactgccatgtcagaaatcgtccgagaactcagccagttgggatgggacgataataaaataggcaaagagctgggaatggacagcgacgaagtgttacgcctgaagcaaattaacggcctgcaagagttgtttgccgaccgtcaattttcccgcgcctggacggttaaataa

SEQ ID NO: 1454 - protein, 205 aa, Escherichia coli
MQQRLTQDLTQFLASLPEDDRIKAINEIRMAIHQVSPFREEPVDCVLWVKNSQLMPNDYNPNNVAPPEKKLLKKSIEIDGFTQPIVVTHTDKNALEIVDGFHRHEIGKGSSSLKLRLKGYLPVTCLEGTRNQRIAATIRHNRARGRHQITAMSEIVRELSQLGWDDNKIGKELGMDSDEVLRLKQINGLQELFADRQFSRAWTVK

SEQ ID NO: 1455 - DNA, 1221 bp, Escherichia coli
atgtctatttataaaatcccgcttccactgaatattctggaagctgcaaaagaacgtattacctggacacttaataccctaccccgtatctgtgtttctttttcgggtggtaaagattccggattaatgctgcatctgacagctgaaattgcccgacaaatgggcaaaaaaatctgcgttttgtttatcgactgggaagcgcagttctcatgcactattaactatgttcagtcattacgtgagttttacgccgatgtcatcgaagagttttactgggttgcgctcccgcttacgacgcaaaattccctttctcaataccaacccgaatggcagtgctgggaacctgatgtcgaatgggtgcgtcagcccccgcaagatgcgataaccgatcctgactttttctccttttaccagcctggtatgaccttcgaacaatttgtgcgtgagtttgccgaatggttttcgcaaaagcgtccggcggcgatgatgatcggcatccgtgcagatgagtcctacaaccgttttgtcgccatcgccagtttaaataaacaacgttttgccgatgataaaccctggaccaccgccgcaccaggcggtcatagctggtacatttaccccatctacgactggaaagtggctgatatctggacctggtatgctaaccatcaacagctctgtaacccactgtataatataatgtatcaggcaggcgttcctctgcgtcatatgcgaatttgcgaaccttttggcccggagcaacggcaaggattatggctctatcacgttatcgaaccggatcgctgggctgctatgtgcgcacgagtcagcggggtaaaaagtggcggcatttacgccggacatgataatcatttttatggtcatcggaaaatcctcaagccagaacatttagactggcaagaatatgcattattgctgctcaatagcatgccggaaaaaacagctgagcattaccgcaataaaatcgccatttatttgcactggtatcagaaaaaaggcatcgaagttccacaaacccagcaaggggacattggcgcgaaagatatcccctcctggcggcgaatatgcaaagttttactcaataacgattactggtgccgggcattatcatttagtcctacgaaagcgaagaactatcagcgttataacgaacggataaaaggaaaacgtcaggaatgggggatactatgcaacaacgattaa

SEQ ID NO: 1456 - protein, 406 aa, Escherichia coli
MSIYKIPLPLNILEAAKERITWTLNTLPRICVSFSGGKDSGLMLHLTAEIARQMGKKICVLFIDWEAQFSCTINYVQSLREFYADVIEEFYWVALPLTTQNSLSQYQPEWQCWEPDVEWVRQPPQDAITDPDFFSFYQPGMTFEQFVREFAEWFSQKRPAAMMIGIRADESYNRFVAIASLNKQRFADDKPWTTAAPGGHSWYIYPIYDWKVADIWTWYANHQQLCNPLYNIMYQAGVPLRHMRICEPFGPEQRQGLWLYHVIEPDRWAAMCARVSGVKSGGIYAGHDNHFYGHRKILKPEHLDWQEYALLLLNSMPEKTAEHYRNKIAIYLHWYQKKGIEVPQTQQGDIGAKDIPSWRRICKVLLNNDYWCRALSFSPTKAKNYQRYNERIKGKRQEWGILCNND

SEQ ID NO: 1457 - DNA, 903 bp, Escherichia coli
atggctaatctttatgatctaaaaaaatttgacctcaatttactggtcatatttgaatgtatttatcaacatctcagcattagtaaagcggcagaatcattatatataacgccctctgctgttagtcagtcgttacaacgtttacgtgcgcaatttaatgacccgttattcattcgctcagggaaaggtatcgcgccgactacaacagggttaaacctgcatcaccatcttgagaaaaatctcagaggccttgaacaaacgatcaatatcgttaataagtctgaactaaagaaaaattttattatctacggtcctcagcttatttcttgtactaataacaacatgctaatccgctgtcttagacaagatacttcaatcgatatagaatgccatgacatcctgctttcagctgaaaatgccgaagaactgttggttcaacgcaaaactgacctggcaattacgctgcaaccagtaattagtcgctctgtcatctgcatgccgttacacactattcgcaattcccttatatgtagcaacaaacatcctcgtattactgataccagtaactatgaacaaattatcgccgaagaattcaccctgttgatatctaaatcagcagggattgacgaaattcaaatggacatagatgaacgttttatgaaccgtaaagtttcatttcgcagttcttctttgatgactataattaatagtatttctgttactgacttattaggcattgtgcccaccgaactgtacgatttacatcgtgactttttgaagttaaaagaaataaaactggaacaacctcttcctgcggttaaactttatatttcctataacaaggcttcgttgaacaaccttgtcttctcccgattcatagatcgtttaaatgatagcttctga

SEQ ID NO: 1458 - protein, 300 aa, Escherichia coli
MANLYDLKKFDLNLLVIFECIYQHLSISKAAESLYITPSAVSQSLQRLRAQFNDPLFIRSGKGIAPTTTGLNLHHHLEKNLRGLEQTINIVNKSELKKNFIIYGPQLISCTNNNMLIRCLRQDTSIDIECHDILLSAENAEELLVQRKTDLAITLQPVISRSVICMPLHTIRNSLICSNKHPRITDTSNYEQIIAEEFTLLISKSAGIDEIQMDIDERFMNRKVSFRSSSLMTIINSISVTDLLGIVPTELYDLHRDFLKLKEIKLEQPLPAVKLYISYNKASLNNLVFSRFIDRLNDSF

SEQ ID NO: 1459 - DNA, 807 bp, Escherichia coli
atgacagtgataggttatgccttttactcgacttttgcactgactgaaaaggacaaattaatgttaaaaaagatacttttactggctctgcttcctgcaatcgccttcgcagaggaacttcctgccccagtaaaagcgattgaaaaacagggtattacaatcatcaaaacgttcgatgcccctggaggaatgaaaggttatctcggtaagtatcaggatatgggcgtcaccatctacctgactccagatggtaagcacgctatctctggttacatgtacaacgaaaaaggtgaaaacctgagtaacacgcttatcgaaaaagaaatttacgcacccgccggacgtgaaatgtggcaacggatggaacaatcccactggctcctcgacggtaaaaaagacgcgccggtcattgtctacgtcttcgccgatccgttctgcccatattgtaaacagttctggcagcaggctcgtccgtgggtagattctggcaaagtgcaattgagaacattgttggttggggttatcaagccagaaagcccggcgacagcagcggcaattcttgcctccaaagatcccgcaaaaacctggcaacaatatgaagcctctggtggcaagcttaagctaagcgtgcctgcaaacgtaagcacagagcaaatgaaagtgttaagcgacaacgagaaactcatggacgatctgggggcaaatgtcacaccagctatctattacatgagtaaggaaaataccctgcaacaagccgtcggattacccgatcagaaaacacttaatatcattatggggaataaatag

SEQ ID NO: 1460 - protein, 268 aa, Escherichia coli
MTVIGYAFYSTFALTEKDKLMLKKILLLALLPAIAFAEELPAPVKAIEKQGITIIKTFDAPGGMKGYLGKYQDMGVTIYLTPDGKHAISGYMYNEKGENLSNTLIEKEIYAPAGREMWQRMEQSHWLLDGKKDAPVIVYVFADPFCPYCKQFWQQARPWVDSGKVQLRTLLVGVIKPESPATAAAILASKDPAKTWQQYEASGGKLKLSVPANVSTEQMKVLSDNEKLMDDLGANVTPAIYYMSKENTLQQAVGLPDQKTLNIIMGNK

SEQ ID NO: 1461 - DNA, 564 bp, Escherichia coli
atgtccttgattaacaccaaaattaaaccttttaaaaaccaggcattcaaaaacggcgaattcatcgaaatcaccgaaaaagataccgaaggccgctggagcgtcttcttcttctacccggctgactttactttcgtatgcccgaccgaactgggtgacgttgctgaccattacgaagaattgcagaaactgggcgtagacgtatacgcagtatctaccgatactcacttcacccacaaagcatggcacagcagctctgaaaccatcgctaaaatcaaatatgcgatgatcggcgacccgactggcgccctgacccgtaacttcgacaacatgcgtgaagatgaaggtctggctgaccgtgcgaccttcgttgttgacccgcagggtatcatccaggcaatcgaagttaccgctgaaggcattggccgtgacgcgtctgacctgctgcgtaaaatcaaagcagcacagtacgtagcttctcacccaggtgaagtttgcccggctaaatggaaagaaggtgaagcaactctggctccgtctctggacctggttggtaaaatctaa

SEQ ID NO: 1462 - protein, 187 aa, Escherichia coli
MSLINTKIKPFKNQAFKNGEFIEITEKDTEGRWSVFFFYPADFTFVCPTELGDVADHYEELQKLGVDVYAVSTDTHFTHKAWHSSSETIAKIKYAMIGDPTGALTRNFDNMREDEGLADRATFVVDPQGIIQAIEVTAEGIGRDASDLLRKIKAAQYVASHPGEVCPAKWKEGEATLAPSLDLVGKI

SEQ ID NO: 1463 - DNA, 1566 bp, Escherichia coli
atgctcgacacaaatatgaaaactcaactcaaggcttaccttgagaaattgaccaagcctgttgagttaattgccacgctggatgacagcgctaaatcggcagaaatcaaggaactgttggctgaaatcgcagaactgtcagacaaagtcacctttaaagaagataacagcttgccggtgcgtaagccgtctttcctgatcaccaacccaggttccaaccagggaccacgttttgcaggctccccgctgggccacgagttcacctcgctggtactggcgttgctgtggaccggtggtcatccgtcgaaagaagcgcagtctctgctggagcagattcgccatattgacggtgattttgaattcgaaacctattactcgctctcttgccacaactgcccggacgtggtgcaggcgctgaacctgatgagtgtactgaacccgcgcatcaagcacactgcaattgacggcggcaccttccagaacgaaatcaccgatcgcaacgtgatgggcgttccggcagtgttcgtaaacgggaaagagtttggtcagggccgcatgacgttgactgaaatcgttgccaaaattgatactggtgcggaaaaacgtgcggcagaagagctgaataagcgtgatgcttatgacgtattaatcgttggttccggaccggcgggtgcagcggcagcaatttactccgcacgtaaaggcatccgtaccggtctgatgggcgaacgttttggtggtcagatcctcgataccgttgatatcgaaaactacatttctgtaccgaagaccgaaggccagaaactggcaggtgcgctgaaagttcatgttgatgaatacgacgttgatgtgatcgatagccagagcgcgagcaaactgatcccggcagcggttgaaggcggcctgcatcagattgaaacagcttctggcgcggtactgaaagcacgcagcattatcgtggcgactggtgcaaaatggcgcaacatgaacgttcctggcgaagatcagtatcgcaccaaaggcgtgacctactgcccgcactgcgacggcccgctgtttaaaggcaaacgcgtagcggttatcggcggcggtaactccggcgtggaagcggcaattgacctggcgggtatcgttgagcacgtaacgctgctggaatttgcgccagaaatgaaagccgaccaggttctgcaggacaaactgcgcagcctgaaaaacgtcgacattattctgaatgcgcaaaccacggaagtgaaaggcgacggtagcaaagtcgtaggtctggaatatcgcgatcgtgtcagcggcgatattcacaacatcgaactggccggtattttcgtccagattggtctgctgccgaacaccaactggctggaaggcgcagtcgaacgtaatcgcatgggcgagattatcattgatgcgaaatgcgaaaccaacgtcaaaggcgtgttcgcagcgggtgactgtacgacggttccgtacaagcagatcatcatcgccactggcgaaggtgccaaagcctctctgagtgcttttgactacctgattcgcaccaaaactgcataa

SEQ ID NO: 1464 - protein, 521 aa, Escherichia coli
MLDTNMKTQLKAYLEKLTKPVELIATLDDSAKSAEIKELLAEIAELSDKVTFKEDNSLPVRKPSFLITNPGSNQGPRFAGSPLGHEFTSLVLALLWTGGHPSKEAQSLLEQIRHIDGDFEFETYYSLSCHNCPDVVQALNLMSVLNPRIKHTAIDGGTFQNEITDRNVMGVPAVFVNGKEFGQGRMTLTEIVAKIDTGAEKRAAEELNKRDAYDVLIVGSGPAGAAAAIYSARKGIRTGLMGERFGGQILDTVDIENYISVPKTEGQKLAGALKVHVDEYDVDVIDSQSASKLIPAAVEGGLHQIETASGAVLKARSIIVATGAKWRNMNVPGEDQYRTKGVTYCPHCDGPLFKGKRVAVIGGGNSGVEAAIDLAGIVEHVTLLEFAPEMKADQVLQDKLRSLKNVDIILNAQTTEVKGDGSKVVGLEYRDRVSGDIHNIELAGIFVQIGLLPNTNWLEGAVERNRMGEIIIDAKCETNVKGVFAAGDCTTVPYKQIIIATGEGAKASLSAFDYLIRTKTA

SEQ ID NO: 1465 - DNA, 429 bp, Escherichia coli
atgtacaaaacaatcatcatgccagtggatgttttcgaaatggaattgagcgacaaagcggttcgccacgctgaattcctcgcccaggatgacggagttattcatctacttcacgtactaccggggtcagccagcctgagcctgcaccgttttgccgctgatgtacgtcgttttgaagagcatctgcaacatgaagcagaagaacgtttacaaacgatggtcagccacttcaccatcgatccttcccgcattaagcaacatgtccgttttggtagtgtgcgggatgaagttaacgagttagcgaaagaacttgatgcagatgtagtagtgattggttcgcgtaacccatcaatttcaactcatctgttgggttctaacgcctcgagcgtgatccgccacgccaatttgccggtgctggttgtgcgttaa

SEQ ID NO: 1466 - protein, 142 aa, Escherichia coli
MYKTIIMPVDVFEMELSDKAVRHAEFLAQDDGVIHLLHVLPGSASLSLHRFAADVRRFEEHLQHEAEERLQTMVSHFTIDPSRIKQHVRFGSVRDEVNELAKELDADVVVIGSRNPSISTHLLGSNASSVIRHANLPVLVVR

SEQ ID NO: 1467 - DNA, 411 bp, Escherichia coli
atgtccagaccaactatcatcattaacgacctggatgccgaacgcatcgatattctgctggagcaacccgcctatgctggtttgccaatcgccgacgcgttaaacgcagagttggatcgcgcccaaatgtgttcgccagaagagatgccacacgacgtggtgacaatgaacagccgggttaaattccgcaatcttagcgatggcgaagtgcgtgtgcgcacgctggtgtatccggcaaaaatgaccgacagcaatactcagctttccgttatggctccggtaggtgccgcactgctggggctgcgcgttggcgattccattcactgggaacttccgggcggcgttgcaacccaccttgaagtgctggaactcgaataccagccagaagctgctggcgactacctgctttaa

SEQ ID NO: 1468 - protein, 136 aa, Escherichia coli
MSRPTIIINDLDAERIDILLEQPAYAGLPIADALNAELDRAQMCSPEEMPHDVVTMNSRVKFRNLSDGEVRVRTLVYPAKMTDSNTQLSVMAPVGAALLGLRVGDSIHWELPGGVATHLEVLELEYQPEAAGDYLL

SEQ ID NO: 1469 - DNA, 825 bp, Escherichia coli
atgagttccacacccattatgaaagcattctggcgtaacgccgcgttgctcgcggtttctctgcttcccttctcttctgccaacgccgtggcgttgcaggcaaaacagtatgacgattttgatcgctatgtcctggccctctcatggcaaaccggattttgtcagagtcaatacgaccgaaatcgtaacgaacgagatgaatgtcgcctgcaaaccgaaacgaccaacaaagctgattttttgaccgtacatggtctgtggccaggattgcctaaatcggttgctgcccgtggtgttgatgaacgccgctggatgcgcttcggttgcgctactcgcccaatcccgaatctgccagaagcacgtgccagccggatgtgttcatcgccggaaaccgggttatcactggaaacggcagctaaactaagtgaagtcatgccaggagctggcggacgttcctgcctggaacgctacgaatatgccaaacacggtgcctgctttggttttgatccagacgcatacttcggcacgatggtacgcctgaatcaagaaattaaagagagcgaagccggaaaattccttgcggataattacggtaaaacagtgagccgccgtgactttgacgccgcctttgccaaaagctggggaaaagagaacgtgaaagcagttaagctaacgtgccagggtaaccctgcgtatttgactgaaattcagatctcgatcaaagctgacgccatcaacgctccgctttctgcaaactcattcttgccacaaccacacccaggtaactgtggcaaaacctttgtgattgataaagcaggttattaa

SEQ ID NO: 1470 - protein, 274 aa, Escherichia coli
MSSTPIMKAFWRNAALLAVSLLPFSSANAVALQAKQYDDFDRYVLALSWQTGFCQSQYDRNRNERDECRLQTETTNKADFLTVHGLWPGLPKSVAARGVDERRWMRFGCATRPIPNLPEARASRMCSSPETGLSLETAAKLSEVMPGAGGRSCLERYEYAKHGACFGFDPDAYFGTMVRLNQEIKESEAGKFLADNYGKTVSRRDFDAAFAKSWGKENVKAVKLTCQGNPAYLTEIQISIKADAINAPLSANSFLPQPHPGNCGKTFVIDKAGY

SEQ ID NO: 1471 - DNA, 1464 bp, Escherichia coli
atgtctttagcaaaagataatatatggaaattattggcgcccctggtggtgatgggtgtcatgtttcttatccctgtacctgacggtatgccgccgcaggcgtggcattactttgcagtgtttgtggcaatgattgtcggcatgatcctcgagccaattccggcaacggcgatcagttttattgcggttactatttgcgttattggcagtaattacctgctctttgatgccaaagaattagctgacccagcgtttaatgcgcaaaaacaggcgctgaaatggggtctggctggtttttccagcaccacggtatggctggtatttggcgcatttatttttgcattagggtatgaagtttccgggttaggccgtcgtattgcccttttcctggtgaaattcatgggcaaacgcacgctgacgttgggttatgcgattgtcattatcgacattctgctggcaccgtttacaccgtccaacaccgcgcgtaccgggggtacggtttttccggtcattaaaaacctgccgccgctgtttaaatcattcccgaacgatccgtccgcgcgtcgtattggcggctatttgatgtggatgatggtcattagtaccagtctgagttcgtccatgtttgtcaccggtgcggcaccaaacgtgctgggtctggagttcgtcagcaaaattgccggtatccagattagctggttgcagtggttcctctgcttcctgccggttggggttatcttgcttatcattgcgccgtggctttcctacgtgctgtacaaaccggaaatcacacacagtgaagaagtggcaacctgggcgggtgatgaactaaaaaccatgggtgcgctgacacgcagagagtggacgctgattggccttgtattgctcagcttaggtttgtgggtatttggcagtgaagtcattaatgctactgcggtaggtctgctggcagtttcgctgatgctggcgctgcacgttgtgccgtggaaagacattactcgctataacagcgcatggaacacgctggtcaacctggcaacgctggttgttatggcgaatggtctgacccgttctggctttatcgactggttcgccaacacgatgagtacgcacctggaaggcttctcaccaaacgcaacggtgattgtactggttctggtgttctactttgcccactacctgtttgccagcctgtctgcgcacaccgcaaccatgctgccggttattctggccgtcggtaaagggattccgggcgtaccaatggaacaactgtgtatcctgctggtgctgtctatcggtatcatgggctgtctgacgccttatgcaaccggtcctggggtgattatttacggctgtggctatgtgaaatcaaaagattactggcgtcttggcgcaatcttcggggtgatttacatctctatgctgctgttggttggctggccgattctcgccatgtggaactaa

SEQ ID NO: 1472 - protein, 487 aa, Escherichia coli
MSLAKDNIWKLLAPLVVMGVMFLIPVPDGMPPQAWHYFAVFVAMIVGMILEPIPATAISFIAVTICVIGSNYLLFDAKELADPAFNAQKQALKWGLAGFSSTTVWLVFGAFIFALGYEVSGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGIQISWLQWFLCFLPVGVILLIIAPWLSYVLYKPEITHSEEVATWAGDELKTMGALTRREWTLIGLVLLSLGLWVFGSEVINATAVGLLAVSLMLALHVVPWKDITRYNSAWNTLVNLATLVVMANGLTRSGFIDWFANTMSTHLEGFSPNATVIVLVLVFYFAHYLFASLSAHTATMLPVILAVGKGIPGVPMEQLCILLVLSIGIMGCLTPYATGPGVIIYGCGYVKSKDYWRLGAIFGVIYISMLLLVGWPILAMWN

SEQ ID NO: 1473 - DNA, 879 bp, Escherichia coli
atgtcgatgcctgcaacgtcaactaaaaccacaaagcttgcgacgtcattaatcgatgagtacgccctgctgggctggcgcgccatgctgactgaagtcaatctgtcaccgaaaccaggcctcgtggatcggattaactgcggtgcgcataaagatatggcgctggaagattttcaccgcagcgcgctggcgattcagggctggttaccccgtttcattgaatttggtgcctgtagtgctgaaatggcaccagaagaggtactccacggattacgcccaataggtatggcttgcgaaggtgatatgttccgcgccactgcgggcgtaaacacgcataaaggcagcattttttctttagggctactgtgtgcggcaattggccgtttgcttcaactcaaccagtcggtaacgccaataacaatttgtgcgacggcggcaagtttctgccgtggcctgaccgatcgcgaactgcgtaccaataattcacaactgacggcaggtcaacggttgtaccagcagcttggccttaccggcgcacgcggtgaagccgaagcgggttatccactggtgatcaaccacgccttgccgcattacctcactctgctggatcaggggttagatcctgagctggcattgctcgataccttgctcctactgatggctaccaacggcgataccaacgttgcatcgcgcggtggcgaggggggcctgcgctggctacagcgcgaggcgcaaacattattaaacaatgggggcatccgaacccccgccgatctcgattatctccggcagttcgacagggagtgtatcgaacgaaatatcagtccaggcggcagtgccgacctgctgattcttacctggtttttagcacagatttaa

SEQ ID NO: 1474 - protein, 292 aa, Escherichia coli
MSMPATSTKTTKLATSLIDEYALLGWRAMLTEVNLSPKPGLVDRINCGAHKDMALEDFHRSALAIQGWLPRFIEFGACSAEMAPEEVLHGLRPIGMACEGDMFRATAGVNTHKGSIFSLGLLCAAIGRLLQLNQSVTPITICATAASFCRGLTDRELRTNNSQLTAGQRLYQQLGLTGARGEAEAGYPLVINHALPHYLTLLDQGLDPELALLDTLLLLMATNGDTNVASRGGEGGLRWLQREAQTLLNNGGIRTPADLDYLRQFDRECIERNISPGGSADLLILTWFLAQI

SEQ ID NO: 1475 - DNA, 552 bp, Escherichia coli
atgcacctgcttcctgaattcgccagccaccatgcggtgtcaattcccgagctgctcgtcagccgggatgaaaggcaagcacggcaacacgcctggctcaagcgccatcctgttccactggtctcctttaccgtggttgcgcctgggccgattaaagacagcgaggtcacacgccgaatttttaatcatggcgtgacagccttgcgtgccttagccacaaagcagggctggcaaattcaggagcaggctgcactggtttccgccagcgggccggagggcatgttgagcattgccgccccggctcgcgacctcaagctcgccaccattgagcttgaacatagtcatcctctcgggcggttatgggatatcgatgtcctgacacccgaaggcgacattctctcccgccgcgactattcactgccgcctcgccgctgcctgttgtgcgagcaaagcgcagctgtttgcgcgcgtggaaaaacccatcaactgaccgatttactcaaccgcatggaggcgctgctgaacgatgtcgatgcctgcaacgtcaactaa

SEQ ID NO: 1476 - protein, 183 aa, Escherichia coli
MHLLPEFASHHAVSIPELLVSRDERQARQHAWLKRHPVPLVSFTVVAPGPIKDSEVTRRIFNHGVTALRALATKQGWQIQEQAALVSASGPEGMLSIAAPARDLKLATIELEHSHPLGRLWDIDVLTPEGDILSRRDYSLPPRRCLLCEQSAAVCARGKTHQLTDLLNRMEALLNDVDACNVN

SEQ ID NO: 1477 - DNA, 1575 bp, Escherichia coli
gtgcagaactttccggcatccgcgaagaataaggcaatcaaaatgacgcagaaaattgaacaatctcaacgacaagaacgggtagcggcctggaatcgtcgcgctgaatgcgatcttgccgctttccagaactcgccaaagcaaacctaccaggctgaaaaagcgcgcgatcgcaaactgtgcgccaacctggaagaagcgattcgtcgctctggtttacaggacggcatgacggtttccttccatcacgctttccgtggcggtgacctgaccgtcaatatggtgatggacgtcatcgcgaagatgggctttaaaaacctgactctggcctccagctccctgagtgattgccatgcgccactggtagaacacattcgccagggcgtggttacccgcatttatacctctggcctgcgcggtccactggcggaagaaatctcccgtggtctgctggcggaaccggtgcaaatccactctcacggcggacgtgtgcatctggtacagagcggcgaactgaatatcgatgtggctttcctcggcgtcccgtcctgtgatgaattcggtaatgccaacggctactccggtaaagcctgctgcggctccctcggctatgcaatggttgatgccgacaacgcaaaacaggtcgtgatgcttaccgaagaactgctgccttatccgcataatccggcaagcattgagcaagatcaggttgatctgatcgtcaaagttgatcgcgttggcgatgctgcaaaaatcggcgctggtgctacccgtatgaccactaacccgcgcgaactgcttattgcccgtagcgctgcggatgtgattgttaactctggctacttcaaagaaggtttctccatgcagaccggcaccggcggcgcttcgctggcggtaacccgtttcctggaagacaaaatgcgtagccgcgatattcgcgccgacttcgccctcggcggtattaccgcaacgatggttgatctgcacgaaaaaggtctgatccgcaaactgctggatgtgcagagctttgacagccatgctgcgcaatcgctggcccgtaaccccaatcacatcgaaatcagcgccaaccagtacgctaactgggggtcgaaaggcgcagcggttgatcgtctcgacgtggtggtactgagcgcgctggaaattgacacccagttcaacgttaacgtgctgaccggctctgacggcgtactgcgtggtgcttccggtggtcactgcgataccgcgattgcttctgcgctttccatcatcgtcgcgccgctggtacgcggtcgtattccgacgctggtggataacgtgctgacctgcatcaccccgggctccagtgtcgatattctggtcacagaccacggcatcgctgttaacccggcacgtccggagctggcagaacgtctgcaggaagcggggatcaaagtggtttctattgagtggctgcgtgaacgtgcgcgtctgctgaccggtgaaccacagccgattgaattcaccgaccgcgtcgttgccgttgtgcgttaccgcgatggctcggtgatcgatgttgtgcatcaggtgaaggaataa

SEQ ID NO: 1478 - protein, 524 aa, Escherichia coli
MQNFPASAKNKAIKMTQKIEQSQRQERVAAWNRRAECDLAAFQNSPKQTYQAEKARDRKLCANLEEAIRRSGLQDGMTVSFHHAFRGGDLTVNMVMDVIAKMGFKNLTLASSSLSDCHAPLVEHIRQGVVTRIYTSGLRGPLAEEISRGLLAEPVQIHSHGGRVHLVQSGELNIDVAFLGVPSCDEFGNANGYSGKACCGSLGYAMVDADNAKQVVMLTEELLPYPHNPASIEQDQVDLIVKVDRVGDAAKIGAGATRMTTNPRELLIARSAADVIVNSGYFKEGFSMQTGTGGASLAVTRFLEDKMRSRDIRADFALGGITATMVDLHEKGLIRKLLDVQSFDSHAAQSLARNPNHIEISANQYANWGSKGAAVDRLDVVVLSALEIDTQFNVNVLTGSDGVLRGASGGHCDTAIASALSIIVAPLVRGRIPTLVDNVLTCITPGSSVDILVTDHGIAVNPARPELAERLQEAGIKVVSIEWLRERARLLTGEPQPIEFTDRVVAVVRYRDGSVIDVVHQVKE

SEQ ID NO: 1479 - DNA, 909 bp, Escherichia coli
atgatttccgcttcgctgcaacaacgtaaaactcgcacccgccgcagtatgttgtttgtgcctggtgctaatgccgcgatggtcagcaactccttcatctacccggctgatgccctgatgtttgacctcgaagactccgtagcattgcgtgaaaaagacaccgcccgccgcatggtttaccacgcgctgcaacatccgctttatcgcgatattgaaaccattgtgcgtgtaaacgcgctggattccgaatggggtgttaacgacctggaagccgtcgttcgcggtggtgcggacgttgtgcgtctgccgaaaaccgataccgctcaggatgttctggatatcgaaaaagagatcctgcgtatcgaaaaagcctgtggtcgtgaacccggcagtaccggcctgctggcggcgattgaatctccgctgggcattacccgcgcagtggaaatcgctcacgcttccgagcgtttgatcggtatcgccctcggtgcagaagactatgtgcgcaacctgcgtacagaacgctccccggaaggaactgaactgctgttcgctcgctgctccattttgcaggccgcgcgctctgcgggtattcaggcgttcgataccgtctattccgacgctaacaacgaagccggattcctgcaagaagccgcccacatcaaacagctgggctttgacggcaaatcgctgatcaacccgcgtcagattgatctgctgcacaacctctacgcaccgacccagaaagaagtggatcacgcccgccgcgtcgtagaagccgctgaagccgccgctcgcgaaggcctcggcgtggtttccctgaacggcaagatggtggacggtccggttatcgatcgcgcccgtctggtgctctcccgtgcagaactttccggcatccgcgaagaataa

SEQ ID NO: 1480 - protein, 302 aa, Escherichia coli
MISASLQQRKTRTRRSMLFVPGANAAMVSNSFIYPADALMFDLEDSVALREKDTARRMVYHALQHPLYRDIETIVRVNALDSEWGVNDLEAVVRGGADVVRLPKTDTAQDVLDIEKEILRIEKACGREPGSTGLLAAIESPLGITRAVEIAHASERLIGIALGAEDYVRNLRTERSPEGTELLFARCSILQAARSAGIQAFDTVYSDANNEAGFLQEAAHIKQLGFDGKSLINPRQIDLLHNLYAPTQKEVDHARRVVEAAEAAAREGLGVVSLNGKMVDGPVIDRARLVLSRAELSGIREE

SEQ ID NO: 1481 - DNA, 297 bp, Escherichia coli
atgaaaataaaccagcccgccgttgcaggcacccttgagtctggggatgtgatgatacgcatcgccccactcgatacgcaggatatcgacctgcaaatcaacagcagcgttgagaaacagtttggcgatgcaattcgcaccaccattctggacgttctcgcccgctacaacgtgcgcggcgtacagctgaatgtcgatgacaaaggcgcactggactgcattttacgtgcacgactggaagccctgctggcacgcgccagcggtatcccggctctgccatgggaggattgccaatga

SEQ ID NO: 1482 - protein, 98 aa, Escherichia coli [sequence omitted]

SEQ ID NO: 1483 - DNA, 1146 bp, Escherichia coli
gtgaaaataaaaggttatcaatttgcaacattgaacaacattcgttgcaaatcgataacaacatgcaccttcaggatactatttattatgttcggcaatgatattttcacccgcgtaaaacgttcagaaaataaaaaaatggcggaaatcgcccaattcctgcatgaaaatgatttgagcgttgacaccacagtcgaagtatttattaccgtaacccgcgatgaaaagcttatcgcgtgcggtggaattgccggaaatattattaaatgcgttgctatcagtgaatccgttcgcggtgaaggactggcgctgacattagccactgaactgataaacctcgcctatgagcggcatagcacgcatctgtttatttataccaaaaccgaatacgaggcgctgttccgccagtgcggtttttccacgctgaccagcgtacccggcgtgatggtgctgatggaaaacagcgccacgcgactgaaacgctatgccgaatcgctgaaaaaatttcgtcatccagggaacaagattggctgcattgtgatgaacgccaatccctttacgaatggtcaccgttatctgattcaacaggctgcggcacagtgcgactggttgcatctgtttttagtcaaagaagattcttcacgcttcccctatgaagaccggctggatctggtgttaaaaggcaccgccgatattccacgcctgactgtgcatcgcggctccgaatacatcatctcccgcgctacgttcccttgctacttcattaaagaacagagcgtcattaaccattgttacaccgaaattgatctgaagattttccgtcagtacctcgctcccgcgctgggtgtaactcaccgctttgtcggtactgaacccttttgtcgcgttaccgcccagtacaaccaggatatgcgctactggctggaaacgccgactatctccgcaccgcccatcgaactggttgaaattgagcggctgcgttaccaggagatgccgatatccgcttcccgggtacgtcaactgctggcgaaaaacgatctcacggctatcgcgccgctggtccctgcagtcacgctgcattatttgcagaacctgcttgagcactcccgccaggacgcggcagctcgtcaaaagacccccgcatga

SEQ ID NO: 1484 - protein, 381 aa, Escherichia coli
MKIKGYQFATLNNIRCKSITTCTFRILFIMFGNDIFTRVKRSENKKMAEIAQFLHENDLSVDTTVEVFITVTRDEKLIACGGIAGNIIKCVAISESVRGEGLALTLATELINLAYERHSTHLFIYTKTEYEALFRQCGFSTLTSVPGVMVLMENSATRLKRYAESLKKFRHPGNKIGCIVMNANPFTNGHRYLIQQAAAQCDWLHLFLVKEDSSRFPYEDRLDLVLKGTADIPRLTVHRGSEYIISRATFPCYFIKEQSVINHCYTEIDLKIFRQYLAPALGVTHRFVGTEPFCRVTAQYNQDMRYWLETPTISAPPIELVEIERLRYQEMPISASRVRQLLAKNDLTAIAPLVPAVTLHYLQNLLEHSRQDAAARQKTPA

SEQ ID NO: 1485 - DNA, 1656 bp, Escherichia coli
ttgcagcttaaagagaataaacagtttgcatttttccaaagactggcatttccgctgcgtatctttttgctgattctggtgttctcaatatttgtcattgcagccctggcgcaatattttacagccagttttgaggactatttaacgcttcatgtgcgcgacatggcaatgaatcaggcaaaaattattgcttctaatgacagtatcatcagtgcagtgaaaacgcgtgactacaagaggctggcgaccatcgctgacaaattacaaagagatactgatttcgattatgtggtgattggcgatcggcactcgattcgtctttaccatcctaatccggagaaaattggttatcctatgcagttcaccaaaccgggcgcgctggagaaaggggagagctacttcatcaccgggaaagggtcaattggcatggcgatgcgtgccaaaacgccaatctttgatgacgatggaaaagtcatcggcgtggtgtcgattggctatctggtgagtaaaatcgatagctggcgggctgagtttttattaccgatggcaggcgtgtttgtcgtgctgttagggattttgatgttgctgtcgtggttcctggccgcgcatatccgtcggcagatgatgggcatggagccaaagcaaatcgctcgcgtggtccgtcagcaagaggcgctgtttagttcggtttatgaagggctgattgcggtggatccgcacgggtacattaccgccatcaatcgtaacgcaagaaagatgctggggctgagttcccccggacggcaatggttgggtaaacccattgctgaagtggtcaggcccgccgatttctttaccgaacagattgatgaaaaacgtcaggatgtggtggcgaactttaacggtctgagcgttattgccaaccgggaagctattcgttctggcgatgatttactgggggccattattagctttcgtagtaaagacgaaatttccaccctcaatgcgcaactgacgcaaattaaacaatacgtcgagagccttcgtacattgcgacacgagcatctcaattggatgtcgacgctcaatggtctgttgcagatgaaagagtatgatcgcgtgctggcgatggtgcagggggagtctcaggcccagcaacagcttattgacagcctgcgtgaggcgtttgccgatcgccaggtggcggggctgctttttggtaaagtgcagcgcgcccgcgaactggggctaaaaatggtcatcgtccccggtagccagctttcgcaactgccgccaggactggacagaaccgagtttgcagccattgttggcaatttacttgataacgccttcgaagcaagcctgcgtagcgatgaaggaaacaagatcgttgaattattcctcagcgatgaaggcgatgatgtggtgattgaagtcgccgatcagggctgcggcgttccagagtctctacgagacaaaatatttgagcagggtgtcagtacgcgtgctgacgagcccggtgaacatggcattgggttgtacttgattgccagctacgtaacgcgctgcggtggtgttatcactctcgaagataatgatccctgcggtaccttattttcaatctatattccgaaagtgaaacctaatgacagctccattaaccctattgatcgttga

SEQ ID NO: 1486 - protein, 551 aa, Escherichia coli
MQLKENKQFAFFQRLAFPLRIFLLILVFSIFVIAALAQYFTASFEDYLTLHVRDMAMNQAKIIASNDSIISAVKTRDYKRLATIADKLQRDTDFDYVVIGDRHSIRLYHPNPEKIGYPMQFTKPGALEKGESYFITGKGSIGMAMRAKTPIFDDDGKVIGVVSIGYLVSKIDSWRAEFLLPMAGVFVVLLGILMLLSWFLAAHIRRQMMGMEPKQIARVVRQQEALFSSVYEGLIAVDPHGYITAINRNARKMLGLSSPGRQWLGKPIAEVVRPADFFTEQIDEKRQDVVANFNGLSVIANREAIRSGDDLLGAIISFRSKDEISTLNAQLTQIKQYVESLRTLRHEHLNWMSTLNGLLQMKEYDRVLAMVQGESQAQQQLIDSLREAFADRQVAGLLFGKVQRARELGLKMVIVPGSQLSQLPPGLDRTEFAAIVGNLLDNAFEASLRSDEGNKIVELFLSDEGDDVVIEVADQGCGVPESLRDKIFEQGVSTRADEPGEHGIGLYLIASYVTRCGGVITLEDNDPCGTLFSIYIPKVKPNDSSINPIDR

SEQ ID NO: 1487 - DNA, 681 bp, Escherichia coli
atgacagctccattaaccctattgatcgttgaggacgaaacgccgctggcagagatgcatgcggaatatattcgtcacattcccggattcagtcagatattactggcgggaaacctggcgcaggcccgaatgatgatcgagcgttttaagccggggctaatcttgctcgataactatcttcctgacggtagagggattaatttactgcatgaactggtgcaggcgcattatcccggcgacgtggtgtttaccactgcagccagcgatatggaaacggtgtctgaagccgtacgttgtggtgtatttgattatctcattaagcccattgcctatgaacggttggggcaaacgctaacccgtttccgccagcgtaaacatatgctggaaagtattgatagcgccagccagaagcaaattgatgagatgtttaatgcctatgctcgcggtgaacccaaagacgaactgccgaccggcattgaccccttgacgctaaacgcggtgcgaaaactgttcaaagagcctggtgtgcaacatacggcagaaacggtggcgcaggcactgaccatcagccgcaccactgccaggcgttatcttgaatattgcgccagccgccatctgattattgctgaaattgttcacggcaaagttggcagaccgcaacgcatataccacagtgggtga

SEQ ID NO: 1488 - protein, 226 aa, Escherichia coli
MTAPLTLLIVEDETPLAEMHAEYIRHIPGFSQILLAGNLAQARMMIERFKPGLILLDNYLPDGRGINLLHELVQAHYPGDVVFTTAASDMETVSEAVRCGVFDYLIKPIAYERLGQTLTRFRQRKHMLESIDSASQKQIDEMFNAYARGEPKDELPTGIDPLTLNAVRKLFKEPGVQHTAETVAQALTISRTTARRYLEYCASRHLIIAEIVHGKVGRPQRIYHSG

SEQ ID NO: 1489 - DNA, 1386 bp, Escherichia coli
atgctgacattcattgaactccttattggggttgtggttattgtgggtgtagctcgctacatcattaaagggtattcggccactggcgtgttatttgtcggtggcctgttattgctgattatcagtgccattatggggcacaaagtgttaccgtccagccaggcttcaacaggctacagcgccacggatatcgttgaatacgttaaaatattgctaatgagccgcggtggcgacctcggcatgatgattatgatgctgtgtggctttgccgcttacatgacccatatcggcgcgaatgatatggtggtcaagctggcgtcaaaaccattgcagtatattaactccccttaccttctgatgattgccgcctattttgttgcctgtctgatgtcactggccgtctcttccgcaaccggtctgggtgttttgctgatggcaaccctgtttccggtgatggtaaacgttggtatcagtcgtggcgcagctgctgccatttgtgcctccccggcggcgattattctcgcaccgacttcaggggatgtggtgctggcggcgcaggcttccgaaatgtcgctgattgacttcgccttcaaaacaacgctgcctatctcaattgctgcaattatcggcatggcgatcgcccacttcttctggcaacgttatctggataaaaaagagcacatctctcatgaaatgttagatgtcagtgaaatcaccaccactgcccctgcgttttatgccattttgccgttcacgccgatcatcggagtactgatttttgacggcaaatggggtccgcaattacacatcatcactattctggtgatttgtatgctaattgcctccattctggagttcatccgcagctttaatacccagaaagttttctctggtctggaagtggcttatcgcgggatggcagatgcatttgctaacgtggtgatgctgctggttgccgctggggtattcgctcaggggcttagcaccatcggctttattcaaagtctgatttctatcgctacctcgtttggttcggcgagtatcatcctgatgctggtattggtgatcctgacaatgctggcggcagtcacgaccggttcaggcaatgcgccgttttatgcgtttgttgagatgatcccgaaactggcgcactcctccggcattaacccggcgtatttgactatcccgatgctgcaggcgtcaaacctgggtcgtaccctatcacccgtttctggcgtagtcgttgcggttgccgggatggcgaagatctcgccgtttgaagtcgtaaaacgcacctcggtgccggtgcttgttggtttggtgattgttatcgttgctacagagctgatggtgccaggaacggcagcagcggtcacaggcaagtaa

SEQ ID NO: 1490 - protein, 461 aa, Escherichia coli
MLTFIELLIGVVVIVGVARYIIKGYSATGVLFVGGLLLLIISAIMGHKVLPSSQASTGYSATDIVEYVKILLMSRGGDLGMMIMMLCGFAAYMTHIGANDMVVKLASKPLQYINSPYLLMIAAYFVACLMSLAVSSATGLGVLLMATLFPVMVNVGISRGAAAAICASPAAIILAPTSGDVVLAAQASEMSLIDFAFKTTLPISIAAIIGMAIAHFFWQRYLDKKEHISHEMLDVSEITTTAPAFYAILPFTPIIGVLIFDGKWGPQLHIITILVICMLIASILEFIRSFNTQKVFSGLEVAYRGMADAFANVVMLLVAAGVFAQGLSTIGFIQSLISIATSFGSASIILMLVLVILTMLAAVTTGSGNAPFYAFVEMIPKLAHSSGINPAYLTIPMLQASNLGRTLSPVSGVVVAVAGMAKISPFEVVKRTSVPVLVGLVIVIVATELMVPGTAAAVTGK

SEQ ID NO: 1491 - DNA, 561 bp, Escherichia coli
atgaacgtgagtaaatatgtcgctatatttttctttgtttttattcagttaatcagtgttggtaaagtttttgctaacgctgatgagtggatgacaacgtttagagaaaatattgcacaaacctggcaacagccagaacattatgatttatatattcctgccatcacctggcatgcacgttttgcttacgacaaagaaaaaaccgatcgctataacgagcgaccgtggggcggcggttttggtcagtcgcgttgggatgaaaaaggaaactggcatggcctgtatgccatggcatttaaggactcgtggaacaaatgggaaccgattgccggatacggatgggaaagtaccaggcgaccgctggcggatgaaaattttcatttaggcctgggatttaccgctggcgtaacggcgcgcgataactggaattacatccctcttccggttctactgccattggcctctgtggggtatggccccgcgacgtttcagatgacctacattccgggtacctacaacaatggcaatgtgtactttgcctggatgcgctttcagttttga

SEQ ID NO: 1492 - protein, 186 aa, Escherichia coli
MNVSKYVAIFFFVFIQLISVGKVFANADEWMTTFRENIAQTWQQPEHYDLYIPAITWHARFAYDKEKTDRYNERPWGGGFGQSRWDEKGNWHGLYAMAFKDSWNKWEPIAGYGWESTRRPLADENFHLGLGFTAGVTARDNWNYIPLPVLLPLASVGYGPATFQMTYIPGTYNNGNVYFAWMRFQF

SEQ ID NO: 1493 - DNA, 294 bp, Escherichia coli
ttgcactggacaaagcgtaccacaattggtgtactggtaaccgacacagcatttgtgtctatttttcatgtaaaggtaattttgatgtctaagattaaaggtaacgttaagtggtttaatgagtccaaaggattcggtttcattactccggaagacggcagcaaagacgtgttcgtacacttctctgcaatccagactaatggttttaaaactcttgctgaaggtcagcgcgtagagttcgaaatcactaacggtgccaaaggcccttctgctgcaaacgtaatcgctctgtaa

SEQ ID NO: 1494 - protein, 97 aa, Escherichia coli
MHWTKRTTIGVLVTDTAFVSIFHVKVILMSKIKGNVKWFNESKGFGFITPEDGSKDVFVHFSAIQTNGFKTLAEGQRVEFEITNGAKGPSAANVIAL

SEQ ID NO: 1495 - DNA, 384 bp, Escherichia coli
gtgttacaacttcttttagcagtttttataggcggtggtacgggaagcgtggcgagatggctgttaagtatgcgatttaacccgctgcatcaggcgattccgttggggacgctggcagcaaacctgattggggcattcatcataggaatgggattcgcctggttcagcaggatgacgaacattgatccagtgtggaaagtattaatcaccaccggattttgtggcggtctaacaaccttctcaacattttcggcagaagtggtgtttttgttacaagagggccgctttggctgggcgttactgaacgttttcgtcaatcttttggggtcttttgccatgaccgcactggctttctggctgttttcggcctcaaccgcacactaa

SEQ ID NO: 1496 - protein, 127 aa, Escherichia coli
MLQLLLAVFIGGGTGSVARWLLSMRFNPLHQAIPLGTLAANLIGAFIIGMGFAWFSRMTNIDPVWKVLITTGFCGGLTTFSTFSAEVVFLLQEGRFGWALLNVFVNLLGSFAMTALAFWLFSASTAH

SEQ ID NO: 1497 - DNA, 789 bp, Escherichia coli
atgctggttgccgcaggacagtttgctgttacatctgtgtgggaaaagaacgctgagatttgtggctcgttgatggcgcaggcggcggaaaacgacgtttcgctgtttgtcctgccggaagcattactggcgcgtgatgatcatgatgcagatctatcggttaaatcagcacagctgctggaaggcgaattcctcggacgtttacggcgagaaagtaaacgtaacatgatgacgacaattctgacgattcatgttccttcaacgccggggcgcgcatggaatatgctggtggcgctacaggcaggaaacatcgtcgcccgttatgccaaactgcatctctatgatgcatttgccattcaggaatcacgccatgttgatgccggtaatgaaatagctccgttactggaggtggaagggatgaaggtcggtctgatgacctgttatgacttacgctttccagagctggcgctggcacaggcattacagggagctgaaatcctggtacttcctgccgcctgggttcgtgggccgctcaaagagcatcactggtcaacgttgcttgccgctcgtgcgctggataccacctgttatatggtggcggcgggggagtgcgggaacaaaaatatcgggcaaagccggattatagatccctttggcgtcaccattgcggcagcgtcagaaatgccagcactcattatggcggaagtgacgcccgaacgtgtgcgtcaggtacgcgcgcaactgcccgtcttaaacaaccgtcgctttgcgccgccgcaattattatga

SEQ ID NO: 1498 - protein, 262 aa, Escherichia coli
MLVAAGQFAVTSVWEKNAEICGSLMAQAAENDVSLFVLPEALLARDDHDADLSVKSAQLLEGEFLGRLRRESKRNMMTTILTIHVPSTPGRAWNMLVALQAGNIVARYAKLHLYDAFAIQESRHVDAGNEIAPLLEVEGMKVGLMTCYDLRFPELALAQALQGAEILVLPAAWVRGPLKEHHWSTLLAARALDTTCYMVAAGECGNKNIGQSRIIDPFGVTIAAASEMPALIMAEVTPERVRQVRAQLPVLNNRRFAPPQLL

SEQ ID NO: 1499 - DNA, 204 bp, Escherichia coli
atgggtgagattagtattaccaaactgctggtagttgcggcgctggtcgttctgctgtttgggactaagaagttacgtacgctgggcggagaccttggagcggccattaaagggttcaagaaggcgatgaatgatgacgatgctgcggcgaaaaaaggcgcagacgttgatcttcaggctgaaaagctctctcataaagagtga

SEQ ID NO: 1500 - protein, 67 aa, Escherichia coli
MGEISITKLLVVAALVVLLFGTKKLRTLGGDLGAAIKGFKKAMNDDDAAAKKGADVDLQAEKLSHKE

SEQ ID NO: 1501 - DNA, 951 bp, Escherichia coli
gtgatggaacgcggtgttaaataccgcgatgccgataagatggcccttatcccggttaaaaacgtggcaacagagcgcgaagccctgctgcgcaagccggaatggatgaaaatcaagcttccagcggactctacacgtatccagggcatcaaagccgcaatgcgcaaaaatggcctgcattctgtctgtgaggaagcctcctgccctaacctggcggaatgctttaaccacggcacagcaacgtttatgatcctcggcgctatttgtacccgccgttgcccgttctgtgacgttgcccacggtcgcccggtagctcctgatgccaatgaaccagtgaaactggcgcagaccattgccgatatggcgctgcgttatgtggttatcacctccgttgaccgtgatgacctgcgcgatggcggtgcccagcactttgcggattgcattactgccattcgggaaaaaagcccgcaaatcaaaattgaaactctggtgccggatttccgcggtcgtatggatcgtgctctggatattctgaccgccacaccaccagatgtgttcaaccataacctggaaaacgtaccgcgtatttaccgtcaggtacggcctggtgcagattacaactggtcgctgaagctgctggaacgctttaaagaagcgcatccggaaatcccgaccaagtctggtctgatggtgggactgggtgaaaccaatgaagaaattattgaggtaatgcgcgacctgcgccgtcatggtgtgacgatgctaacgctggggcaatatttgcagccaagccgccatcacctgccggttcaacgttacgttagcccggatgagttcgacgaaatgaaagccgaagcgctggcgatgggctttacccatgctgcatgcggtccgtttgtccgctcttcttaccacgccgatttgcaggcgaaagggatggaagttaagtaa

SEQ ID NO: 1502 - protein, 316 aa, Escherichia coli
MMERGVKYRDADKMALIPVKNVATEREALLRKPEWMKIKLPADSTRIQGIKAAMRKNGLHSVCEEASCPNLAECFNHGTATFMILGAICTRRCPFCDVAHGRPVAPDANEPVKLAQTIADMALRYVVITSVDRDDLRDGGAQHFADCITAIREKSPQIKIETLVPDFRGRMDRALDILTATPPDVFNHNLENVPRIYRQVRPGADYNWSLKLLERFKEAHPEIPTKSGLMVGLGETNEEIIEVMRDLRRHGVTMLTLGQYLQPSRHHLPVQRYVSPDEFDEMKAEALAMGFTHAACGPFVRSSYHADLQAKGMEVK

SEQ ID NO: 1503 - DNA, 642 bp, Escherichia coli
ttgtatcaggataaaattcttgtccgccagctcggtcttcagccttacgagccaatctcccaggctatgcatgaattcaccgatacccgcgatgatagtacccttgatgaaatctggctggtcgagcactatccggtattcacccaagggcaggcaggaaaggcggagcacattttaatgccgggtgatattccggtgatccagagcgatcgcggtgggcaggtgacttatcacgggccggggcaacaggtgatgtatgtgttgcttaacctgaaacgccgtaaactcggtgtgcgtgaactggtgaccttgcttgagcaaacagtggtgaataccctggctgaactgggtatagaagcgcatcctcgggctgacgcgcctggtgtctatgtcggggaaaagaaaatttgctcactgggtttacgtattcgacgcggttgttcattccacggtctggcattaaacgtcaatatggatctttcaccatttttacgtattaatccttgtgggtatgcaggaatggaaatggctaaaatatcacaatggaaacccgaagcgacaactaataatattgcaccacgtttactggaaaatattttagcgctactaaacaatcctgacttcgaatatattaccgcttaa

SEQ ID NO: 1504 - protein, 213 aa, Escherichia coli
MYQDKILVRQLGLQPYEPISQAMHEFTDTRDDSTLDEIWLVEHYPVFTQGQAGKAEHILMPGDIPVIQSDRGGQVTYHGPGQQVMYVLLNLKRRKLGVRELVTLLEQTVVNTLAELGIEAHPRADAPGVYVGEKKICSLGLRIRRGCSFHGLALNVNMDLSPFLRINPCGYAGMEMAKISQWKPEATTNNIAPRLLENILALLNNPDFEYITA

SEQ ID NO: 1505 - DNA, 264 bp, Escherichia coli
atgaaaaccaaacttaacgaactgcttgaattccctactccttttacttacaaagttatggggcaggcgttacctgagctggttgatcaggtggttgaagtggtacagcgccatgcgccaggtgactacaccccaacggtaaaaccaagcagcaaaggcaactaccactcggtatctatcactatcaacgccactcatatcgagcaggttgaaacactgtatgaagaactgggcaaaatcgatattgtccgcatggttctgtaa

SEQ ID NO: 1506 - protein, 87 aa, Escherichia coli
MKTKLNELLEFPTPFTYKVMGQALPELVDQVVEVVQRHAPGDYTPTVKPSSKGNYHSVSITINATHIEQVETLYEELGKIDIVRMVL

SEQ ID NO: 1507 - DNA, 1212 bp, Escherichia coli
atgaataccattttttccgctcgtatcatgaagcgcctggcgctcaccacggctctttgcacagcctttatctctgctgcacatgccgatgacctgaatatcaaaaccatgatcccgggtgtaccgcagatcgacgcggagtcctacatcctgattgactataactccggcaaagtactcgccgaacagaacgctgatgtccgccgcgatcctgccagcctgaccaaaatgatgaccagttacgttatcggccaggcaatgaaagccggtaaatttaaagaaactgatttagtcactatcggcaacgacgcatgggccaccggtaacccggtgtttaaaggttcttcgctgatgttcctcaaaccgggcatgcaggttccggtttctcagctgatccgcggtattaacctgcaatcgggtaacgatgcttgtgtcgccatggccgattttgccgctggtagccaggacgcttttgttggcttgatgaacagctacgttaacgccctgggcctgaaaaatacccacttccagacggtacacggtctggatgctgatggtcagtacagctccgcgcgagatatggcgctgatcggccaggcgttgatccgtgacgtaccgaatgaatactcgatctataaagaaaaagaatttacgtttaacggtattcgccagctgaaccgtaacggcctgttatgggataacagcctgaatgtcgacggcatcaaaaccggacacactgacaaagcaggttacaaccttgttgcttctgcgactgaaggccagatgcgcttgatctctgcggtgatgggcggacgtacttttaaaggccgtgaagccgaaagtaaaaaattgctaacctggggcttccgtttcttcgaaaccgttaacccactgaaagtaggtaaagagttcgcctctgaaccggtttggtttggtgattctgatcgcgcttcgttaggggttgataaagacgtgtacctgaccattccgcgtggtcgcatgaaagatctgaaagccagctatgtgctgaacagcagtgaattgcatgcgccgctgcaaaagaatcaggtcgtcggtactatcaacttccagcttgatggcaaaacgatcgaacaacgcccgctggttgtgctgcaagaaatcccggaaggtaacttcttcggcaaaatcattgattacattaaattaatgttccatcactggtttggttaa

SEQ ID NO: 1508 - protein, 403 aa, Escherichia coli
MNTIFSARIMKRLALTTALCTAFISAAHADDLNIKTMIPGVPQIDAESYILIDYNSGKVLAEQNADVRRDPASLTKMMTSYVIGQAMKAGKFKETDLVTIGNDAWATGNPVFKGSSLMFLKPGMQVPVSQLIRGINLQSGNDACVAMADFAAGSQDAFVGLMNSYVNALGLKNTHFQTVHGLDADGQYSSARDMALIGQALIRDVPNEYSIYKEKEFTFNGIRQLNRNGLLWDNSLNVDGIKTGHTDKAGYNLVASATEGQMRLISAVMGGRTFKGREAESKKLLTWGFRFFETVNPLKVGKEFASEPVWFGDSDRASLGVDKDVYLTIPRGRMKDLKASYVLNSSELHAPLQKNQVVGTINFQLDGKTIEQRPLVVLQEIPEGNFFGKIIDYIKLMFHHWFG

SEQ ID NO: 1509 - DNA, 1089 bp, Escherichia coli
atgcgtaagcagtggctcgggatctgcatcgcggcaggaatgctcgcggcatgtacaagcgatgatagtcagcaacagacggtaagtgtaccgcagcctgcggtatgtaacggccccatagttgaaattagcggggcagacccgcgtttcgaaccactgaacgcgacggcaaatcaggattaccagcgcgacggtaaaagctacaaaatcgtgcaggatccgtctcgatttagccaggcgggactggcggcaatctatgatgccgaacccggcagtaacctgacggcctctggcgaagctttcgatccgacacagttgacggcggcccatccaacgcttccaatccccagctacgccagaatcactaatctggctaacgggcgaatgatcgtggtgcgcattaatgatcgcggcccttatggcaacgaccgcgtgatttcgctttctcgcgcggcagctgaccgtcttaacacgtcaaacaacaccaaagttcgtatcgatccgattattgtcgcccaggatggttcgctttctggtcctggtatggcttgtaccacagtcgccaaacagacttacgccctgccagcacctcccgatttaagcggtggcgcgggaacaagttcagtgcctgtcccgcagggtgacattcttccggtcagtaattcgacgctaaaaagcgaagatccgaccggcgcgccggtaaccagcagcggtttcctcggcgcaccaacgaccttagcgcctggtgtactggaaggcagcgaaccgacgcctgcgccacagcccgttgttacagctccgtcgacaacgcctgcaacctcacctgcaatggtgacaccgcaagccgcctcgcaaagcgccagcggcaactttatggtgcaagtcggggccgttagcgatcaggctcgtgcgcaacagtaccaacagcaactgggacagaagttcggcgtccccggtcgcgtaactcaaaatggcgcggtctggcggatccagcttggcccattcgccagcaaagccgaagccagtaccttgcagcaacgtttgcaaaccgaagcccaattacagtcatttattaccaccgcgcagtag

SEQ ID NO: 1510 - protein, 362 aa, Escherichia coli
MRKQWLGICIAAGMLAACTSDDSQQQTVSVPQPAVCNGPIVEISGADPRFEPLNATANQDYQRDGKSYKIVQDPSRFSQAGLAAIYDAEPGSNLTASGEAFDPTQLTAAHPTLPIPSYARITNLANGRMIVVRINDRGPYGNDRVISLSRAAADRLNTSNNTKVRIDPIIVAQDGSLSGPGMACTTVAKQTYALPAPPDLSGGAGTSSVPVPQGDILPVSNSTLKSEDPTGAPVTSSGFLGAPTTLAPGVLEGSEPTPAPQPVVTAPSTTPATSPAMVTPQAASQSASGNFMVQVGAVSDQARAQQYQQQLGQKFGVPGRVTQNGAVWRIQLGPFASKAEASTLQQRLQTEAQLQSFITTAQ

SEQ ID NO: 1511 - DNA, 144 bp, Escherichia coli
gtgatggaattaaaaaaagtgccctactatagcaaatgcactaccggcaggcatctgactttccgcgtgactttgttaacgtcatttacagaaattgacacatcagatgcctgctttacgctactgcgcggtggtaataaatga

SEQ ID NO: 1512 - protein, 47 aa, Escherichia coli
MMELKKVPYYSKCTTGRHLTFRVTLLTSFTEIDTSDACFTLLRGGNK

SEQ ID NO: 1513 - DNA, 1113 bp, Escherichia coli
atgacggataatccgaataaaaaaacattctgggataaagtccatctcgatcccacaatgctgctgatcttactggcattgctggtttacagcgccctggttatctggagcgccagcggtcaggatattggcatgatggagcgtaaaatcggccagattgcgatgggtctggtcatcatggtggtgatggcgcaaattcctccacgcgtttatgaaggctgggccccctatctctatatcatctgtattattttgctggtggcggtagatgctttcggtgccatctctaaaggcgctcaacgctggctggacctcggtattgttcgttttcaaccgtcggaaattgccaagatagccgtaccgttgatggttgcacgctttatcaaccgcgacgtttgcccaccttcattgaagaatacagctatcgcgctggtactgatatttatgcccacgctgctggtggctgcacagcctgacctgggaacatcaatcctcgttgcgctttccggcctgtttgtactgttcctctctggccttagctggcgtctgattggcgtcgcagtagtgctggtagcggcgttcattccgattctgtggttcttcctgatgcatgattaccagcgccagcgcgtaatgatgctcctggacccggaatcagacccactcggcgcaggctatcacattattcagtctaaaattgctattggctccggcggattacgcggcaaaggctggctgcacggcactcagtcacagcttgaatttctccccgaacgccataccgactttatcttcgcggtactggcggaagagctgggattagtgggcattttgattctgctcgctctttacattctgctgatcatgcgcgggctgtggatagccgccagagcgcaaaccacctttggtcgcgtcatggctggcggcttaatgctgatattattcgtttatgtcttcgtaaatattggtatggtaagcggtattctgccggttgtaggggttccgctcccactggtcagttatggaggatcggcgctaattgtgctgatggctgggttcgggattgtaatgtcaatccacacccacaggaaaatgttgtcgaaaagcgtgtaa

SEQ ID NO: 1514 - protein, 370 aa, Escherichia coli
MTDNPNKKTFWDKVHLDPTMLLILLALLVYSALVIWSASGQDIGMMERKIGQIAMGLVIMVVMAQIPPRVYEGWAPYLYIICIILLVAVDAFGAISKGAQRWLDLGIVRFQPSEIAKIAVPLMVARFINRDVCPPSLKNTAIALVLIFMPTLLVAAQPDLGTSILVALSGLFVLFLSGLSWRLIGVAVVLVAAFIPILWFFLMHDYQRQRVMMLLDPESDPLGAGYHIIQSKIAIGSGGLRGKGWLHGTQSQLEFLPERHTDFIFAVLAEELGLVGILILLALYILLIMRGLWIAARAQTTFGRVMAGGLMLILFVYVFVNIGMVSGILPVVGVPLPLVSYGGSALIVLMAGFGIVMSIHTHRKMLSKSV

SEQ ID NO: 1515 - DNA, 864 bp, Escherichia coli
  n 4, 5, 6, 7, 8: n is any nucleotide
atgnnnnntacgacgctgtttgaccccggctggtggcaactgccagggtcggaaaaacgttatcgtgactggaaaaaatggggccacgggcgtctgaatgtcacaagatcgctggaagaatctgcggataccttcttctatcaggtggcctacgatatggggatcgatcgcctctccgaatggatggggaaattcggttatggtcattacaccggtatcgacctggcggaagaacgttccggcaacatgcctacccgcgaatggaaacagaaacgctttaaaaaaccgtggtatcagggtgacaccattccggttggtatcggtcagggttactggacagcgaccccaatccagatgagtaaggcactgatgatcctgattaatgacggtatcgtgaaggttccgcatttactgatgagcaccgccgaagacggcaaacaggtgccatgggtacaaccgcatgaaccgcccgtcggcgatattcattccggttactgggagctggcgaaagacggtatgtacggtgttgctaaccgccctaacggtacggcgcataaatattttgccagcgcaccgtacaaaattgcggcgaaatccggtaccgctcaggtcttcggtctgaaagcgaacgaaacctataatgcgcacaaaattgccgagcgtttacgtgaccacaaactgatgaccgcctttgcgccatacaacaatccgcaagtggctgtcgccatgattctggagaacggtggcgcgggtccggcggttggtacgctgatgcgccagatcctcgaccacattatgctgggtgataacaacaccgatctgcctgcggaaaatccagcggttgccgcagcggaggaccattaa

SEQ ID NO: 1516 - protein, 287 aa, Escherichia coli
  Xaa 2, 3: Xaa is any amino acid
MXXTTLFDPGWWQLPGSEKRYRDWKKWGHGRLNVTRSLEESADTFFYQVAYDMGIDRLSEWMGKFGYGHYTGIDLAEERSGNMPTREWKQKRFKKPWYQGDTIPVGIGQGYWTATPIQMSKALMILINDGIVKVPHLLMSTAEDGKQVPWVQPHEPPVGDIHSGYWELAKDGMYGVANRPNGTAHKYFASAPYKIAAKSGTAQVFGLKANETYNAHKIAERLRDHKLMTAFAPYNNPQVAVAMILENGGAGPAVGTLMRQILDHIMLGDNNTDLPAENPAVAAAEDH

SEQ ID NO: 1517 - DNA, 930 bp, Escherichia coli
  n 912, 913, 914, 915, 916: n is any nucleotide
atgaaactacagaactcttttcgcgactatacggcagagtccgcgctgtttgtgcgccgggcgctggtcgcctttttggggattttgctgctgaccggcgtgcttatcgccaacctgtataatctgcaaattgttcgctttaccgactaccagacccgctctaatgaaaaccgcattaagctggtgcctatcgcacccagccgcggcattatctacgaccgtaacggtatccctctggctctcaaccgcactatctaccagatagaaatgatgccggagaaagtcgataacgtgcagcaaacgctggacgctttgcgcagcgtggttgatctgaccgatgatgatattgcggcattccgaaaagagcgcgcacgttcacaccgtttcacctctattccggtgaaaactaacctgaccgaagtacaagtagctcgctttgccgtcaaccagtaccgttttccgggtgttgaagttaaaggctataaacgtcgttactatccttacggttcggcgttgacccacgtcatcggctatgtgtcgaaaatcaacgataaagacgtcgaacgcctgaataatgacggcaaactggccaactatgcggcaacgcatgatatcggtaagctgggcattgaacgttactatgaagacgtgctgcacggtcagaccggttatgaagaggttgaagttaacaaccgtgggcgtgttatccgccagttaaaagaagtaccaccgcaagccggacacgatatttacctgacgctggatctcaaactccagcaatatattgaaacgctgctggcgggtagccgcgcagctgtggtagtcaccgatccgcgtacaggtggggtgttggcgctggtttccacgcctagttatgacccaaacctgtttgttgacggtatctccagcaannnnncattcattcattaa

SEQ ID NO: 1518 - protein, 309 aa, Escherichia coli
  Xaa 304, 305, 306: Xaa is any amino acid
MKLQNSFRDYTAESALFVRRALVAFLGILLLTGVLIANLYNLQIVRFTDYQTRSNENRIKLVPIAPSRGIIYDRNGIPLALNRTIYQIEMMPEKVDNVQQTLDALRSVVDLTDDDIAAFRKERARSHRFTSIPVKTNLTEVQVARFAVNQYRFPGVEVKGYKRRYYPYGSALTHVIGYVSKINDKDVERLNNDGKLANYAATHDIGKLGIERYYEDVLHGQTGYEEVEVNNRGRVIRQLKEVPPQAGHDIYLTLDLKLQQYIETLLAGSRAAVVVTDPRTGGVLALVSTPSYDPNLFVDGISSXXXFIH

SEQ ID NO: 1519 - DNA, 468 bp, Escherichia coli
gtgaagctgcaacttgtcgccgtgggaacgaaaatgccggactgggtacaaaccggttttaccgagtacctgcgtcgttttccgaaagatatgcccttcgagctgattgaaattccggccggaaaacgcggcaagaatgcggacatcaagcgcatactcgacaaagagggtgagcagatgttggcggccgcaggcaaaaaccgcattgtcaccctcgatattccaggcaagccctgggatacgccgcagttagccgctgagctggaacgctggaagctggatggtcgcgacgtcagtctactgattggcgggcctgaagggttgtcgcctgcctgtaaagcggcggcggagcagagctggtcgctgtcggcacttacccttccccatccgctggttcgcgtgctggtcgcagagagtctgtaccgggcgtggagcatcaccaccaaccatccttatcaccgtgagtga

SEQ ID NO: 1520 - protein, 155 aa, Escherichia coli
MKLQLVAVGTKMPDWVQTGFTEYLRRFPKDMPFELIEIPAGKRGKNADIKRILDKEGEQMLAAAGKNRIVTLDIPGKPWDTPQLAAELERWKLDGRDVSLLIGGPEGLSPACKAAAEQSWSLSALTLPHPLVRVLVAESLYRAWSITTNHPYHRE

SEQ ID NO: 1521 - DNA, 318 bp, Escherichia coli
ttgcagggtaaagcactccaggattttgttatcgacaaaattgatgacctcaaaggtcaggacatcatcgccttagacgttcagggcaaatccagcatcaccgactgcatgatcatctgtacgggtacgtccagccgccatgttatgtccattgctgatcacgttgtgcaggagtctcgcgcagcgggcctgttaccgctcggcgtagaaggtgaaaacagcgccgactggattgtcgtggatttgggcgatgtgattgtccatgtcatgcaggaagagagccgtcgcctgtatgaactggaaaaactctggagttaa

SEQ ID NO: 1522 - protein, 105 aa, Escherichia coli
MQGKALQDFVIDKIDDLKGQDIIALDVQGKSSITDCMIICTGTSSRHVMSIADHVVQESRAAGLLPLGVEGENSADWIVVDLGDVIVHVMQEESRRLYELEKLWS

SEQ ID NO: 1523 - DNA, 612 bp, Escherichia coli
atgcgactgtggttaattcgtcatggtgaaacgcaagcgaatgtcgatggtctgtacagcggtcatgcgcccacacccctgaccgcgcgcggtattgagcaagcgcaaaatctgcatacgctgctacatgatgtttcctttgacctggttttatgcagtgaactggaacgggcacagcataccgcgcgactggttcttagtgaccgccagcaccccgttcatatcatccctgaactcaatgaaatgttttttggcgactgggagatgcgacatcatcgtgacctcatgcaagaagatgccgaaaactatagcgcgtggtgcaatgactggcagcatgctatccccacgaacggtgaaggatttcaggcattttcgcaacgtgtggaacgatttatcgcaaggcttagtgaatatcagcactatcagaatattttagtcgtcagccatcagggcgtactgagtctgttaattgctcgtttaattggcatgcctgccgagtctatgtggcatttccgcgttgaccaggggtgttggagcgccattgatatcaaccaaaaattcgcgacgctacgcgtcctcaatagccgtgccatcggggtcgagaatgcatga

SEQ ID NO: 1524 - protein, 203 aa, Escherichia coli
MRLWLIRHGETQANVDGLYSGHAPTPLTARGIEQAQNLHTLLHDVSFDLVLCSELERAQHTARLVLSDRQHPVHIIPELNEMFFGDWEMRHHRDLMQEDAENYSAWCNDWQHAIPTNGEGFQAFSQRVERFIARLSEYQHYQNILVVSHQGVLSLLIARLIGMPAESMWHFRVDQGCWSAIDINQKFATLRVLNSRAIGVENA

SEQ ID NO: 1525 - DNA, 705 bp, Escherichia coli
ttgaagggttatctcttctgttgtgccataaacccctggcggacgtatttatcgacggttgatatgaaatctttacaggctctgtttggcggcacctttgatccggtgcactatggtcatcttaaacccgtggaaacgctggcgaatttgattggtctgacgcgggtcacaatcatccctaataatgttcctccgcatcgtccccagccggaagcaaacagcatgcagcgtaaacacatgcttgaactggcgattgccgacaagccattatttactcttgatgaacgcgagctaaagcgcaatgccccctcttacactgcgcaaacactgaaagagtggcggcaggagcaaggaccggacgtgccgctggcgtttattattggtcaggattcattgctgacctttccgacctggtacgaatacgaaacgatactcgacaatgcacatttgatcgtctgtcggcgtcctggttacccacttgaaatggcacaaccacaatatcagcaatggctggaggatcatttgacacataacccggaagatcttcaccttcagcctgccggtaaaatttatctggctgaaacgccgtggtttaacatctcggcgaccatcatccgcgaacgtttgcaaaatggtgaatcgtgtgaggatttattaccggaaccggtactgacttacattaaccaacaaggcttgtatcgctga

SEQ ID NO: 1526 - protein, 234 aa, Escherichia coli
MKGYLFCCAINPWRTYLSTVDMKSLQALFGGTFDPVHYGHLKPVETLANLIGLTRVTIIPNNVPPHRPQPEANSMQRKHMLELAIADKPLFTLDERELKRNAPSYTAQTLKEWRQEQGPDVPLAFIIGQDSLLTFPTWYEYETILDNAHLIVCRRPGYPLEMAQPQYQQWLEDHLTHNPEDLHLQPAGKIYLAETPWFNISATIIRERLQNGESCEDLLPEPVLTYINQQGLYR

SEQ ID NO: 1527 - DNA, 1032 bp, Escherichia coli
atgattcggttgtacccggaacaactccgcgcgcagctcaatgaagggctgcgcgcggcgtatcttttacttggtaacgatcctctgttattgcaggaaagccaggacgctgttcgtcaggtcgctgcggcgcaagggttcgaagaacaccacactttttccattgatcccaacaccgactggaatgcgattttttcgttatgccaggccatgagcctgtttgccagtcgacaaacgctattgctgttgttacccgaaaacggaccgaatgcggcgatcaatgaacaacttctcacactcaccggacttctgcatgacgacctgctgttgatcgtccgcggtaataaattaagcaaagcgcaagaaaatgccgcctggtttactgctcttgcgaatcgcagcgtgcaggtgacctgtcagacaccggagcaggctcagctgccccgctgggttgctgcgcgcgcaaaacagctcaacttagaactggatgacgctgcaaatcaggtgctctgctactgttatgaaggtaacctgctggcgctggcccaggcactggagcgtttatcgctactctggccggacggcaaactgacattaccgcgcgttgaacaggcggtgaatgatgccgcgcatttcaccccttttcattgggttgatgctttgttgatgggaaaaagtaagcgcgcgttgcatattcttcagcaactgcgtctggaaggcagcgaaccggttattttgttgcgcacattacaacgtgaactgttgttactggttaacctgaaacgccagtctgcccatacgccactgcgtgcgttgtttgataagcatcgggtatggcagaaccgcaggggcatgatgagcgaggcgttaaatcgcttaagccagtcgcagttacgtcaggccgtgcaactcctgacacgaacggaactcaccctcaaacaagattacggtcagtcagtgtgggcagagcttgaagggttatctcttctgttgtgccataaacccctggcggacgtatttatcgacggttga

SEQ ID NO: 1528 - protein, 343 aa, Escherichia coli
MIRLYPEQLRAQLNEGLRAAYLLLGNDPLLLQESQDAVRQVAAAQGFEEHHTFSIDPNTDWNAIFSLCQAMSLFASRQTLLLLLPENGPNAAINEQLLTLTGLLHDDLLLIVRGNKLSKAQENAAWFTALANRSVQVTCQTPEQAQLPRWVAARAKQLNLELDDAANQVLCYCYEGNLLALAQALERLSLLWPDGKLTLPRVEQAVNDAAHFTPFHWVDALLMGKSKRALHILQQLRLEGSEPVILLRTLQRELLLLVNLKRQSAHTPLRALFDKHRVWQNRRGMMSEALNRLSQSQLRQAVQLLTRTELTLKQDYGQSVWAELEGLSLLLCHKPLADVFIDG

SEQ ID NO: 1529 - DNA, 582 bp, Escherichia coli
gtgcgatatctggcaacattgttgttatctctggcggtgttaatcaccgccgggtgtggctggcatctgcgtgacaccacgcaggttccttccactatgaaagtcatgatcctggactcaggcgatccgaacgggccattaagccgtgcggtgcgtaatcagttacgtctgaatggtgtcgagttgcttgataaagaaaccacgcgtaaggacgttccatccctgcgtttgggtaaagtgagcatcgcgaaagataccgcatcggtattccgtaacggtcaaacagcagagtatcagatgatcatgacggtgaatgcgaccgtgttgatccccggccgtgatatctacccgattagcgccaaagtcttccgttcgttcttcgataacccgcaaatggcgttagcgaaagataacgaacaagacatgatcgtaaaagagatgtacgaccgtgctgccgaacagctgattcgtaagctgccaagcatccgtgctgcggatattcgttccgacgaagaacagacgtcgaccacaacggatactccggcaacgcctgcacgcgtctccaccacgctgggtaactga

SEQ ID NO: 1530 - protein, 193 aa, Escherichia coli
MRYLATLLLSLAVLITAGCGWHLRDTTQVPSTMKVMILDSGDPNGPLSRAVRNQLRLNGVELLDKETTRKDVPSLRLGKVSIAKDTASVFRNGQTAEYQMIMTVNATVLIPGRDIYPISAKVFRSFFDNPQMALAKDNEQDMIVKEMYDRAAEQLIRKLPSIRAADIRSDEEQTSTTTDTPATPARVSTTLGN

SEQ ID NO: 1531 - DNA, 2724 bp, Escherichia coli
atgaataatccgggcatcatttcaacgtcgagtgcgcgaaaggctgttttgacgcgggcgtttgggctatgctatgcggatctgaaaaaccacatcaacgctacatttgtagccgtattgaaaacaggaccactggctgccatgcaagagcaataccgcccggaagagatagaatccaaagtacagcttcactgggatgagaagcgcacatttgaagtaaccgaagacgagagcaaagagaagtattactgcctgtctatgcttccctatccttctggtcgactacacatgggccacgttcgcaactacaccatcggtgacgtgatcgcccgctaccagcgtatgctgggcaaaaacgtcctgcagccaatcggctgggacgcatttggtctgcctgcggaaggcgcggcggtgaaaaacaacaccgcgccagcaccgtggacgtacgacaacatcgcgtatatgaaaaaccagctcaaaatgctgggctttggttatgactggagccgcgagctggcgacctgtacgccggaatactaccgttgggaacagaaattcttcaccgaactgtataaaaaaggcctggtatataagaagacttctgcggtcaactggtgcccgaacgaccagaccgtactggcgaacgaacaagttatcgacggctgctgctggcgctgcgataccaaagttgagcgtaaagagatcccgcagtggtttatcaaaatcactgcttacgctgacgagctgctcaacgatctggataaactggatcactggccagacaccgttaaaacaatgcagcgtaactggatcggtcgttccgaaggcgtggaaatcaccttcaacgttaaggactatgacaacacgctgaccgtttacactacccgcccggacacctttatgggttgtacctacctggcggtggctgcgggtcatccgctggcacagaaagcggcggaaaataatcctgaactggccgcctttattgacgaatgccgtaacaccaaagttgccgaagctgaaatggcgacgatggagaaaaaaggcgtcgatactggctttaaagcggttcacccattaacgggcgaagaaattcccgtttgggcagcaaacttcgtattgatggaatacggcacgggcgcagttatggcggttccgggtcacgaccagcgcgactacgagtttgcctctaaatacggcctgaacatcaaaccggttatcctggcagctgacggctctgagccagatctttctcagcaagccctgactgaaaaaggcgtgctgttcaactctggcgagtttaatggtcttgaccatgaagcggccttcaacgccattgccgacaaactgactgaaatgggcgttggcgagcgtaaagtgaactaccgcctgcgcgactggggtgtttctcgtcagcgttactggggcgcgccgattccgatggtgacgctggaagacggtaccgtaatgccgaccccggacgaccagctgccggtgatcctgccggaagatgtggtgatggacggcattaccagcccgattaaagcagatccggaatgggcaaaaactaccgttaacggtatgccagcactgcgtgaaaccgacactttcgacacctttatggagtcctcctggtactatgcgcgctacacttgcccggagtacaaagaaggtatgctggattccaaagcggctaactactggctgccggtggatatttacattggtggtatcgaacacgccattatgcacctgctctacttccgcttcttccacaaactgatgcgtgatgcaggcatggtgaactctgacgaaccagcgaaacagttgctgtgtcagggtatggtgctggcagatgccttctactatgttggtgaaaacggcgaacgtaactgggtttccccggttgatgctatcgttgaacgtgacgagaaaggccgtatcgtgaaagcgaaagatgcggcaggccatgaactggtttataccggcatgagcaaaatgtccaagtcgaagaacaacggtatcgacccgcaggtgatggttgaacgttacggcgcggacaccgttcgtctgtttatgatgtttgcttctccggctgatatgactctcgaatggcaggagtccggcgtggaaggggctaaccgcttcctgaaacgtgtctggaaactggtgtacgagcatacagcaaaaggtgatgttgcggcactgaacgtcgatgcgctgactgaagatcagaaagcgctgcgtcgcgatgtgcataaaactatcgctaaagtaaccgatgatatcggccgtcgtcagaccttcaacaccgcaattgcggcgattatggagctgatgaacaaactggcgaaagcaccgaccgatggcgagcaggatcgcgccctgatgcaggaagcgctgctggcggtagtccgtatgcttaacccgttcaccccgcacatctgcttcacgctgtggcaggaactgaaaggcgaaggcgatatcgacaacgcgccgtggccggttgctgacgaaaaagcgatggtggaagactccacgctggtcgtggtgcaggttaacggtaaagtccgtgcaaaaatcaccgttccggtggacgcaacggaagaacaggttcgcgaacgtgctggccaggaacatctggtagcaaaatatcttgatggcgttactgtacgtaaagtgatttacgtaccaggtaaactcctcaatctggtcgttggctaa

SEQ ID NO: 1532 - protein, 907 aa, Escherichia coli
MNNPGIISTSSARKAVLTRAFGLCYADLKNHINATFVAVLKTGPLAAMQEQYRPEEIESKVQLHWDEKRTFEVTEDESKEKYYCLSMLPYPSGRLHMGHVRNYTIGDVIARYQRMLGKNVLQPIGWDAFGLPAEGAAVKNNTAPAPWTYDNIAYMKNQLKMLGFGYDWSRELATCTPEYYRWEQKFFTELYKKGLVYKKTSAVNWCPNDQTVLANEQVIDGCCWRCDTKVERKEIPQWFIKITAYADELLNDLDKLDHWPDTVKTMQRNWIGRSEGVEITFNVKDYDNTLTVYTTRPDTFMGCTYLAVAAGHPLAQKAAENNPELAAFIDECRNTKVAEAEMATMEKKGVDTGFKAVHPLTGEEIPVWAANFVLMEYGTGAVMAVPGHDQRDYEFASKYGLNIKPVILAADGSEPDLSQQALTEKGVLFNSGEFNGLDHEAAFNAIADKLTEMGVGERKVNYRLRDWGVSRQRYWGAPIPMVTLEDGTVMPTPDDQLPVILPEDVVMDGITSPIKADPEWAKTTVNGMPALRETDTFDTFMESSWYYARYTCPEYKEGMLDSKAANYWLPVDIYIGGIEHAIMHLLYFRFFHKLMRDAGMVNSDEPAKQLLCQGMVLADAFYYVGENGERNWVSPVDAIVERDEKGRIVKAKDAAGHELVYTGMSKMSKSKNNGIDPQVMVERYGADTVRLFMMFASPADMTLEWQESGVEGANRFLKRVWKLVYEHTAKGDVAALNVDALTEDQKALRRDVHKTIAKVTDDIGRRQTFNTAIAAIMELMNKLAKAPTDGEQDRALMQEALLAVVRMLNPFTPHICFTLWQELKGEGDIDNAPWPVADEKAMVEDSTLVVVQVNGKVRAKITVPVDATEEQVRERAGQEHLVAKYLDGVTVRKVIYVPGKLLNLVVG

SEQ ID NO: 1533 - DNA, 483 bp, Escherichia coli
atgaacaaggttgctcaatattaccgtgaactggtcgcgtcattgagcgaacgcctgcgcaatggcgaacgtgatatcgacgcactggtggaacaggcgcgcgagcgcgtaataaaaacaggggagttaacgcgaaccgaggtcgatgagctgacgcgagctgtcagacgtgacctggaagagttcgccatgagctatgaagagagcctgaaagaagagtctgacagcgtctttatgcgggtgattaaagaaagcttgtggcaggagctggcagacatcaccgataaaacgcagcttgaatggcgcgaagttttccaggacctcaatcatcacggggtttatcacagcggagaagtggtagggctgggaaatctggtctgcgagaaatgtcacttccatctcccgatctatacaccggaagtgctgacgctatgcccgaaatgtggtcatgatcagttccagagacgcccgttcgagccgtaa

SEQ ID NO: 1534 - protein, 160 aa, Escherichia coli
MNKVAQYYRELVASLSERLRNGERDIDALVEQARERVIKTGELTRTEVDELTRAVRRDLEEFAMSYEESLKEESDSVFMRVIKESLWQELADITDKTQLEWREVFQDLNHHGVYHSGEVVGLGNLVCEKCHFHLPIYTPEVLTLCPKCGHDQFQRRPFEP

SEQ ID NO: 1535 - DNA, 936 bp, Escherichia coli
atggcactgccaattctgttagattgcgacccaggtcatgacgacgctatcgcaatcgttctcgccctcgcctcaccagagcttgatgtcaaagcaattacgtcttccgccggaaaccagacaccagaaaaaaccttacgcaatgttctgcgtatgctgaccttgcttaatcgcaccgatattccggtagcaagcggtgcggtaaaaccgttaatgcgtaatttgattattgcggacaacgtgcacggcgaaagcggtctcgacggcccggcattaccggaaccgacgttcgcaccgcaaaactgtacggcggtggagctgatggcgaaaacgctgcgtgaaagtgaggaacctgtcaccattgtttctaccggaccgcaaactaacgttgccttgctgctcaatagccacccggaactgcatagcaaaattgcccgtatcgtgattatgggcggcgcaatggggcttggtaactggacgcctgcggctgaatttaatatttacgttgacccggaagcggcagaaattgtcttccagtcaggaattccggtggtgatggccggtctggatgttactcacaaagcacaaatccacgttgaagacactgagcgtttccgcgcgattggcaaccctgtttcaaccattgttgccgaactgctggatttcttcctcgaatatcataaagacgaaaaatggggctttgtcggcgcaccactgcatgacccatgcaccatcgcctggctgttgaaaccggagttgtttaccactgttgagcgctgggttggcgtggaaacacaagggaaatatacccagggtatgacggttgttgattattattatctgactggcaataaaccgaatgccaccgtaatggtcgatgttgatcgtcagggctttgttgatttactggctgatcgtctgaaattttacgcttaa

SEQ ID NO: 1536 - protein, 311 aa, Escherichia coli
MALPILLDCDPGHDDAIAIVLALASPELDVKAITSSAGNQTPEKTLRNVLRMLTLLNRTDIPVASGAVKPLMRNLIIADNVHGESGLDGPALPEPTFAPQNCTAVELMAKTLRESEEPVTIVSTGPQTNVALLLNSHPELHSKIARIVIMGGAMGLGNWTPAAEFNIYVDPEAAEIVFQSGIPVVMAGLDVTHKAQIHVEDTERFRAIGNPVSTIVAELLDFFLEYHKDEKWGFVGAPLHDPCTIAWLLKPELFTTVERWVGVETQGKYTQGMTVVDYYYLTGNKPNATVMVDVDRQGFVDLLADRLKFYA

SEQ ID NO: 1537 - DNA, 726 bp, Escherichia coli
atgattaccctgaaaaatgtttcaaaatggtatggtcactttcaggtgctgaccgactgctcaaccgaagtgaaaaaaggcgaagtggtggtggtttgcggcccgtctggttcaggcaaatcaacgctgattaaaaccgtcaacggcctcgaaccggtgcagcaaggtgaaatcaccgtcgatggcatcgtggttaacgacaagaaaaccgatctggcgaaactgcgttcccgcgtcgggatggtgtttcagcatttcgagctgttcccccatctgtcgattatcgaaaacctgaccctggcgcaggtgaaagtgcttaaacgcaataaagcgccggctcgtgaaaaagcattgaaattgctggagcgcgtcgggctttccgcacatgccaataagtttccggcgcagctttccggcggccagcagcagcgtgtggcgatcgctcgcgcattgtgcatggatcctattgccatgctgttcgacgaaccaacgtcggcgctggatccggagatgatcaacgaagtgctggacgtgatggtcgaactggcgaacgaaggaatgacgatgatggtggtgacccacgaaatgggctttgcccgtaaagtggcgaatcgggtgatctttatggacgagggtaaaattgtcgaagactcgccgaaagacgctttcttcgatgatccgaaatcggaccgcgcaaaagacttcctcgcaaaaatcctgcattaa

SEQ ID NO: 1538 - protein, 241 aa, Escherichia coli
MITLKNVSKWYGHFQVLTDCSTEVKKGEVVVVCGPSGSGKSTLIKTVNGLEPVQQGEITVDGIVVNDKKTDLAKLRSRVGMVFQHFELFPHLSIIENLTLAQVKVLKRNKAPAREKALKLLERVGLSAHANKFPAQLSGGQQQRVAIARALCMDPIAMLFDEPTSALDPEMINEVLDVMVELANEGMTMMVVTHEMGFARKVANRVIFMDEGKIVEDSPKDAFFDDPKSDRAKDFLAKILH

SEQ ID NO: 1539 - DNA, 675 bp, Escherichia coli
atgtacgagtttgactggagttccattgttccttccctgccatatctgctcgacgggctggtgatcacgctgaaaatcaccgtcacggcagtggtgattggtattttgtggggcaccatgctggcggtgatgcgcttgtccagctttgcgcccgtagcgtggtttgccaaagcctacgttaacgtattccgctcgattcctttagttatggttttgctgtggttttacctgatcgtaccgggttttctgcaaaacgtgctgggattatcacccaaaaatgatatccgtttaatttcggcgatggtggcgttttcgatgtttgaagcggcctactattcagagattatccgtgctggtattcaaagtatttctcgtggtcagtcgagcgccgcgctggcgttgggaatgactcactggcagtcgatgaaactgattattctgccgcaggcgttccgcgcgatggtgccgctgttgctcactcagggcatcgtactgtttcaggatacctcactggtgtatgtgttatctctggccgatttcttccgtaccgcctcaaccattggtgagcgtgatggtacgcaggttgagatgatcctgtttgccggatttgtttatttcgttattagccttagcgcgtcgttgttggtcagctacttgaaaagaaggacagcataa

SEQ ID NO: 1540 - protein, 224 aa, Escherichia coli
MYEFDWSSIVPSLPYLLDGLVITLKITVTAVVIGILWGTMLAVMRLSSFAPVAWFAKAYVNVFRSIPLVMVLLWFYLIVPGFLQNVLGLSPKNDIRLISAMVAFSMFEAAYYSEIIRAGIQSISRGQSSAALALGMTHWQSMKLIILPQAFRAMVPLLLTQGIVLFQDTSLVYVLSLADFFRTASTIGERDGTQVEMILFAGFVYFVISLSASLLVSYLKRRTA

SEQ ID NO: 1541 - DNA, 741 bp, Escherichia coli
atgtctatagactggaactggggtatttttttacaacaagccccgttcggcaacaccacctatcttggttggatctggagtggttttcaggtgacgatcgctttgtcgatctgcgcctggattatcgctttcctcgtcggttcatttttcggcattttacgtaccgttccaaaccgttttctctccggtctgggtacgttgtatgtcgaactgttccgcaacgtgccgttgattgtgcaattctttacctggtacctggtgatcccggagctgctgccagagaaaatcggcatgtggtttaaggcagagctggatcccaatattcagtttttcctttcatccatgctctgcctggggctgtttaccgccgcccgtgtttgcgaacaggtacgcgcagctattcagtcgctgccgcgtgggcaaaaaaatgccgcgctggcgatgggtctgacgctaccgcaggcctaccgctacgtactgctgcctaatgcttatcgcgttatcgtcccgccgatgacctcagagatgatgaacctggtgaaaaactccgccatcgcctcgactatcggtctggtggatatggcggcgcaggcgggtaaattgctcgattactcggcccacgcctgggagtcgtttaccgccattacgctggcgtatgtattgattaacgcttttatcatgctggtgatgacgctggttgaacgtaaagttcgcctgcccggcaacatggggggcaaataa

SEQ ID NO: 1542 - protein, 246 aa, Escherichia coli
MSIDWNWGIFLQQAPFGNTTYLGWIWSGFQVTIALSICAWIIAFLVGSFFGILRTVPNRFLSGLGTLYVELFRNVPLIVQFFTWYLVIPELLPEKIGMWFKAELDPNIQFFLSSMLCLGLFTAARVCEQVRAAIQSLPRGQKNAALAMGLTLPQAYRYVLLPNAYRVIVPPMTSEMMNLVKNSAIASTIGLVDMAAQAGKLLDYSAHAWESFTAITLAYVLINAFIMLVMTLVERKVRLPGNMGGK

SEQ ID NO: 1543 - DNA, 909 bp, Escherichia coli
atgcaattacgtaaacctgccacagcaatcctggccctggcgctttccgcaggactggcacaggcagatgacgccgccccggcagcaggcagcacgctggacaaaatcgccaaaaacggcgtgattgtcgtcggtcaccgtgaatcttcagtacctttctcttattacgacaatcagcaaaaagtggtgggctactcgcaggattactccaacgccattgttgaagcagtgaaaaagaaactcaacaaaccagacttacaggtgaaattgattccgatcacctcacaaaaccgtattccactgctgcaaaacggcactttcgattttgaatgcggttctaccaccaacaatgccgaacgccaaaaacaggcggctttctctgacactattttcgtggtcggtacgcgcctgctgaccaaaaagggcggcgatatcaaagattttgccgacctgaaaggcaaagccgtagtcgtcacttccggcactacctctgaagttttgctcaacaaactgaatgaagagcaaaaaatgaatatgcgcatcatcagcgccaaagatcacggtgactctttccgcaccctggaaagcggtcgtgccgttgcctttatgatggatgatgccctgctggccggtgaacgtgcgaaagcgaagaaaccagacaactgggaaatcgtcggcaagccgcagtctcaggaagcctacggttgcatgttgcgtaaagacgatccgcagttcaaaaagctgatggatgacactatcgctcaggtgcagacctccggtgaagcggaaaaatggtttgataaatggttcaaaaacccaattccgccgaaaaacctgaacatgaatttcgaactgtcagacgaaatgaaagcactgttcaaagaaccgaatgacaaggcactgaactaa

SEQ ID NO: 1544 - protein, 302 aa, Escherichia coli
MQLRKPATAILALALSAGLAQADDAAPAAGSTLDKIAKNGVIVVGHRESSVPFSYYDNQQKVVGYSQDYSNAIVEAVKKKLNKPDLQVKLIPITSQNRIPLLQNGTFDFECGSTTNNAERQKQAAFSDTIFVVGTRLLTKKGGDIKDFADLKGKAVVVTSGTTSEVLLNKLNEEQKMNMRIISAKDHGDSFRTLESGRAVAFMMDDALLAGERAKAKKPDNWEIVGKPQSQEAYGCMLRKDDPQFKKLMDDTIAQVQTSGEAEKWFDKWFKNPIPPKNLNMNFELSDEMKALFKEPNDKALN

SEQ ID NO: 1545 - DNA, 1878 bp, Escherichia coli
atgtctgcatcttcggttaagccgttaaatgttcaattacccgcaataaccctgatcctttttgcgctctgtgttgggatattttgttacctcgcacaatggatgagttacgaagaagtcgatcaatccgcactcatccatctcggcgctaacgttgcttctctcacgttgtcggatgaatcctggcgcttattgagcagtgtttttctgcacagtagtttttcccatttgctgatgaatatgtttgcactcctggtggtggggacagtggcggaacggatactggggaaatggcgactcctgattatctggttattctccggcatctttggtgggctgatcagcgcctgttatacgttacgcgaaagtgagcagatagtcatcagcattggggcatccggggcaattatgggaatagcgggcgctgcgatagcaacacagcttgcttcaggtgcgggcacacaccataaaaaccagcggcgagtatttcctctgttgggtatggtggcgctgacactgttgtatggtacccggcaaacaggaatagataacgcttgccacattggcggcctgattgcggggggcgcgttgggttggctgagtgcgcgtttagttgggcaaaatcggctcgttacggaaggcgggattattgttgcggtcactcttcttctgaccgggactatctggtttgtgcagcagcagattgatgaatcagttttacaggtcgggcaaagcctgcgtgaagcgttttatccgcaggagattgaacaagagcgacgacaaaaaaagcagcagttagtggaggagcgcaacgccctcagggaaacattatccgctccggtaagtcgtgagcaggccagtggtgatttactcgctgagattgccgatatccatgatatggcgatcagtcgggatggtaatacgttgtatgccgcaattgaaaacacgaacagtattgttgttttcgacctcggacaaaagaaaatcctgcatacctttacagcgcccatagcgaaagaaaagtcagtcaaacattgtggtggctgtaaagatcagggcgtcagatcgctggcattaagcctggatgaaaagttgatttatgcgacttcatttgaagcgaatgcgttatcggtcattaacgtggcgacgggggagattattcagtcgattaccaccggcgcacatcctgacagctttatcctctcgcgtgatggcacaaaagcctgggtgatgaatcgcaccagtaatagtgtgtcagcgattgatctggtggcttatcagcatgtggcggatatcccgctggagaaatacgacgggacggggatgagcggtaaaccaggcgcctgggttatggcactttccccggatgaaaaaacattactggttccgggagcaggcagaggtaacatcgtgcggatcaataccatcacgcatcagaaagaagactttcccgcaggtaatgcgcgtggtgtcgtttctgcgatgggattccgaccaaaaaatggtgagattatttttgccgatagccaggggatttcacgtataagagctgaggatcaacaagccagcattatgacgcaatggtgtagcaggagcgtttattccgttgagggtattagcccggacggtcagtatttagcgttggtgtcatatggcctgcaaggttatgtcatcctgctcaatattaatgccgggcagattattggcgtttatcccgccagctacgtgaatcatcttcgtttttcagcggatgatagaaagatatttgttatggcgaagaacaggttaatccaaatggacaggacgcgctcgcttgatccgcaggcaattattcggcatccccaatatggcgatgtggcttgtatccctgaaccgtaa

SEQ ID NO: 1546 - protein, 625 aa, Escherichia coli
MSASSVKPLNVQLPAITLILFALCVGIFCYLAQWMSYEEVDQSALIHLGANVASLTLSDESWRLLSSVFLHSSFSHLLMNMFALLVVGTVAERILGKWRLLIIWLFSGIFGGLISACYTLRESEQIVISIGASGAIMGIAGAAIATQLASGAGTHHKNQRRVFPLLGMVALTLLYGTRQTGIDNACHIGGLIAGGALGWLSARLVGQNRLVTEGGIIVAVTLLLTGTIWFVQQQIDESVLQVGQSLREAFYPQEIEQERRQKKQQLVEERNALRETLSAPVSREQASGDLLAEIADIHDMAISRDGNTLYAAIENTNSIVVFDLGQKKILHTFTAPIAKEKSVKHCGGCKDQGVRSLALSLDEKLIYATSFEANALSVINVATGEIIQSITTGAHPDSFILSRDGTKAWVMNRTSNSVSAIDLVAYQHVADIPLEKYDGTGMSGKPGAWVMALSPDEKTLLVPGAGRGNIVRINTITHQKEDFPAGNARGVVSAMGFRPKNGEIIFADSQGISRIRAEDQQASIMTQWCSRSVYSVEGISPDGQYLALVSYGLQGYVILLNINAGQIIGVYPASYVNHLRFSADDRKIFVMAKNRLIQMDRTRSLDPQAIIRHPQYGDVACIPEP

SEQ ID NO: 1547 - DNA, 1542 bp, Escherichia coli
atggcttttgcctcattaattgaacgccagcgcattcgcctgctgctggcgttattattcggtgcctgcggaacgctggccttctctccttacgacgtctggcctgcggcgattatttcgctgatggggcttcaggcgttgacctttaaccgtcgtccactccagtctgccgctattggcttttgctggggatttggtctctttggcagcggtattaactgggtctatgtcagcatcgcgacctttggtggaatgcctggcccggttaacgtcttcctggtggtgctgctggcggcgtatttgtcgctgtataccggactgtttgctggcgtgctgtcgcggttgtggtcaaaaaccacctggctgcgcgtggcgattgccgcccctgctctctggcaaatgaccgagtttctgcgcggttgggtgctgactggcttcccgtggttacagttcggctatagccagattgatggcccgttaaaagggctggcaccgataatgggcgtggaagccattaacttcctgctgatgatggttagcggcctgctggcactggcgttggtcaaacgcaactggcgtccgctggtggtggccgtcgtgctgtttgcccttcccttcccgctgcgttacatccagtggtttaccccgcaaccggagaaaaccattcaggtttcgatggttcagggcgatattccgcaatcgctgaaatgggacgaaggccagcttcttaatacgctgaagatttactacaacgcaacggcaccgctgatgggcaaatcatcgttgattatctggccggagtcggcgataaccgatctggaaattaatcagcaaccgttcctcaaagcactggacggtgagttgcgcgataaaggtagctcgctggtaaccgggattgttgacgcacgtctcaataagcagaaccgctacgatacctacaacaccatcatcacgctgggtaaaggtgcgccgtacagctacgaatcagccgatcgctataacaaaaaccatctggtgccgtttggcgagtttgtcccgctggagtcgattctgcgtccgttagcaccgttctttgatctgccgatgtcgtcgttcagccgtgggccatatatccaaccaccgctgtcggtaaatggtattgagcttactgcggctatttgctacgagatcattctcggcgagcaagtgcgcgataacttccgcccggataccgactatctgctgactatctccaacgatgcgtggtttggtaagtctattggtccatggcagcacttccagatggcgcgaatgcgtgcgctggagctggcgcgcccactgttgcgcagcaccaacaacggcattacggcggtgattggcccgcagggtgagattcaggcgatgatcccgcagttcacccgcgaggtgttgaccactaacgtgacaccaaccaccggactcacaccgtacgcacgaaccggcaactggccgctgtgggtgctgacggcgctgtttggttttgccgctgtactgatgagtctgcgtcagcgacgtaaacgttga

SEQ ID NO: 1548 - protein, 513 aa, Escherichia coli
MAFASLIERQRIRLLLALLFGACGTLAFSPYDVWPAAIISLMGLQALTFNRRPLQSAAIGFCWGFGLFGSGINWVYVSIATFGGMPGPVNVFLVVLLAAYLSLYTGLFAGVLSRLWSKTTWLRVAIAAPALWQMTEFLRGWVLTGFPWLQFGYSQIDGPLKGLAPIMGVEAINFLLMMVSGLLALALVKRNWRPLVVAVVLFALPFPLRYIQWFTPQPEKTIQVSMVQGDIPQSLKWDEGQLLNTLKIYYNATAPLMGKSSLIIWPESAITDLEINQQPFLKALDGELRDKGSSLVTGIVDARLNKQNRYDTYNTIITLGKGAPYSYESADRYNKNHLVPFGEFVPLESILRPLAPFFDLPMSSFSRGPYIQPPLSVNGIELTAAICYEIILGEQVRDNFRPDTDYLLTISNDAWFGKSIGPWQHFQMARMRALELARPLLRSTNNGITAVIGPQGEIQAMIPQFTREVLTTNVTPTTGLTPYARTGNWPLWVLTALFGFAAVLMSLRQRRKR

SEQ ID NO: 1549 - DNA, 879 bp, Escherichia coli
atgagcgacgacaattcacacagtagtgacacgataagcaacaagaagggatttttctccctgttactcagccaacttttccacggtgaaccaaaaaaccgtgacgaactgctggcgctgatccgtgattccgggcagaacgaccttatcgacgaagatacgcgcgatatgctcgaaggggtgatggacatcgcagaccaacgcgtccgcgacatcatgatcccccgctcccagatgattaccctgaaacgcaaccagacgctggacgaatgccttgatgtcatcatcgagtccgcccactcacgtttcccggtgattagcgaagacaaagatcacattgaagggattctgatggcgaaagacttgctgccgtttatgcgcagcgatgctgaagccttcagcatggacaaagtgttacgtcaggcggttgtcgttcctgaaagtaagcgcgtagaccggatgctgaaagagtttcgctctcagcgttaccacatggcgatcgtcattgacgaattcggtggggtttccggtctggtgaccattgaagacatcctggaactgattgttggtgagattgaagacgagtatgacgaagaagatgatatcgacttccgtcagctgagtcgtcatacctggaccgtgcgcgcactggcttctattgaagacttcaacgaagcgttcggcacccactttagcgatgaagaggttgacactatcggtggtctggtgatgcaggcatttgggcatcttccggcgcgtggcgaaaccatcgacatcgacggttaccagttcaaagtggcgatggccgacagtcggcgtattattcaggttcatgtcaaaatcccggatgactcaccccagccgaagctggatgaataa

SEQ ID NO: 1550 - protein, 292 aa, Escherichia coli
MSDDNSHSSDTISNKKGFFSLLLSQLFHGEPKNRDELLALIRDSGQNDLIDEDTRDMLEGVMDIADQRVRDIMIPRSQMITLKRNQTLDECLDVIIESAHSRFPVISEDKDHIEGILMAKDLLPFMRSDAEAFSMDKVLRQAVVVPESKRVDRMLKEFRSQRYHMAIVIDEFGGVSGLVTIEDILELIVGEIEDEYDEEDDIDFRQLSRHTWTVRALASIEDFNEAFGTHFSDEEVDTIGGLVMQAFGHLPARGETIDIDGYQFKVAMADSRRIIQVHVKIPDDSPQPKLDE

SEQ ID NO: 1551 - DNA, 468 bp, Escherichia coli
atgagtcaggtgatcctcgatttacaactggcatgtgaagataattccgggttaccggaagagagccagtttcagacatggctgaatgcggtgatcccgcagtttcaggaagaatcggaagtgacgattcgcgtggtcgataccgccgaaagccacagtctgaatctgacctatcgcggtaaggataagccgaccaacgtgctctccttcccgtttgaagtaccgcctggcatggaaatgtcgctactgggcgatctggttatctgccgtcaggtggttgagaaggaagctcaggagcaaggcaaaccactggaggcgcactgggcgcatatggtggtgcacggcagtctgcatttgttaggttacgatcacatcgaagacgacgaagcagaagaaatggaagccctcgaaacagagattatgcttgctctgggctatgaggatccgtacattgccgagaaagaataa

SEQ ID NO: 1552 - protein, 155 aa, Escherichia coli
MSQVILDLQLACEDNSGLPEESQFQTWLNAVIPQFQEESEVTIRVVDTAESHSLNLTYRGKDKPTNVLSFPFEVPPGMEMSLLGDLVICRQVVEKEAQEQGKPLEAHWAHMVVHGSLHLLGYDHIEDDEAEEMEALETEIMLALGYEDPYIAEKE

SEQ ID NO: 1553 - DNA, 1041 bp, Escherichia coli
ttgaacatagacactcgcgaaatcaccctggagccagcagacaatgcgcgtctgttgagcctgtgcggcccgtttgatgacaacatcaaacaactcgaacgccgtctcggcatcgagatcaatcgccgcgataaccactttaaactgaccggccgtccgatttgcgtcaccgcagcggcagacattctgcgtagcctgtatgtcgatactgccccgatgcgcggtcagattcaggatatcgaaccggaacagatccaccttgcgattaaagaagcgcgggtactggagcaaagcgcggagagcgtgccggagtacggcaaagcagtcaatatcaaaaccaaacgcggcgtaattaagccgcgcacgccaaaccaggcgcagtacatcgccaatattctcgaccatgacattaccttcggcgttggcccggcgggtacgggtaaaacctacctggcagtggctgcggcagttgatgccctggagcgtcaggaaattcgccgtattctgctgactcgtccggcggtcgaagccggtgagaaactgggcttcctgcctggcgatttaagccagaaagtagacccgtatctgcgcccgctgtacgacgcgctgtttgaaatgctgggctttgagaaagtcgagaaactgattgagcgcaacgttattgaagtcgcaccgctggcctatatgcgtggtcgtacgctgaacgacgcgtttatcattcttgatgagagccagaacaccaccatcgaacagatgaagatgttcctgacccgtatcggttttaactcaaaagcggttatcaccggcgacgtcacacagatcgacctgccgcgtaataccaagtctggtttgcgtcatgccatcgaagtgctggctgatgtcgaagagatcagctttaacttcttccacagcgaagacgtggttcgtcacccggtggtggcgcgtatcgttaacgcctatgaagcctgggaagaagccgaacaaaaacgtaaagcggcgctggcagcagaacgcaagcgcgaagaacaggaacaaaaatga

SEQ ID NO: 1554 - protein, 346 aa, Escherichia coli
MNIDTREITLEPADNARLLSLCGPFDDNIKQLERRLGIEINRRDNHFKLTGRPICVTAAADILRSLYVDTAPMRGQIQDIEPEQIHLAIKEARVLEQSAESVPEYGKAVNIKTKRGVIKPRTPNQAQYIANILDHDITFGVGPAGTGKTYLAVAAAVDALERQEIRRILLTRPAVEAGEKLGFLPGDLSQKVDPYLRPLYDALFEMLGFEKVEKLIERNVIEVAPLAYMRGRTLNDAFIILDESQNTTIEQMKMFLTRIGFNSKAVITGDVTQIDLPRNTKSGLRHAIEVLADVEEISFNFFHSEDVVRHPVVARIVNAYEAWEEAEQKRKAALAAERKREEQEQK

SEQ ID NO: 1555 - DNA, 1425 bp, Escherichia coli
atgaccaaaaaactccatattaaaacctggggctgtcagatgaacgagtacgattcatcgaagatggccgatctgctggatgccacccacggctatcaactgaccgacgtggcggaagaagcggatgtgctgctgctgaacacctgctcaatccgcgagaaggctcaggaaaaagtcttccatcagttgggtcgctggaaactgttaaaagagaagaatccagacctgattatcggcgtcggcggctgcgtggcatcgcaagaaggcgagcacattcgccagcgcgcccactatgtcgatattatttttgggccgcaaacgctgcaccgcctgccggagatgatcaactccgtgcgcggcgaccgcagcccggttgtagatatcagcttcccggaaatcgagaagtttgaccgtctgccggaaccgcgtgccgaagggccgaccgcgtttgtctccatcatggaaggctgcaataaatattgcacctactgcgtagtgccatacacccgtggtgaagaggtaagccgtccgtccgacgatattctgtttgagatcgcccagcttgcggctcagggcgtgcgtgaagttaacctgctcggccagaacgtgaacgcctggcgcggtgagaactacgacggcaccaccggatcgtttgccgatctgctgcgtctggttgcggcgatcgacgggatcgatcgtattcgctttaccaccagccatccgatcgaattcaccgacgatatcatcgaagtgtatcgcgacacgccggagctggtgagcttcctgcacctgccggtacagagcggttccgatcgcattctgaacctgatgggccgtactcacacggcgctggagtacaaagcgatcatccgtaaactgcgtgcggcgcgtccggatattcagatcagttctgacttcatcgttggcttccctggcgaaaccaccgacgacttcgagaaaacgatgaagctgattgccgacgtcaatttcgacatgagctacagctttatcttctctgcacgtccgggtacaccagccgccgatatggttgatgatgttccggaagaagagaagaagcagcgtctgtatattctgcaagagcgcattaatcagcaagcgatggcatggagccgccggatgctcggcaccacccagcgcattctggtagaagggacttcacgtaagagcatcatggagctttccggtcgcactgaaaataaccgcgtggtcaacttcgagggcacaccggatatgatcggtaaattcgtcgatgtagaaattaccgacgtctacccgaactctctgcgcggtaaagtggtgcgaactgaagatgaaatgggtctgcgcgtggcagaaacaccggaatcggtgattgcccgtacccgcaaagaaaacgaccttggcgtgggttattatcagccgtaa

SEQ ID NO: 1556 - protein, 474 aa, Escherichia coli
MTKKLHIKTWGCQMNEYDSSKMADLLDATHGYQLTDVAEEADVLLLNTCSIREKAQEKVFHQLGRWKLLKEKNPDLIIGVGGCVASQEGEHIRQRAHYVDIIFGPQTLHRLPEMINSVRGDRSPVVDISFPEIEKFDRLPEPRAEGPTAFVSIMEGCNKYCTYCVVPYTRGEEVSRPSDDILFEIAQLAAQGVREVNLLGQNVNAWRGENYDGTTGSFADLLRLVAAIDGIDRIRFTTSHPIEFTDDIIEVYRDTPELVSFLHLPVQSGSDRILNLMGRTHTALEYKAIIRKLRAARPDIQISSDFIVGFPGETTDDFEKTMKLIADVNFDMSYSFIFSARPGTPAADMVDDVPEEEKKQRLYILQERINQQAMAWSRRMLGTTQRILVEGTSRKSIMELSGRTENNRVVNFEGTPDMIGKFVDVEITDVYPNSLRGKVVRTEDEMGLRVAETPESVIARTRKENDLGVGYYQP

SEQ ID NO: 1557 - DNA, 1176 bp, Escherichia coli
atgacaaatcaaccaacggaaattgccattgtcggcggaggaatggtcggcggcgcactggcgctggggctggcacagcacggatttgcggtaacggtgatcgagcacgcagaacctgcgccgtttgtcgctgacagccaaccggacgtgcggatctcggcgatcagcgcggcttcggtatcattgcttaaagggttaggggtctgggatgcagtacaggctatgcgttgccatccttaccgcagactggaaacgtgggagtgggaaacggcgcatgtcgtgtttgacgccgctgaacttaagctaccgttgcttggctacatggtggaaaacactgtcctgcaacaggcgttgtggcaggcgctggaagcgcatccgaaagtaacgttacgtgtgccaggctcgctgattgcactgcatcgccataatgatcttcaggagctggaactgaagggcggtgaaacgatcctcgcgaagctggtgattggtgccgacggcgcaaattcgcaggtgcgacagatggcgggaattggcgttcatgcctggcagtatgcgcagtcgtgtatgttaattagcgtacagtgtgagaacgatcccggcgacagcacctggcagcaatttaccccggacggaccgcgtgcgtttctgccgttgtttgataactgggcatcgctggtgtggtatgactctccggcgcgcattcgccagttgcagaatatgaatatggcgcagctacaggcggaaatcgcgaagcatttcccgtcgcgtctgggttacgtaacaccgcttgccgctggtgcgtttccgctgatacgtcgccatgcgttgcagtatgtgcaaccagggcttgctctggtgggcgatgccgcgcataccatccatccgctggcggggcagggagtgaatcttggttatcgtgatgtcgatgccctgattgacgttctggtgaacgcccgcagctacggcgaagcgtgggccagttatcctgtgctcaagcgttaccagatgcggcgtatggcggataacttcatgatgcaaagtggtatggatctgttttatgccggattcagcaataatctgccaccgctgcgttttgtgcgtaatcttggtttgatggcggcggagcgtgctggcgtgttgaaacgtaaggcgctgaaatatgcgttagggttgtag

SEQ ID NO: 1558 - protein, 391 aa, Escherichia coli
MTNQPTEIAIVGGGMVGGALALGLAQHGFAVTVIEHAEPAPFVADSQPDVRISAISAASVSLLKGLGVWDAVQAMRCHPYRRLETWEWETAHVVFDAAELKLPLLGYMVENTVLQQALWQALEAHPKVTLRVPGSLIALHRHNDLQELELKGGETILAKLVIGADGANSQVRQMAGIGVHAWQYAQSCMLISVQCENDPGDSTWQQFTPDGPRAFLPLFDNWASLVWYDSPARIRQLQNMNMAQLQAEIAKHFPSRLGYVTPLAAGAFPLIRRHALQYVQPGLALVGDAAHTIHPLAGQGVNLGYRDVDALIDVLVNARSYGEAWASYPVLKRYQMRRMADNFMMQSGMDLFYAGFSNNLPPLRFVRNLGLMAAERAGVLKRKALKYALGL

SEQ ID NO: 1559 - DNA, 1899 bp, Escherichia coli
gtggtttcttatttttacccatcattaaaatcaccccattcaataaaacccgtcaaaaattatcgatccatcaataaatatacccaaaagccctcccctttttcatcaatcagcaatcgccattacgttttttatttttccaccgccaaatcgcttgcgcaccgtgctgctttgcggcatttttttaacaagcaaacacaacacgcagtaaacaccaggttaacggagaaggttatgtgttcaatttttggcgtattcgatatcaaaacagacgcagttgagctgcgtaagaaagcactcgagctgtcacgcctgatgcgtcatcgtggcccggactggtccggtatttatgccagcgataacgccattctcgcccacgaacgtctgtcaattgttgacgttaacgcgggggcgcaacctctctacaaccaacaaaaaactcatgtgctggcagtaaacggtgaaatctacaaccaccaggcattgcgcgctgaatatggcgatcgttaccagttccagaccgggtctgactgtgaagtgatcctcgcgctgtatcaggaaaaagggccggaatttctcgacgacttgcagggcatgtttgcctttgccctgtacgacagcgaaaaagatgcatatctgattggtcgcgaccatctggggatcatcccactgtatatgggctatgacgaacacggtcagctgtatgtggcctcagaaatgaaagccctcgtgccagtttgccgcacgattaaagagtttccggcggggagctatttgtggagtcaggacggcgaaatccgttcttattatcatcgcgactggttcgactacgatgcggtgaaagataacgtgaccgacaaaaacgagctgcgtcaggcactggaagattccgttaaaagccatctgatgtctgatgtgccttacggtgtgctgctttctggtggtctggattcctcaattatttccgctatcaccaagaaatacgccgcccgtcgcgtggaagatcaggaacgctctgaagcctggtggccgcagttgcactcctttgctgtaggtctgccgggctcaccggatctgaaagcagcccaggaagtggcaaaccatcttggcacggtgcatcacgaaattcacttcactgtacaggaaggtctggatgccatccgcgacgtgatttaccacatcgaaacctatgacgtgacgacaatccgcgcttcaacaccgatgtatttaatgtcgcgtaagatcaaggcgatgggcattaaaatggtgctgtccggtgaaggttctgacgaagtgtttggcggttatctatacttccacaaagcgccgaacgctaaagagttgcatgaagagacggtgcgtaaactgctggccctgcatatgtatgactgcgcgcgtgccaacaaagcgatgtcagcctggggcgtggaagcacgcgttccgttcctcgacaaaaaattccttgatgtggcgatgcgcattaacccacaggataaaatgtgcggtaacggcaaaatggaaaaacacatcctgcgtgaatgttttgaagcgtatctgcctgcaagcgtggcctggcggcaaaaagagcagttctccgatggcgtcggttacagttggatcgacaccctgaaagaagtggcagcgcagcaggtttctgatcaacagctggaaactgcccgcttccgcttcccgtacaacacgccgacctcaaaagaagcgtatctgtaccgggagatctttgaagaattgttcccgcttccgagcgccgctgagtgcgtgccgggcggtccttccgtcgcttgttcttccgctaaagcgattgagtgggatgaagcgttcaagaaaatggacgatccgtctggtcgcgcggttggcgttcaccagtcggcatataaataa

SEQ ID NO: 1560 - protein, 632 aa, Escherichia coli
MVSYFYPSLKSPHSIKPVKNYRSINKYTQKPSPFSSISNRHYVFYFSTAKSLAHRAALRHFFNKQTQHAVNTRLTEKVMCSIFGVFDIKTDAVELRKKALELSRLMRHRGPDWSGIYASDNAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDYDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFEAYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 1561 - DNA, 753 bp, Escherichia coli
atgaccattaaaaatgtaatttgcgatatcgacggcgtgctgatgcacgataacgtcgccgtacccggtgcagcggaatttttgcacgggattatggataaaggcctgccgctggtgttgctgaccaactatccttcacagaccgggcaagatctggcgaatcgctttgccactgccggtgtcgatgtaccggatagcgtgttttatacctccgcgatggcgaccgccgatttcctgcgtcgccaggaaggcaagaaagcgtatgtggtgggcgaaggcgcactgattcatgaactgtacaaagccggtttcactattaccgatgtgaaccctgattttgtgattgttggcgaaacgcgttcctacaactgggacatgatgcataaagcagcctatttcgtcgctaacggtgcacgctttatcgccaccaacccggacacccacgggcgcggtttttatcccgcctgtggcgcgttgtgtgcagggatcgagaaaatctccgggcgcaaaccgttctatgttggaaagccgagtccgtggatcatccgcgcggcattaaacaaaatgcaggcgcattcggaagaaacggtgattgtcggcgataacttgcgtaccgatattctggcgggcttccaggccggtctggagacgattctggtgctttctggtgtttcgtcactcgacgatatcgacagtatgccgttccgcccaagttggatttacccatcggtcgctgaaatcgacgttatctga

SEQ ID NO: 1562 - protein, 250 aa, Escherichia coli
MTIKNVICDIDGVLMHDNVAVPGAAEFLHGIMDKGLPLVLLTNYPSQTGQDLANRFATAGVDVPDSVFYTSAMATADFLRRQEGKKAYVVGEGALIHELYKAGFTITDVNPDFVIVGETRSYNWDMMHKAAYFVANGARFIATNPDTHGRGFYPACGALCAGIEKISGRKPFYVGKPSPWIIRAALNKMQAHSEETVIVGDNLRTDILAGFQAGLETILVLSGVSSLDDIDSMPFRPSWIYPSVAEIDVI

SEQ ID NO: 1563 - DNA, 1221 bp, Escherichia coli
atgacaccaggcggacaagctcagataggtaatgttgatctcgtaaaacagcttaacagcgcggcagtttatcgcctgattgaccagtacgggccaatctcgcggattcagattgccgagcaaagtcagcttgcccccgccagcgtaaccaaaattacgcgtcagcttatcgaacgcgggctgatcaaagaagttgatcagcaggcctccaccgggggccgccgcgctatctccatcgtcaccgaaacccgcaatttccacgcaatcggcgtacggcttggtcgtcacgacgccaccatcaccttgtttgatctcagcagcaaagtgctggcagaagaacattacccgctgccggaacgtacccagcagacgctggaacatgccctgctgaatgccattgctcagtttattgatagctaccagcgcaagctacgcgagctgatcgcgatttcggtgatcctgccagggcttgtagacccggacagcggcaaaattcattacatgccgcatattcaggtagaaaactgggggctggttgaagcactggaagagcgttttaaagtgacctgttttgtcggccacgatatccgcagtctggcgctggcagagcactacttcggtgcaagtcaggattgcgaagactccattctggtgcgtgtccatcgcggaaccggggccgggattatctctaacgggcgaatttttatcgggcgcaacggcaacgtcggtgaaattggccatattcaggtcgaaccgctgggtgaacgctgccactgcggcaactttggctgcctggaaactatcgccgccaatgctgccattgaacaacgggtgttgaatctgttaaagcagggctaccagagccgtgtgccactggacgactgcaccatcaaaactatctgcaaagccgcgaacaaaggcgatagcctggcctcggaagtgattgaatatgtcggtcgtcatctgggtaaaaccatcgccattgctatcaacttatttaatccgcaaaaaattgttattgctggagaaatcaccgaagccgataaagtgctgctccctgctattgaaagctgcattaatacccaggcgttgaaggcgtttcgtactaatctaccggtggtacgttctgagttggatcaccgctcggcaatcggcgcttttgcgctggtaaaacgcgccatgctcaacggtattttgctccagcatttgctggaaaattaa

SEQ ID NO: 1564 - protein, 406 aa, Escherichia coli
MTPGGQAQIGNVDLVKQLNSAAVYRLIDQYGPISRIQIAEQSQLAPASVTKITRQLIERGLIKEVDQQASTGGRRAISIVTETRNFHAIGVRLGRHDATITLFDLSSKVLAEEHYPLPERTQQTLEHALLNAIAQFIDSYQRKLRELIAISVILPGLVDPDSGKIHYMPHIQVENWGLVEALEERFKVTCFVGHDIRSLALAEHYFGASQDCEDSILVRVHRGTGAGIISNGRIFIGRNGNVGEIGHIQVEPLGERCHCGNFGCLETIAANAAIEQRVLNLLKQGYQSRVPLDDCTIKTICKAANKGDSLASEVIEYVGRHLGKTIAIAINLFNPQKIVIAGEITEADKVLLPAIESCINTQALKAFRTNLPVVRSELDHRSAIGAFALVKRAMLNGILLQHLLEN

SEQ ID NO: 1565 - DNA, 1149 bp, Escherichia coli
atgtatgcattaacccagggccggatctttaccggccacgaatttcttgatgaccacgcggttgttatcgctgatggcctgattaaaagcgtctgtccggtagcggaactgccgccagagatcgaacaacgttcactgaacggggccattctctcccccggttttatcgatgtgcagttaaacggctgcggcggcgtacagtttaacgacaccgctgaagcggtcagcgtggaaacgctggaaatcatgcagaaagccaatgagaaatcaggctgtactaactatctgccgacgcttatcaccaccagcgatgagctgatgaaacagggcgtgcgcgttatgcgcgagtacctggcaaaacatccgaaccaggcgttaggtctgcatctggaaggtccgtggctgaatctggtaaaaaaaggcacccataatccgaattttgtgcgtaagcctgatgccgcgctggtcgatttcctgtgtgagaacgccgacgtcattaccaaagtgactctggcaccggaaatggttccagcggaagtcatcagcaaactggcaaatgccgggattgtggtttctgctggtcactccaacgcgacgttgaaagaagcgaaagccggtttccgcgcggggattacctttgccacccatctgtacaacgcgatgccgtatattaccggtcgtgaaccgggcctggcgggcgcgatcctcgacgaagctgacatttattgcggtattattgctgatggcctgcatgttgattacgccaacattcgtaacgctaaacgtctgaaaggcgacaaattgtgtctggttaccgatgccaccgcgccagcaggtgccaacattgaacagttcatttttgcgggtaaaacaatatactaccgtaacggactttgtgtggatgagaacggtacgttaagcggttcatccttaaccatgattgaaggcgtgcgtaatctggtcgaacattgtggtatcgcactggatgaagtgctgcgtatggcgacgctctatccggcacgtgcgattggcgttgagaaacgtctcggcacgctcgccgcaggtaaagttgccaacctgactgcattcacacctgattttaaaatcaccaggaccatcgttaacggtaacgaggtcgtaactcaataa

SEQ ID NO: 1566 - protein, 382 aa, Escherichia coli
MYALTQGRIFTGHEFLDDHAVVIADGLIKSVCPVAELPPEIEQRSLNGAILSPGFIDVQLNGCGGVQFNDTAEAVSVETLEIMQKANEKSGCTNYLPTLITTSDELMKQGVRVMREYLAKHPNQALGLHLEGPWLNLVKKGTHNPNFVRKPDAALVDFLCENADVITKVTLAPEMVPAEVISKLANAGIVVSAGHSNATLKEAKAGFRAGITFATHLYNAMPYITGREPGLAGAILDEADIYCGIIADGLHVDYANIRNAKRLKGDKLCLVTDATAPAGANIEQFIFAGKTIYYRNGLCVDENGTLSGSSLTMIEGVRNLVEHCGIALDEVLRMATLYPARAIGVEKRLGTLAAGKVANLTAFTPDFKITRTIVNGNEVVTQ

SEQ ID NO: 1567 - DNA, 801 bp, Escherichia coli
atgagactgatccccctgactaccgctgaacaggtcggcaaatgggctgctcgccatatcgtcaatcgtatcaatgcgttcaaaccgactgccgatcgtccgtttgtactgggcctgccgactggcggcacgccgatgaccacctataaagcgttagtcgaaatgcataaagcaggccaggtcagctttaagcacgttgtcaccttcaacatggacgaatatgtcggtctgccgaaagagcatccggaaagctactacagctttatgcaccgtaatttcttcgatcacgttgatattccagcagaaaatatcaaccttctcaacggcaacgccccggatatcgacgccgaatgccgccagtatgaagaaaaaatccgttcttacggaaaaattcatctgtttatgggcggtgtaggtaacgacggtcatattgcatttaacgaaccggcgtcttctctggcttctcgtactcgtatcaaaaccctgactcatgacactcgcgtcgcgaactctcgtttctttgataacgatgttaatcaggtgccaaaatatgccctgactgtcggtgttggtacattgctggatgccgaagaagtgatgattctggtgctgggtagtcagaaagcactggcactgcaggccgccgttgaaggttgcgtgaaccacatgtggaccatcagctgtctgcaactgcatccaaaagcgatcatggtgtgcgatgaaccttccaccatggagctgaaagttaagactttaagatatttcaatgaattagaagcagaaaatatcaaaggtctgtaa

SEQ ID NO: 1568 - protein, 266 aa, Escherichia coli [sequence omitted]

SEQ ID NO: 1569 - DNA, 1947 bp, Escherichia coli
atgaatattttaggttttttccagcgactcggtagggcgttacagctccctatcgcggtgctgccggtggcggcgctgttgctgcgattcggtcagccagatttacttaacgttgcgtttattgcccaggcgggcggtgcgatttttgataacctcgcattaatcttcgccatcggcgtggcatccagctggtcgaaagacagcgcaggtgcggcggcactggcgggtgcggtaggttactttgtgttaaccaaagcgatggtgaccatcaacccagaaattaacatgggtgtactggcgggtatcattaccggtctggttggtggcgcagcctataaccgttggtccgatattaaactgccggacttcctgagcttcttcggcggcaaacgctttgtgccgatcgccaccggcttcttctgtctggtgctggcggccatttttggttacgtctggccaccggtacagcacgctatccatgcaggcggcgagtggatcgtttctgcgggcgcgctgggttccggtatctttggtttcatcaaccgtctgctgatcccaaccggtctgcatcaggtgctgaacaccatcgcctggttccagattggtgaattcaccaacgcggcgggaacggttttccacggtgatatcaaccgcttctatgccggtgacggcaccgcggggatgttcatgtccggcttcttcccgattatgatgttcggtctgccgggtgcggcgctggcgatgtacttcgcagcaccgaaagagcgtcgtccgatggttggcgggatgctgctttctgttgctgttactgcgttcctgaccggtgtgactgagccgctggaattcctgttcatgttccttgcaccgctgctgtacctcctgcacgcactgctgaccggtatcagcctgtttgtggcaacgctgctgggtatccatgccggcttctctttctctgcgggggctatcgactacgcgttgatgtataacctgccggccgccagccagaacgtctggatgctgctggtgatgggggttgtcttcttcgctatctacttcgtggtgttcagtttggttatccgcatgttcaacctgaaaacgccgggtcgtgaagataaagaagacgagatcgttactgaagaggctaacagcaatactgaagaaggtctcaatcaactggcaaccaactatattgctgcggttggcggtactgacaacctgaaagccattgacgcctgtattactcgtctgcgccttaccgtggttgactcagctcgcgtcaacgatgcgatgtgtaaacgtctgggtgcttctggggtagtgaaactgaacaaacagactattcaggtgattgttggcgcgaaagcagaatccatcggcgatgcgatgaagaaagtcgttgcccgtggtccggtagccgctgcgtcagctgaagcaactccggcaactgccgctcctgtagcaaaaccgcaggctgtaccaaacgcggtatctatcgcggagctggtatcgccgattaccggggatgttgtggcactggatcaggttcctgacgaagcattcgccagcaaagcggtgggtgacggtgtggcggtgaaaccgacagataaaatcgtcgtatcaccagccgcaggaacaatcgtgaaaatcttcaacaccaaccacgcattctgtctggaaaccgaaaaaggcgcggagatcgtcgtccatatgggtatcgacaccgtagcgctggaaggtaaaggctttaaacgtctggtggaagagggcgcgcaggtaagcgcagggcaaccgattctggaaatggatctggattacctgaacgctaacgctcgctcgatgattagcccggtggtttgcagcaatatcgacgatttcagcggccttatcattaaagctcagggccatgttgtggcgggtcaaacaccgctgtatgaaatcaaaaagtaa

SEQ ID NO: 1570 - protein, 648 aa, Escherichia coli
MNILGFFQRLGRALQLPIAVLPVAALLLRFGQPDLLNVAFIAQAGGAIFDNLALIFAIGVASSWSKDSAGAAALAGAVGYFVLTKAMVTINPEINMGVLAGIITGLVGGAAYNRWSDIKLPDFLSFFGGKRFVPIATGFFCLVLAAIFGYVWPPVQHAIHAGGEWIVSAGALGSGIFGFINRLLIPTGLHQVLNTIAWFQIGEFTNAAGTVFHGDINRFYAGDGTAGMFMSGFFPIMMFGLPGAALAMYFAAPKERRPMVGGMLLSVAVTAFLTGVTEPLEFLFMFLAPLLYLLHALLTGISLFVATLLGIHAGFSFSAGAIDYALMYNLPAASQNVWMLLVMGVVFFAIYFVVFSLVIRMFNLKTPGREDKEDEIVTEEANSNTEEGLNQLATNYIAAVGGTDNLKAIDACITRLRLTVVDSARVNDAMCKRLGASGVVKLNKQTIQVIVGAKAESIGDAMKKVVARGPVAAASAEATPATAAPVAKPQAVPNAVSIAELVSPITGDVVALDQVPDEAFASKAVGDGVAVKPTDKIVVSPAAGTIVKIFNTNHAFCLETEKGAEIVVHMGIDTVALEGKGFKRLVEEGAQVSAGQPILEMDLDYLNANARSMISPVVCSNIDDFSGLIIKAQGHVVAGQTPLYEIKK

SEQ ID NO: 1571 - DNA, 1281 bp, Escherichia coli
atgacaatggaaatgatcctggcattaggaatactggtcctgatgatcgtgctgatcatgtcggacaaaatgccttttggcgcaccgccactgcttgcgtgtttattgctggttgtatcgggactttcgaccgttcaacaggcttttgccggattcgtcaatccaagcgtggtgatgattgcagggtttatggtggtcatggcggcgctacaaaaaacccggcttatcagcaacgttaaatctgcgatgataagcctggtcaataaaggcagttaccgcagctatgggctgttgttagtcattgttatgctgggtgccagtcttgccggcaccggagcgaccggttattacgtgctaattctgtcgctggtatccaccattccgtacagtaaaaagctaccaacatcgaaattaatgatgcccctgggatttgccaccaaccacccgcttcttcctatcaatctcgcgcttctctttggcgttacggcgaccgtactcgaaaccgcggggtttcatcaggagatttcgatggggcgctttgcgctggtgaatctcatcatgtcagcggctttcctcgcatggagtcttattgcctaccgttttcttccggatcatcccattgcggatgcttccgaggatgcgctggcggcacgcgaggaaacgtttaacgcccttcctgcctggaaagaatattgcactattgccgcattcgctgtcagcgttatcggcatgatgctaatgaacattctgggaaatatcgccttcgttattccgggtcttgcgggtgcgtttgttctgatgatcgatgtactggacttcaaagaagttcgcgatcatatgggggctccggtcattttaatgatggcgggggtgatcggtatagctgatgcactggcgggcaccggctttacggcgatggttggcgatgccgttgcaggtgtgctcggttctggcgtctcaccgtttgtatttattgtcgcctttgctttgcttaccagtacctgcgccaccttcacgggttcgaatatggggtcagtatatatttttgcccccatcgccattgccgcctgtactagccttgggcttaacccgaccgctgccgcgattgcggtggtgatttctggctggaatggcggctatatgcctattgacggaatgccagccatgatcctcggaatggggaaatacaaacttcccgaattctgggtgttctctgtaccaatgtatctcatccgcattctggcgctttgtgcaggcgctgtttttatcttcccaatgtaa

SEQ ID NO: 1572 - protein, 426 aa, Escherichia coli
MTMEMILALGILVLMIVLIMSDKMPFGAPPLLACLLLVVSGLSTVQQAFAGFVNPSVVMIAGFMVVMAALQKTRLISNVKSAMISLVNKGSYRSYGLLLVIVMLGASLAGTGATGYYVLILSLVSTIPYSKKLPTSKLMMPLGFATNHPLLPINLALLFGVTATVLETAGFHQEISMGRFALVNLIMSAAFLAWSLIAYRFLPDHPIADASEDALAAREETFNALPAWKEYCTIAAFAVSVIGMMLMNILGNIAFVIPGLAGAFVLMIDVLDFKEVRDHMGAPVILMMAGVIGIADALAGTGFTAMVGDAVAGVLGSGVSPFVFIVAFALLTSTCATFTGSNMGSVYIFAPIAIAACTSLGLNPTAAAIAVVISGWNGGYMPIDGMPAMILGMGKYKLPEFWVFSVPMYLIRILALCAGAVFIFPM

SEQ ID NO: 1573 - DNA, 105 bp, Escherichia coli
atgaaaccccgcggtttcgagtacggtcgccgtaacgccaaagagaagcgcgagattgataggaagaagcgggtggttggtggcaaatcccaggggcatcattaa

SEQ ID NO: 1574 - protein, 34 aa, Escherichia coli
MKPRGFEYGRRNAKEKREIDRKKRVVGGKSQGHH

SEQ ID NO: 1575 - DNA, 471 bp, Escherichia coli
atgattatcggtaatctcaaccatttgtcgctggcggggcttcctgcctgggtgagaaatattctgctgcgcccggagtgttcattatcggcgttatccaccagagaggacggtcgctggcaacctgaaggatgtcggtggttctgcacgctgggaacttcagacacgcaacccgccgaactccgccatacggagtatcaccatttatgggccgatatacaggtggtgattactggttgtgagggcattaatgcgggaacgcggcccatcgctcgcgaaaacgatgaagaacgtaagcccgatctgtttatcgccccatcccctgaaaacagtgtcgccatcaccctacacgccggtgatttcgccgtctttatgcctgaggaacctcaccaggcgctgtgcgcaattggcacggctacttcaatacgcaaagcggtctttaaagtaccgcgcgacatgctggaagcctaa

SEQ ID NO: 1576 - protein, 156 aa, Escherichia coli
MIIGNLNHLSLAGLPAWVRNILLRPECSLSALSTREDGRWQPEGCRWFCTLGTSDTQPAELRHTEYHHLWADIQVVITGCEGINAGTRPIARENDEERKPDLFIAPSPENSVAITLHAGDFAVFMPEEPHQALCAIGTATSIRKAVFKVPRDMLEA

SEQ ID NO: 1577 - DNA, 1170 bp, Escherichia coli
atgtctgtagcccttattcgtgacggcgtcatccgtccatccgaaaacgattcgcatgtgcttaccgccatgctgccctcgtcctgcccgcaaaaccacgcggcgaatattctgcctttgccggatggcgcgttaatgtgcgtctggtttgcgggaacgcaggaaggtattgccgatatttctgtctggggatcgcgattgcccgctggcggaatgcagtggagcgatgcggtcaaactttcccacgatgacacgcgttcagagcaaaacccggtgctgtttctcgcgccggataacgtgctgtggctcctatggaccgcacaaatatccggtaatcaggacaccgccatcgtccgctaccgtaagtcagacgacctcggacaaacctggggcgagattgccaccctgcttgataaacccggtacgttcattcgacagccaatcacggtgcttgataacggcaactggctgctgcccgtcttttattgccgtacccaacccggcgaaaaatgggtcggcaatgatgatatcagcgcagtgaaaatttccgctgacggtggtcactcctggcgcgatgtcgaggtgccgcaaagtctcggctgtgttcatatgaatatcacaatgttgcacgacggtacgttggttgctctctttcgcagccgttgggcagacaacatctatatcagccattcagtggacaacggcgagagttggtcggtgccgcaagcaaccgaattgcccaacaacaattcgtctattcaggtaacgacgcttgccagcggcgaactggcgctggtgtacaacgcgatgagtgcggcaggcgcagtagaacgtcgcgcgtcgctttatgacgaaatcgtcgatggcgacgacagccgcaaagaaccgacagccgtcggacgctccgctttctggggtgccccacgcgcgccgatgacggtagcgatttctgccgatggtgggaaaagctggccgtggcggcgcaatctcgatgaaggcgacggctactgcatgaccaacaattccctggaaaagctaaatcgtgagttctcctaccccagcatcaaacaaagcccggacggtacgctacatatcgcttacacctggtggcgtcaggccatcaagtacgtacgcatctcccccgagtgggttaaggggcaggcatcatga

SEQ ID NO: 1578 - protein, 389 aa, Escherichia coli
MSVALIRDGVIRPSENDSHVLTAMLPSSCPQNHAANILPLPDGALMCVWFAGTQEGIADISVWGSRLPAGGMQWSDAVKLSHDDTRSEQNPVLFLAPDNVLWLLWTAQISGNQDTAIVRYRKSDDLGQTWGEIATLLDKPGTFIRQPITVLDNGNWLLPVFYCRTQPGEKWVGNDDISAVKISADGGHSWRDVEVPQSLGCVHMNITMLHDGTLVALFRSRWADNIYISHSVDNGESWSVPQATELPNNNSSIQVTTLASGELALVYNAMSAAGAVERRASLYDEIVDGDDSRKEPTAVGRSAFWGAPRAPMTVAISADGGKSWPWRRNLDEGDGYCMTNNSLEKLNREFSYPSIKQSPDGTLHIAYTWWRQAIKYVRISPEWVKGQAS

SEQ ID NO: 1579 - DNA, 345 bp, Escherichia coli
ttgtgcggtgccattgtacagataatgctgctcgatatcgtgtttagcctggattcggtgatcaccgccgtcggcctttctcagcatatatttatcatgattgccgccgtaatgattgccgtcggtgtcatgatgtttgcggcgaaaacaattggtgatttcgttaacgccacgccgtcaataaaaatactggcgttaacctttttattgtttgtcggtgtattgctggttgccgatagtctcaacattcatattgccaaagagtatctctacttcgcgatatttttctcattaagtgttgagacactcaatattatccgtgaaagaagaaagtttcgacattga

SEQ ID NO: 1580 - protein, 114 aa, Escherichia coli
MCGAIVQIMLLDIVFSLDSVITAVGLSQHIFIMIAAVMIAVGVMMFAAKTIGDFVNATPSIKILALTFLLFVGVLLVADSLNIHIAKEYLYFAIFFSLSVETLNIIRERRKFRH

SEQ ID NO: 1581 - DNA, 294 bp, Escherichia coli
atgtttttgtggtttatgcagccagatatctggctcactttaattaccctcacctttctggaaattattcttggggtggataatattatttttctttcactggtggtggcaaaacttccgttatcacaacaaaatatggcgcgtaaactgggtttaagctgcgcgatgattatgcggatattattgctgatatccattgcgtggctttcacatattacccagccgctttttaccgtgctgacgctggagatttcgttccgcacgttgattctgctcggggcgggctgttcctga

SEQ ID NO: 1582 - protein, 97 aa, Escherichia coli
MFLWFMQPDIWLTLITLTFLEIILGVDNIIFLSLVVAKLPLSQQNMARKLGLSCAMIMRILLLISIAWLSHITQPLFTVLTLEISFRTLILLGAGCS

SEQ ID NO: 1583 - DNA, 888 bp, Escherichia coli
atgccgaaaaccattgaaggtgtattaaccgctatcgtcaccccgtttaccgcgaccggcagtctgaatatcccggcgttaaaagtgcaggtgaatcgtcaactggaagcgggtaacgcgattttttgcggcggcaccaacggcgagttttttgtgttgaatgaacaggagaagctcagcgttacgcaaacctgcgtggatgaagtggctggtcgtgcgccggtcgtggcacacattggcgagatctctacgcgcgaaacgattcgtctgggtcagcagattgaaaaacttggcgtagatgccgtgtcggtcattgccccttacttcgtaccgctgaaacaggaagagttgattgcgcattacagcgcaattgccgacgcactgagcattccgatgtttctctataacatcccggcccgcactggcaatacgatccagccagaaaccgcgcgtgctctggcgtcgcaccccaatatcattgggattaaagacagcgccggaagcgacgaaagcctgaagggttttctcgatgcggtgcgcgacattgacggctttaatgtgctcaacggcccggattcgctgatccataaagggtttgtcgagggatgttcagcctgtatctctgggctcgccaacatcgcgccgcgagaaatcaatgccatctggtctcgcttccatgccggtgatattgaagggtcttatgaagcacaggagagtgtaacgggcctgcgtaccgatctttataaagtagcattctccccggctgcggtgaaaaaagcgttgcagcttatggggcatgatgttggtgatagccgctacgcggttaatttcacgcctgaacagatcagcgagattcaacaaattattcgtcattataacattaattaa

SEQ ID NO: 1584 - protein, 295 aa, Escherichia coli
MPKTIEGVLTAIVTPFTATGSLNIPALKVQVNRQLEAGNAIFCGGTNGEFFVLNEQEKLSVTQTCVDEVAGRAPVVAHIGEISTRETIRLGQQIEKLGVDAVSVIAPYFVPLKQEELIAHYSAIADALSIPMFLYNIPARTGNTIQPETARALASHPNIIGIKDSAGSDESLKGFLDAVRDIDGFNVLNGPDSLIHKGFVEGCSACISGLANIAPREINAIWSRFHAGDIEGSYEAQESVTGLRTDLYKVAFSPAAVKKALQLMGHDVGDSRYAVNFTPEQISEIQQIIRHYNIN

SEQ ID NO: 1585 - DNA, 1158 bp, Escherichia coli
gtggtaattatcaatagcacgatactgagcggcgcaggcgctatcccttccctgacgtcgctcttacccgacatcagaaaaatgctgctggtcactgaccgtaatattgcgcagctcgacggtgtgcagcagattcgcgccttactggaaaagcactgcccgcaggttaacgttatcgataatgtgcccgcagagcccacgcatcatgatgtgcgccagctaatggatgcccttggcgatgcctcttttgatgtggtggtcgggatcggcggtggcagcgtgttggatgtggcgaagctgctgtcggtgctttgccatccacaatcaccggggctggatgcgctgcttgcgggtgaaaaaccgactcagcgggtgcaatcatggttgattcctacaaccgccggaaccggctcagaagccacgccgaatgcgattctggcaatccctgaacaaagcacgaaggtgggtattatttcccaggtgctgttaccagactatgtggcgcttttcccggaactgaccaccagcatgcccgcgcatattgcggcgtccacgggcattgatgctctttgccacttactggagtgttttaccgcgaccgtggcaaatccggtcagcgataacgcggcgctgactgggttaagtaaacttttccggcacattcaacccgccgtgaacgatcctcaggatctgcgcgcaaaactggaaatgctgtgggcgtcttactatggcggcgtagcgataacccatgcgggcacgcatctcgttcatgcgctctcctacccgttaggtggcaaatatcatctgccgcatggcgtcgcgaatgccatcttgctggcgccgtgcatggcgtttgttcgcccctgggcggtcgagaaatttgcccgggtctgggattgcattcccgatgcggaaaccgccctgagcgcggaagaaaaatctcatgccctggtgacctggttacaggcattagtcaatcaactcaagctacccaacaatctcgcggatctcggcgtaccgccagaggatattgcctctctgagcgaggcggcactgaacgtgaagcgccttatgaacaatgtgccgtgccagcttgatctacaggacgtacaggccatttaccaaacactgtttccgcaacatcaatttaaggaataa

SEQ ID NO: 1586 - protein, 385 aa, Escherichia coli
MVIINSTILSGAGAIPSLTSLLPDIRKMLLVTDRNIAQLDGVQQIRALLEKHCPQVNVIDNVPAEPTHHDVRQLMDALGDASFDVVVGIGGGSVLDVAKLLSVLCHPQSPGLDALLAGEKPTQRVQSWLIPTTAGTGSEATPNAILAIPEQSTKVGIISQVLLPDYVALFPELTTSMPAHIAASTGIDALCHLLECFTATVANPVSDNAALTGLSKLFRHIQPAVNDPQDLRAKLEMLWASYYGGVAITHAGTHLVHALSYPLGGKYHLPHGVANAILLAPCMAFVRPWAVEKFARVWDCIPDAETALSAEEKSHALVTWLQALVNQLKLPNNLADLGVPPEDIASLSEAALNVKRLMNNVPCQLDLQDVQAIYQTLFPQHQFKE

SEQ ID NO: 1587 - DNA, 1236 bp, Escherichia coli
atggaaaagggaatcactaagccgagcattctcgtcgttgccgatgatttcacgggagccaacgacgcgggggtaagcctggcgcaggtggggcatacagttgatgtggcctttgaaatgcattatcgcggtgatgccagcgtatgggtgattaacagcgacagccgggcgatggatcctaagctggcggcgatgaaaataacctcgctgatgagtcatctccctctggcgaataatccgccgctcgtgattaaaaagatagattccacgctgcgaggcaatatcggcgcagaaattgaagccctgatgaaggcatgcggtataacgggcgcagtggttgcccccgcatttcctcaggcgggaaggaccacagtggccggtgagtgttgggtaaacggtgtgcggataacggaaaccgagtttgccagcgatccgaaaaccccggtattgagcgcccgaattgcggatatcatccggttgcagacggccattccatgccagcccgttacggtttctcagctcagccatttgtcttatgagcaaccgtggattggcgtgatagatgcgcagacggacagcgacctggatcgcatcgctgccgctgtgatgcaggctaaacaaccgctgctgctggtcggctccgctggtatttgtgatgccgttgcccggcgctccgcgattatgtcgccacccaccgtgctggccattattggttcaatgagcgaaatcgctcaacggcagatcgccacacttcattcacacccacgtatcacacagatatacgtcgatgttgaacacattctggcaggcaatgccagtgactatgacgcgcgtattgtgcaggccttgcagaaaggcgaccactgcattgtccacacctgtaacgattctgtagcaagacatcagatcgacaccctttgccagcgttggcagatgagtcgcgctgcacttggggaaaaaatttgccggtttcttggcgaacttacccggcaagttctgcttcgcacaatgcccgatgcgctttatctctctggtggtgatgtcgcaatggcaacagccagtgcgttaggcgcgaccggatttcgtattacggggaaggtggcgcaatgcgttccatacggtcactttctgggcggtgtctggtcccgttcggtgatgacgaaagccggtgggtttggcgatgagaccacgttgcatcaggttctgaattttatcgaggagaagtgtagtgaataa

SEQ ID NO: 1588 - protein, 411 aa, Escherichia coli
MEKGITKPSILVVADDFTGANDAGVSLAQVGHTVDVAFEMHYRGDASVWVINSDSRAMDPKLAAMKITSLMSHLPLANNPPLVIKKIDSTLRGNIGAEIEALMKACGITGAVVAPAFPQAGRTTVAGECWVNGVRITETEFASDPKTPVLSARIADIIRLQTAIPCQPVTVSQLSHLSYEQPWIGVIDAQTDSDLDRIAAAVMQAKQPLLLVGSAGICDAVARRSAIMSPPTVLAIIGSMSEIAQRQIATLHSHPRITQIYVDVEHILAGNASDYDARIVQALQKGDHCIVHTCNDSVARHQIDTLCQRWQMSRAALGEKICRFLGELTRQVLLRTMPDALYLSGGDVAMATASALGATGFRITGKVAQCVPYGHFLGGVWSRSVMTKAGGFGDETTLHQVLNFIEEKCSE

SEQ ID NO: 1589 - DNA, 963 bp, Escherichia coli
atgggtgacccggcgggtattggcccggagatcattattaaatccctgagcgaagccgggcttgctggtgccccggtggtggtggtgggctgtgtgcgtacgctgcgacgtattatggcgatgaatatcacgccgcaggcagagttacgcgtcattcaaaaggtgtgcgacgcccattttgctcccggcgtgattaacgtgatggatgagccgctggctaaccccgatgcgctgacacccggagtggtacaggctgcggcaggcgatttagcgtatcgctgtatcaaacgtgcaacggctctggccttatcaggcgaggtgaaagccatagccactgcgccgctgaataaagaagcgctgcatcttggcgggcataactatccggggcatacggaattgctggcccatcttaccggcagcaaagagtacgcgatggtgctctataccgataagctcaaggttatccatatttcgactcacatctcactgcgtaaattcctggatactttgaatggtgaaagggtcaaaacggttattcgagttgcgaaccacttcctgaaacgtgttggtattgagcgtccgcgtattgccgtggcgggtgtaaatccacatgcaggggaacatggtttattcggcactgaggaaatcgagattatcgcgcctgcgattgaagcaatgcaggccgaagatattgatgttactggcccgtgcccgccagataccgtgtttatgcaatgccatgaagggctattcgatatggtagtggctatgtaccacgatcaggggcatatccctttaaaactgcttggattttatgatggggtgaatatcaccgccgggttgccatttattcgcacttctgccgaccacggcaccgcgtttgatattgcctggacaggaaaagccaagtctgagagcatggcagtttccatccagttagcaatgcagatttcgcgagaataa

SEQ ID NO: 1590 - protein, 320 aa, Escherichia coli
MGDPAGIGPEIIIKSLSEAGLAGAPVVVVGCVRTLRRIMAMNITPQAELRVIQKVCDAHFAPGVINVMDEPLANPDALTPGVVQAAAGDLAYRCIKRATALALSGEVKAIATAPLNKEALHLGGHNYPGHTELLAHLTGSKEYAMVLYTDKLKVIHISTHISLRKFLDTLNGERVKTVIRVANHFLKRVGIERPRIAVAGVNPHAGEHGLFGTEEIEIIAPAIEAMQAEDIDVTGPCPPDTVFMQCHEGLFDMVVAMYHDQGHIPLKLLGFYDGVNITAGLPFIRTSADHGTAFDIAWTGKAKSESMAVSIQLAMQISRE

SEQ ID NO: 1591 - DNA, 762 bp, Escherichia coli
atgaagggatataaccggttagagcagatcatggattacctgaaaagccataatctggtcaccgttgatgagctggtggcggtaaccaatgcgtcgccggctacgattcgtcgagacctgataaaactcgatgagcagggtgttatcagccgtacacacggcggtgtgaccctcaaccggtttattcctacccaaccgactacccatgagaaaatgcagcgcagcctggcggaaaaacatgccatcgccagcgcagcggcgtcaatggtcaaagcgggggattccgtcgtccttgatgccggtacgacaatgattgaacttgcgcggcagattacacatttaccgcttcgcgtgatcaccagcgacctgcatatcgcgctttttttggctgaattcaagcaaattgaagtgacgattatcggcggacgtatcgacgactccagccagtcctgcattggcgaacatggtcgtaaattgctgcaaaatacctggccggacgtggcatttttaagctgtaacagctgggatcttgaaaagggtattacagcacccacggaagagaaagccgcactaaaacgcgatcttatcgcgcatgcttcgcgcaaaattctcctggctgacagctcaaaatacggttcatggtcgctgtttaatatcgcgcatcttaatgaactgacagagattattacggatagtcagcttgatgggcagacgcgtagaacgcttgcgtccttgtcgacgcgtttaatcatagccgactaa

SEQ ID NO: 1592 - protein, 253 aa, Escherichia coli
MKGYNRLEQIMDYLKSHNLVTVDELVAVTNASPATIRRDLIKLDEQGVISRTHGGVTLNRFIPTQPTTHEKMQRSLAEKHAIASAAASMVKAGDSVVLDAGTTMIELARQITHLPLRVITSDLHIALFLAEFKQIEVTIIGGRIDDSSQSCIGEHGRKLLQNTWPDVAFLSCNSWDLEKGITAPTEEKAALKRDLIAHASRKILLADSSKYGSWSLFNIAHLNELTEIITDSQLDGQTRRTLASLSTRLIIAD

SEQ ID NO: 1593 - DNA, 1665 bp, Escherichia coli
atgagtgaggcagaagcccgcccgactaactttattcgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgtcgattcgatcaaaaacgacgtagagtggttaggtttccactggtctggtaacgtccgttactcctccgattattttgatcagctccacgcctatgcgatcgaactgatcaataaaggcctggcgtacgttgatgaactgacgccggaacagatccgcgaataccgcggcaccttgacgcagccgggtaaaaacagcccgtaccgcgatcgcagcgttgaagagaacctggcgctgttcgagaaaatgcgtaccggcggttttgaagaaggtaaagcctgcctgcgtgcgaaaatcgacatggcttcgccgtttatcgtgatgcgcgatccggtgctgtaccgcattaagtttgctgaacaccaccagactggcaacaagtggtgcatctacccgatgtacgacttcacccactgcatcagcgatgcgctggaaggtattacgcactctctgtgtacgcttgagttccaggacaaccgccgtctgtacgactgggtactggacaacatcaccattcctgttcacccgcgccagtacgaattctcgcgcctgaatctggaatacactgtgatgtccaagcgtaagctgaacctgctggtgaccgataagcacgttgaaggctgggatgacccgcgtatgccgaccatttctggtctgcgtcgtcgtggttacactgcggcttctattcgtgagttctgcaaacgcattggtgtgaccaagcaggacaacaccattgagatggcgtcactggaatcctgcatccgtgaagatctcaacgaaaatgcgccgcgcgcaatggcggttatcgatccggtgaaactggttatcgaaaactaccagggcgaaggcgaaatggttaccatgccgaaccatccgaataaaccggaaatgggcagccgtcaggtgccgtttagcggtgagatttggatcgatcgcgccgatttccgcgaagaagctaacaagcagtacaaacgtctggtgctgggtaaagaagtgcgtctgcgtaatgcttacgtcattaaggcagaacgcgtggagaaagatgccgaaggcaatatcaccaccatcttctgtacttatgacgccgacaccttaagcaaagatccggcagatggtcgtaaagtcaaaggtgttattcactgggtgagcgcggcacatgcgctgccggttgaaatccgtttgtatgaccgtctgttcagcgtgccgaaccctggtgctgcggatgatttcctgtcggtgattaacccggaatcgctggtgatcaaacagggctttgctgaaccgtcgctgaaagatgcggttgcgggtaaagcattccagtttgagcgtgaaggttatttctgcctcgacagccgccattctacggcggaaaaaccggtatttaaccgcaccgttgggctgcgtgatacctgggcgaaagttggcgagtaa

SEQ ID NO: 1594 - protein, 554 aa, Escherichia coli
MSEAEARPTNFIRQIIDEDLASGKHTTVHTRFPPEPNGYLHIGHAKSICLNFGIAQDYKGQCNLRFDDTNPVKEDIEYVDSIKNDVEWLGFHWSGNVRYSSDYFDQLHAYAIELINKGLAYVDELTPEQIREYRGTLTQPGKNSPYRDRSVEENLALFEKMRTGGFEEGKACLRAKIDMASPFIVMRDPVLYRIKFAEHHQTGNKWCIYPMYDFTHCISDALEGITHSLCTLEFQDNRRLYDWVLDNITIPVHPRQYEFSRLNLEYTVMSKRKLNLLVTDKHVEGWDDPRMPTISGLRRRGYTAASIREFCKRIGVTKQDNTIEMASLESCIREDLNENAPRAMAVIDPVKLVIENYQGEGEMVTMPNHPNKPEMGSRQVPFSGEIWIDRADFREEANKQYKRLVLGKEVRLRNAYVIKAERVEKDAEGNITTIFCTYDADTLSKDPADGRKVKGVIHWVSAAHALPVEIRLYDRLFSVPNPGAADDFLSVINPESLVIKQGFAEPSLKDAVAGKAFQFEREGYFCLDSRHSTAEKPVFNRTVGLRDTWAKVGE

SEQ ID NO: 1595 - DNA, 189 bp, Escherichia coli
atgaaaacggttacattttacttaattatggtttgtgattttaaatttgttttctggataaattgcgaagcggaattaattcgcgaagaaaagcagaaaaaaaacgccgcagagcgcggcgtttgggattgtttgcatatttcttgccggatgcggcgtaaacgcttcacccggcctggtagaacttaa

SEQ ID NO: 1596 - protein, 62 aa, Escherichia coli
MKTVTFYLIMVCDFKFVFWINCEAELIREEKQKKNAAERGVWDCLHISCRMRRKRFTRPGRT

SEQ ID NO: 1597 - DNA, 1407 bp, Escherichia coli
atgcgtacgtttagtggcaaacgtagtacgctggcgctggctatcgccggtgttacagctatgtcgggctttatggcaattccggaggctcgcgccgaaggattcatcgacgattcaaccttaaccggcggtatctattactggcagcgtgaacgcgaccgtaaagatgttaccgacggcgataaatacaaaaccaacctttctcactccacctggaacgccaacctcgattttcagtctggttatgctgctgatatgttcggccttgatattgccgcgtttacggcgattgaaatggcggaaaacggcgacagctctcacccgaacgaaatcgcgttttcaaaaagtaataaagcctatgacgaagactggtccggcgataaaagcggtataagcctgtataaagcagcggccaaatttaaatacggtccggtttgggcgagggcaggttatattcagccaaccggtcagacgctgttagcgccacactggagctttatgccgggtacttatcagggggcggaggccggggcgaattttgattacggcgatgctggtgcgttgagtttctcctacatgtggaccaacgaatacaaagcaccgtggcatctggaaatggatgagttttatcagaacgataaaaccaccaaagttgattatctacactcccttggggcgaagtacgacttcaaaaataacttcgtactggaagcggcgtttggtcaggccgaagggtatatcgatcaatattttgccaaagccagctacaaatttgatatcgccggtagcccgttaaccaccagctaccagttctatggtacgcgcgataaagttgacgatcgcagcgtcaacgatctttatgacggcaccgcctggctgcaggcgttgacctttggttaccgggcggctgacgtagtggatttgcgcctcgaaggtacctgggttaaggctgacggtcagcaaggatacttcctgcaacgtatgactccaacctacgcttcctcgaacggtcgcctggatatctggtgggataaccgttccgacttcaacgccaacggcgaaaaagcggtcttcttcggtgcgatgtatgacctgaaaaactggaatcttccaggcttcgccatcggcgcttcctacgtttacgcatgggatgctaaacctgcgacctggcagagcaatccggatgcgtactacgacaagaaccggactattgaagagtctgcctacagcctggatgcggtttacaccattcaggacggtcgtgccaagggcacgatgttcaaactgcatttcaccgaatatgacaaccactccgacatcccaagctggggcggtggttacggcaacatcttccaggatgagcgtgacgtgaaatttatggtaatcgcaccattcaccatcttctga

SEQ ID NO: 1598 - protein, 468 aa, Escherichia coli
MRTFSGKRSTLALAIAGVTAMSGFMAIPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSLGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 1599 - DNA, 327 bp, Escherichia coli
atgaaaaaattgattctcatcgccatgatggcatcggggctggtggcttgtgcacaatccaccgcgccacaggaagacagtcgtctgaaagaggcatacagcgcctgtatcaacaccgcacaaggttcgccggaaaaaattgaagcctgccagagcgtgttaaacgtgctgaagaaagagaaacaacatcagcagtttgccgagcaggaaagtgtccgcgtactggattatcagcagtgtattcaggcaacgcaaaccggaaatgatcaggcggtgaaagccgattgtgataaggtctggcaggaaattcgcagtaataacaaataa

SEQ ID NO: 1600 - protein, 108 aa, Escherichia coli
MKKLILIAMMASGLVACAQSTAPQEDSRLKEAYSACINTAQGSPEKIEACQSVLNVLKKEKQHQQFAEQESVRVLDYQQCIQATQTGNDQAVKADCDKVWQEIRSNNK

SEQ ID NO: 1601 - DNA, 447 bp, Escherichia coli
atgactgataacaataccgccctaaagaaagctggcctgaaagtaacgcttcctcgcttgaaaatcctggaagttcttcaggagccggacaaccatcacgtcagtgcggaagatttatacaaacgtctgatcgatatgggtgaagaaattggtctggctacggtatatcgcgtactgaaccagtttgacgacgctggtatcgtcacccgccacaattttgaaggcggtaaatccgtatttgaactaacacagcaacatcaccacgatcacctgatctgcctcgactgcggtaaggttatcgaatttagtgatgattccatcgaagcgcgtcagcgtgaaatcgccgcaaaacatggcattcgcctgactaaccacagtctctatctttacggtcactgtgccgaaggcgattgccgcgaagatgagcacgcgcacgaaggcaaataa

SEQ ID NO: 1602 - protein, 148 aa, Escherichia coli
MTDNNTALKKAGLKVTLPRLKILEVLQEPDNHHVSAEDLYKRLIDMGEEIGLATVYRVLNQFDDAGIVTRHNFEGGKSVFELTQQHHHDHLICLDCGKVIEFSDDSIEARQREIAAKHGIRLTNHSLYLYGHCAEGDCREDEHAHEGK

SEQ ID NO: 1603 - DNA, 228 bp, Escherichia coli
ttgggcaccatccgcgacatcattgaaccgcgcggcgcaactatcgttggtcactggccaaccgcgggctaccacttcgaagcgtcaaaaggtctggctgatgatgaccactttgtcggtctggctatcgacgaagatcgtcagccggaactgaccgctgaacgtgtagaaaaatgggttaaacaaatttctgaagagctgcatctcgacgaaattctcaatgcctga

SEQ ID NO: 1604 - protein, 75 aa, Escherichia coli
MGTIRDIIEPRGATIVGHWPTAGYHFEASKGLADDDHFVGLAIDEDRQPELTAERVEKWVKQISEELHLDEILNA

SEQ ID NO: 1605 - DNA, 312 bp, Escherichia coli
  n 12, 13, 14, 15, 16, 285, 286, 287, 288, 289: n is any nucleotide
atgaatgaatgnnnnngcgcggcattccggtgggtacgctggcgattgccaatgagagcaggccagcgtttaacgcttaaacgcccgcagcacgggatgcgcagttatctggcggtcgcgggtggtattgatgttccgccggtaatgggatcatgcagcaccgatctcaaagtggggattggcgggttggaaggccgtttactgagggatggtgaccgactcccgattggcaaagcgaagcgtgattttatggaagcgcagggcgttaaacagctgctgtggggnnnnncattccattcattaattaattaa

SEQ ID NO: 1606 - protein, 103 aa, Escherichia coli
  Xaa 4, 5, 6, 96, 97: Xaa is any amino acid
MNEXXXAAFRWVRWRLPMRAGQRLTLKRPQHGMRSYLAVAGGIDVPPVMGSCSTDLKVGIGGLEGRLLRDGDRLPIGKAKRDFMEAQGVKQLLWGXXFHSLIN

SEQ ID NO: 1607 - DNA, 312 bp, Escherichia coli; identical to SEQ ID NO: 1605
  n 12, 13, 14, 15, 16, 285, 286, 287, 288, 289: n is any nucleotide

SEQ ID NO: 1608 - protein, 103 aa, Escherichia coli; identical to SEQ ID NO: 1606
  Xaa 4, 5, 6, 96, 97: Xaa is any amino acid

SEQ ID NO: 1609 - DNA, 681 bp, Escherichia coli
ttgtgccacagggctgcaacaaataaggtttattccgagtttttctgcaagccaggcttgacgctatccgctgccgggatttattcatatactcctggcgacttgtattcagctaagacactgcactggattaagatgaaaacgattgaagttgatgatgaactctacagctatattgccagccacactaagcatatcggcgagagcgcatccgacattttacggcgtatgttgaaatttaccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggacgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccaaaacatgtgcctggtacgccgtattgggtgatcaccaacaccaacaccggccgtaaatgcagcatgatcgaacacatcatgcagtcgatgcaattcccggcggaattgattgagaaggtttgcggaactatctaa

SEQ ID NO: 1610 - protein, 226 aa, Escherichia coli
MCHRAATNKVYSEFFCKPGLTLSAAGIYSYTPGDLYSAKTLHWIKMKTIEVDDELYSYIASHTKHIGESASDILRRMLKFTAASQPAAPVTKEVRVASPAIVEAKPVKTIKDKVRAMRELLLSDEYAEQKRAVNRFMLLLSTLYSLDAQAFAEATESLHGRTRVYFAADEQTLLKNGNQTKPKHVPGTPYWVITNTNTGRKCSMIEHIMQSMQFPAELIEKVCGTI

SEQ ID NO: 1611 - DNA, 1692 bp, Escherichia coli
ttgagaaggtttgcggaactatctaaaacgttgcagacaaaggacaaagcaatggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgagcctgcgttcatttccgtactggaagtgctggcagcgaacggcgttgatgtcattgtgcaggaaaacaatggcttcactccgacacctgccatttccaatgccattctggttcacaataaaaaaggtggcccactggcagacggtatcgtgattacaccgtcccataacccgccggaagatggtggtatcaagtacaatccgccaaatggtggcccggctgataccaacgtcactaaagtggtggaagacagagccaacgcactgctggctgatggcctgaaaggcgtgaagcgtatctccctcgacgaagcgatggcatccggtcatgtgaaagagcaggatctggtgcagccgtttgtggaagggctggccgatatcgttgatatggcggcgattcagaaagcgggcctgacgctgggcgttgatccgctgggtggttccggtatcgaatactggaagcgcattggcgagtattacaacctcaacctgaccatcgttaacgatcaggtcgatcaaaccttccgctttatgcacctcgataaagacggtgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcgatcaactacctgttccagcatcgtccgcagtggggcaaagatgttgctgtcggtaaaacgctggtttcatctgcgatgatcgaccgtgtggtcaatgatttgggccgtaagctggtagaagtaccggtaggtttcaaatggtttgttgatggtttgttcgatggcagcttcggctttggcggcgaagagagtgcaggcgcttccttcctgcgtttcgacggcacgccgtggtccaccgataaagacggcatcattatgtgtctgctggcggcggaaatcaccgctgtcaccggtaagaacccgcaggaacactataacgaactggcaaaacgctttggtgcgccgagctataaccgtttgcaggcagcagcgacttccgcacaaaaagcggcgttgtctaagctgtctccggaaatggtgagcgccagcaccctggcaggtgacccgatcaccgcgcgtctgacggcggcaccgggtaatggcgcttctatcggcggtctgaaagtgatgactgacaacggctggttcgccgcgcgtccgtcaggcacggaagacgcatataagatctactgcgaaagcttccttggtgaagaacatcgcaagcagattgagaaagaagcggttgagattgttagcgaagttctgaaaaacgcgtaa

SEQ ID NO: 1612 - protein, 563 aa, Escherichia coli
MRRFAELSKTLQTKDKAMAIHNRAGQPAQQSDLINVAQLTAQYYVLKPEAGNAEHAVKFGTSGHRGSAARHSFNEPHILAIAQAIAEERAKNGITGPCYVGKDTHALSEPAFISVLEVLAANGVDVIVQENNGFTPTPAISNAILVHNKKGGPLADGIVITPSHNPPEDGGIKYNPPNGGPADTNVTKVVEDRANALLADGLKGVKRISLDEAMASGHVKEQDLVQPFVEGLADIVDMAAIQKAGLTLGVDPLGGSGIEYWKRIGEYYNLNLTIVNDQVDQTFRFMHLDKDGAIRMDCSSECAMAGLLALRDKFDLAFANDPDYDRHGIVTPAGLMNPNHYLAVAINYLFQHRPQWGKDVAVGKTLVSSAMIDRVVNDLGRKLVEVPVGFKWFVDGLFDGSFGFGGEESAGASFLRFDGTPWSTDKDGIIMCLLAAEITAVTGKNPQEHYNELAKRFGAPSYNRLQAAATSAQKAALSKLSPEMVSASTLAGDPITARLTAAPGNGASIGGLKVMTDNGWFAARPSGTEDAYKIYCESFLGEEHRKQIEKEAVEIVSEVLKNA

SEQ ID NO: 1613 - DNA, 1320 bp, Escherichia coli
atgagtcaggcgaaatcgaacaaaatgggtgtcgttcagttaaccatactgacgatggtcaacatgatgggctccggtatcatcatgctgccgacaaagcttgccgaagtcgggacaatctcaattatctcctggctggtgacagccgtaggctcaatggcactggcatgggcattcgcaaaatgcggtatgttcagccgtaaatcaggaggtatgggcggttatgccgagtatgctttcggtaaatccggtaactttatggcgaactatacctacggcgtctcgctgctgattgctaacgtcgcgattgctatttcggcggttggttacggcaccgaactgctcggcgcgagtttgtcgccagtgcagattggtcttgcgaccatcggggtgctgtggatttgtaccgtggctaactttggtggtgcgcgcattaccgggcaaatcagtagcattaccgtgtggggggtcattattccggtggtaggcctgtgcattatcggctggttctggtttagcccgacgctttacgttgattcctggaatccgcatcatgcaccgttcttcagtgcggtaggttcttccatcgctatgacgctgtgggcttttcttggtctggagtctgcgtgtgcgaatactgatgtagtggaaaacccggaacgtaatgtgccaatcgcggtactcggcggtacgttaggtgcggcggtgatttatatcgtctccaccaacgtgattgccgggattgtgccaaatatggagctggcaaattcaacggcaccatttggtctggccttcgcgcagatgttcacgccggaagtgggtaaagtcattatggcgctgatggtgatgtcctgctgcggttcgctgcttggctggcagttcaccattgcccaggtgtttaaatcttctgccgatgaagggtacttcccgaaaattttctcccgtgtgagcaaagtcgatgcaccagtacagggaatgctgaccattgtcatcatccagagcggattatcactgatgaccattagcccgtcgctgaacagtcagttcaacgtgctggttaacctggccgtggtgaccaatatcatcccgtatattctgtcaatggcggcattagtcattattcagaaggtcgctaatgtgcccccctcaaaagcgaaagttgcaaactttgttgcttttgttggcgcgatgtacagcttttatgcgctgtactcatccggggaagaagccatgctatacggttccatcgtgaccttcctcggttggacactgtatggtctggtctcaccacgctttgaactgaaaaataaacacggttaa

SEQ ID NO: 1614 - protein, 439 aa, Escherichia coli
MSQAKSNKMGVVQLTILTMVNMMGSGIIMLPTKLAEVGTISIISWLVTAVGSMALAWAFAKCGMFSRKSGGMGGYAEYAFGKSGNFMANYTYGVSLLIANVAIAISAVGYGTELLGASLSPVQIGLATIGVLWICTVANFGGARITGQISSITVWGVIIPVVGLCIIGWFWFSPTLYVDSWNPHHAPFFSAVGSSIAMTLWAFLGLESACANTDVVENPERNVPIAVLGGTLGAAVIYIVSTNVIAGIVPNMELANSTAPFGLAFAQMFTPEVGKVIMALMVMSCCGSLLGWQFTIAQVFKSSADEGYFPKIFSRVSKVDAPVQGMLTIVIIQSGLSLMTISPSLNSQFNVLVNLAVVTNIIPYILSMAALVIIQKVANVPPSKAKVANFVAFVGAMYSFYALYSSGEEAMLYGSIVTFLGWTLYGLVSPRFELKNKHG

SEQ ID NO: 1615 - DNA, 2199 bp, Escherichia coli
atgtcagaattaaaaattgccgttagccgttcttgcccggattgtttttccactcatcgtgaatgcgtgaatattgacaaaagtaattatattgacgttgccgccattattttatcagtcaatgatgttgaacgtggaaaactcgatgaaatagacgctactggctatggcattcctgtttttattgcaacggaaaatgaagaacgtgtaccagcagaatatctgccacgtatttctggtgtcttcgagcattgcgaatcacggaaagagttttatggacgtcagttagaaaccgctgccagccattatgaaacgcaactgcgcccgcccttcttccgcgcactggtcgattatgtcaatcagggcaatagcgcttttgactgcccgggtcatcagggaggtgagtttttccgtcgccatccggcaggcaatcagttcgtggaatattttggcgaaatgctcttccgctccgacttgtgtaatgccgacgttgcaatgggcgatctactgattcatgaaggtgcgccatgcattgcacagcaacatgcggctaaagtgtttaatgctgataaaacgtactttgttttaaacggcacctcctcttccaacaaagtggttttaaacgccctgctgacaccgggtgatctggtgctgtttgaccgcaataaccataagtctaaccaccacggggccttgctacaggctggtgcaacaccggtttatctggaaacagcacgtaacccgtatggttttatcggtggcattgatgcgcactgcttcgaagaaagttatctgcgtgaactgattacagaagttgcaccgcaacgggcaaaagaggcgcgtccgttccgcctcgctgtgattcagttaggcacctacgacggtactatttataacgcccgccaggtggtggataaaatcggtcatctgtgtgactacatcctgtttgactcagcatgggtcggctatgaacagtttattccgatgatggcggactgttcgccactgctgctggagcttaatgagaacgatccgggtattctggttacgcaatctgtgcataaacaacaggctggtttttctcagacttcacaaattcataaaaaagacagccatatcaaagggcaacagcgttatgtaccgcacaaacgcatgaacaacgcatttatgatgcacgcctccaccagcccgttctatccgctgtttgccgcactggatatcaacgccaaaatgcatgaaggtgtcagcggtcgtaatatgtggatggattgtgtggttaacggtattaatgcccgcaaattgatcctcgataactgccagcacattcgcccgttcgttcctgaactggtggatggtaaaccctggcagtcgtatgaaacagcgcaaattgcggttgatctgcgcttctttaaatttgtacccggtgagcactggcattcttttgaaggctacgcagagaaccaatactttgtcgatccgtgcaaactgttgctgacaactccaggtattgatgcacgtaacggcgaatatgaagcgttcggtgtacccgcaacgattcttgctaacttcctgcgcgaaaatggcgtagtgccggaaaaatgcgatcttaactccatcctcttcctgctgactccggcagaagatatggccaaactgcagcaacttgttgccctgctggtacgcttcgaaaaactactggaagctgatgcgcctctggcggaagtactgccttccatctacaaacagcatgaagagcgctacgccggttataccctgcgtcagttgtgccaggaaatgcatgatttgtatgcccgccacaacgtgaaacaactgcaaaaagagatgttccgtaaggaacacttcccacgcgtcagcatgaatccgcaagaagccaactacgcctacttacgcggtgaagtggagctggttcgtctgccggatgcagaaggccgtatcgctgccgaaggtgcgcttccttatcctccgggtgtgctgtgtgttgttcctggtgaaatctggggtggtgctgttctgcgttacttcagcgctctggaagaaggcatcaacctgctgccaggttttgcaccggagctgcagggtgtctatatcgaagaacatgatggtcgtaagcaagtttggtgctatgtcatcaagcctcgtgatgcgcaaagcgccctgttgaaaggggaaaaattatga

SEQ ID NO: 1616 - protein, 732 aa, Escherichia coli
MSELKIAVSRSCPDCFSTHRECVNIDKSNYIDVAAIILSVNDVERGKLDEIDATGYGIPVFIATENEERVPAEYLPRISGVFEHCESRKEFYGRQLETAASHYETQLRPPFFRALVDYVNQGNSAFDCPGHQGGEFFRRHPAGNQFVEYFGEMLFRSDLCNADVAMGDLLIHEGAPCIAQQHAAKVFNADKTYFVLNGTSSSNKVVLNALLTPGDLVLFDRNNHKSNHHGALLQAGATPVYLETARNPYGFIGGIDAHCFEESYLRELITEVAPQRAKEARPFRLAVIQLGTYDGTIYNARQVVDKIGHLCDYILFDSAWVGYEQFIPMMADCSPLLLELNENDPGILVTQSVHKQQAGFSQTSQIHKKDSHIKGQQRYVPHKRMNNAFMMHASTSPFYPLFAALDINAKMHEGVSGRNMWMDCVVNGINARKLILDNCQHIRPFVPELVDGKPWQSYETAQIAVDLRFFKFVPGEHWHSFEGYAENQYFVDPCKLLLTTPGIDARNGEYEAFGVPATILANFLRENGVVPEKCDLNSILFLLTPAEDMAKLQQLVALLVRFEKLLEADAPLAEVLPSIYKQHEERYAGYTLRQLCQEMHDLYARHNVKQLQKEMFRKEHFPRVSMNPQEANYAYLRGEVELVRLPDAEGRIAAEGALPYPPGVLCVVPGEIWGGAVLRYFSALEEGINLLPGFAPELQGVYIEEHDGRKQVWCYVIKPRDAQSALLKGEKL

SEQ ID NO: 1617 - DNA, 153 bp, Escherichia coli
atgacgagtatagccagttaccgggctggtctgggttattgcatctgcaaaaagcaaactactgatttatttatcagcggtggggttttgcttttttccggcgtgatcaatttctcctttgagaaattgaggacctgctattacctgaaataa

SEQ ID NO: 1618 - protein, 50 aa, Escherichia coli
MTSIASYRAGLGYCICKKQTTDLFISGGVLLFSGVINFSFEKLRTCYYLK

SEQ ID NO: 1619 - DNA, 153 bp, Escherichia coli
gtggaaaaacaatccgggcaagaacggctaacggcaatttttaattctgacattttgttcatctctttatttcaggtaatagcaggtcctcaatttctcaaaggagaaattgatcacgccggaaaaaagcaaaaccccaccgctgataaataa

SEQ ID NO: 1620 - protein, 50 aa, Escherichia coli
MEKQSGQERLTAIFNSDILFISLFQVIAGPQFLKGEIDHAGKKQNPTADK

SEQ ID NO: 1621 - DNA, 678 bp, Escherichia coli
gtgacaaacgttctgattgttgaagatgaacaggctattcgtcgctttctgcgcacggcgctggagggcgacggtatgcgcgtctttgaggccgaaacgctgcaacgcggcttgctggaagcggcaacccgtaagccagatttgattattctcgatctcggcctgcccgacggtgatgggattgagtttatccgcgacctgcgccagtggagcgcggtgccggtgattgtgctttccgcacgcagcgaagagagcgataaaatcgccgcgctggatgccggagcggatgattatctgagtaagccgtttggcattggcgaattgcaggcccgtctgcgcgtcgcattacgccgccactccgccaccaccacgcccgatccgctggtgaaattttccgatgttaccgtcgatttagcagctcgtgtgatccatcggggcgaggaagaggtgcatctcaccccgattgagttccgcctgctggcagtgttgcttaataatgcgggaaaagtgctcacccagcgccagctcctcaaccaggtgtgggggccaaacgcggtcgaacacagtcattatttgcgtatttatatggggcatctgcgacaaaaactggagcaggatcccacccgcccccgccattttattactgaaaccggtattgggtatcggtttatgccatga

SEQ ID NO: 1622 - protein, 225 aa, Escherichia coli
MTNVLIVEDEQAIRRFLRTALEGDGMRVFEAETLQRGLLEAATRKPDLIILDLGLPDGDGIEFIRDLRQWSAVPVIVLSARSEESDKIAALDAGADDYLSKPFGIGELQARLRVALRRHSATTTPDPLVKFSDVTVDLAARVIHRGEEEVHLTPIEFRLLAVLLNNAGKVLTQRQLLNQVWGPNAVEHSHYLRIYMGHLRQKLEQDPTRPRHFITETGIGYRFMP

SEQ ID NO: 1623 - DNA, 2718 bp, Escherichia coli
ttgtcgaactcaatctggcactggataggcttgatgaataacgaacccttacgtcccgaccccgatcgtctgctggaacaagctgccgcgccgcatcgggggaagctgaaagtattcttcggtgcctgcgcaggcgtcgggaagacctgggcgatgctggcggaagcccagcgactgcgggcgcaagggctggatattgtggttggcgtggtagaaacccacggtcggaaagataccgccgccatgctgaaaggtctggctgttctgccgttaaaacgccaggcgtaccgtgggcggcacatcagcgagtttgatctcgatgccgccctcgcccgccgtccggcactgatcttaatggacgaactggcgcacagtaatgcgccaggttctcgtcatcctaaacgctggcaggacattgaggagctgctggaagcaggcattgatgttttcactaccgtcaacgttcagcatctggaaagcctgaacgatgtggtcagcggcgtcaccggaattcaggtgcgggaaaccgtgcccgatccttttttcgatgccgccgacgacgtggtgctggtggacttgcccccggacgatctgcgccagcgactgaaagaaggcaaagtctatattgccgggcaggcggagcgcgccattgaacattttttccgcaaaggtaatctgatcgccctgcgcgaactggcactacgccgtactgccgatcgcgtagatgagcaaatgcgcgcctggcgggggcatcctggcgaagagaaagtctggcacacacgcgacgcgatcctattatgcatcgggcataacaccggcagtgagaaactggtccgcgcggcggcgcggttggcctcgcgcctgggcagtgtctggcacgcggtgtatgttgaaacccctgccctgcatcgcttaccggagaaaaaacgtcgggcaattctcagcgccttacgtctggcgcaggagctgggcgcggagacggcaacactttctgatccagcggaagagaaagcggtagtgcgttatgcccgtgaacataatctcggcaagattattctcggtcgcccggcttcgcgccgctggtggcgtcgggaaacatttgctgaccggctggcacgcatcgcccccgatctcgatcaggtgctggtcgcgcttgatgaaccacccgcccgcacgattaacaacgcgccggatagccgctcttttaaagacaagtggcgggtacagattcagggatgcgtggttgccgccgcgttatgcgccgttatcaccttaattgccatgcagtggctgatagcgtttgatgccgccaacctggtgatgctgtatctgcctggcgtcgtggtggtggcactattttacggacgctggccttcggtggttgccaccgtcattaatgtggtgagtttcgatctcttttttatcgccccacgcggcacgctcgccgtctctgatgtgcaatatctgctgaccttcgcggtgatgttaaccgtcgggctggtgatcgggaaccttactgctggcgtgcgttatcaggcgcgggtagcccgttaccgcgaacaacgcacacggcacttatatgaaatgtccaaagctctggctgtgggccgtagttcgcaggatatcgccgccaccagcgaacagtttattgcctccacgtttcatgcccgtagccaggtgttgctgcctgatgacaacggtaaattgcagcctttaacacatccgcaaggaatgacgccgtgggacgatgccatcgcgcagtggagttttgataaaggcctgcctgcgggcgcaggcaccgacacgttacccggtgtaccgtaccagattttgccgctaaaaagcggcgagaaaacctacgggctggtggtggtggaaccggggaatctgcgccagttgatgatcccggaacagcagcgcctgctggagacgtttacgctgttagtcgccaatgcccttgagcgactgacactgaccgccagcgaagaacaggcgcggatggcaagcgaacgtgaacagatccgcaacgccctgctggcggcgctttcgcatgatttacgcacgccgcttacggtgctgttcggtcaggcagaaatcttaacgctcgatctggcaagcgaaggatcgccccacgcccgccaggccagcgagattcgtcagcatgtgctgaacaccacccgactggtgaataatctactggatatggcgcgaattcagtccggcggctttaatttgaagaaagagtggttaacgctggaagaagtggtcggcagcgcgctgcaaatgctggaaccgggtttatcgtcgcccatcaatctttctctgccagagccgctgaccttaatccacgttgacgggccactctttgaacgggtgctgattaacctgctagagaacgcggtgaaatatgcgggggcgcaggccgaaattggtatcaatgcccacgttgagggcgaaaatctacaactggatgtctgggataacggccccggtcttccaccaggccaggagcagacgatatttgataagtttgctcgcgggaataaagagtcggcggtaccgggtgtagggcttgggttggcaatttgtcgggcgatagtggatgtacacggcggcaccattaccgcattcaaccgaccggaaggtggtgcctgttttcgtgttacacttccccagcaaacagcccctgaacttgaagaatttcatgaggatatgtga

SEQ ID NO: 1624 - protein, 905 aa, Escherichia coli
MSNSIWHWIGLMNNEPLRPDPDRLLEQAAAPHRGKLKVFFGACAGVGKTWAMLAEAQRLRAQGLDIVVGVVETHGRKDTAAMLKGLAVLPLKRQAYRGRHISEFDLDAALARRPALILMDELAHSNAPGSRHPKRWQDIEELLEAGIDVFTTVNVQHLESLNDVVSGVTGIQVRETVPDPFFDAADDVVLVDLPPDDLRQRLKEGKVYIAGQAERAIEHFFRKGNLIALRELALRRTADRVDEQMRAWRGHPGEEKVWHTRDAILLCIGHNTGSEKLVRAAARLASRLGSVWHAVYVETPALHRLPEKKRRAILSALRLAQELGAETATLSDPAEEKAVVRYAREHNLGKIILGRPASRRWWRRETFADRLARIAPDLDQVLVALDEPPARTINNAPDSRSFKDKWRVQIQGCVVAAALCAVITLIAMQWLIAFDAANLVMLYLPGVVVVALFYGRWPSVVATVINVVSFDLFFIAPRGTLAVSDVQYLLTFAVMLTVGLVIGNLTAGVRYQARVARYREQRTRHLYEMSKALAVGRSSQDIAATSEQFIASTFHARSQVLLPDDNGKLQPLTHPQGMTPWDDAIAQWSFDKGLPAGAGTDTLPGVPYQILPLKSGEKTYGLVVVEPGNLRQLMIPEQQRLLETFTLLVANALERLTLTASEEQARMASEREQIRNALLAALSHDLRTPLTVLFGQAEILTLDLASEGSPHARQASEIRQHVLNTTRLVNNLLDMARIQSGGFNLKKEWLTLEEVVGSALQMLEPGLSSPINLSLPEPLTLIHVDGPLFERVLINLLENAVKYAGAQAEIGINAHVEGENLQLDVWDNGPGLPPGQEQTIFDKFARGNKESAVPGVGLGLAICRAIVDVHGGTITAFNRPEGGACFRVTLPQQTAPELEEFHEDM

SEQ ID NO: 1625 - DNA, 573 bp, Escherichia coli
atgcgtggattacgtccggcattatcgacatttctctttctgttattgattactggcggcgtttacccgctgctgaccaccgcactggggcaatggtggtttccctggcaggccaacggttcattgattcgtgaaggtgatacggtgcgcggttcggcattaatcgggcaaaattttaccggcaacggctattttcatggtcgcccgtcggcaacagcagaaatgccctataatccacaggcttctggcgggagcaatctggcagtcagtaacccggagctggataaacagatagccgcacgcgttgccgcattacgggctgctaacccggatgccagcacgaacgttccggttgaactggtgacggcgtcagcaagcgggctggacaataacatcaccccgcaagcggcggcctggcagatcccacgcgtggcgaaagcgcgtaatctcagcgttgaacagctcacgcaactgatcgcaaaatacagccaacaaccgctggtgaaatatatcggccagccggtcgtcaacattgtcgaactcaatctggcactggataggcttgatgaataa

SEQ ID NO: 1626 - protein, 190 aa, Escherichia coli
MRGLRPALSTFLFLLLITGGVYPLLTTALGQWWFPWQANGSLIREGDTVRGSALIGQNFTGNGYFHGRPSATAEMPYNPQASGGSNLAVSNPELDKQIAARVAALRAANPDASTNVPVELVTASASGLDNNITPQAAAWQIPRVAKARNLSVEQLTQLIAKYSQQPLVKYIGQPVVNIVELNLALDRLDE

SEQ ID NO: 1627 - DNA, 2049 bp, Escherichia coli
atgagtcgtaaacaactggcgctattcgaaccaacacttgtcgttcaggcgctgaaagaagcggtgaaaaaattaaacccgcaggcgcaatggcgcaatccggtgatgtttatcgtctggatcggcagtctgctgaccacctgtattagcatcgcgatggcaagcgatgtgatgcctggcaatgcgctgtttagcgcggcaattagcggctggctgtgggtcaccgtactgttcgctaatttcgccgaggcgttggcagaaggccgcagtaaagcgcaggccaacagtctgaaaggggtgaaaaaaaccgcttttgctcgcaagctgcgcgaaccgaaatatggcgctgcggcggacaaagttcctgctgatcaactgcgtaaaggtgacatcgtgctggtagaagctagcgatattatcccctgcgatggtgaagtcattgaaggcggcgcatcggtcgatgaaagcgccatcaccggggaatcggctccggtgatccgtgaatccggcggtgattttgcctccgtcactggcggcacgcgtattctttctgactggctggtgattgagtgcagcgttaaccccggcgagacatttctggatcggatgatcgcgatggtggaaggtgcgcagcgacgtaaaacgccgaacgagattgccctgaccattctcctgattgccctgactatcgtctttttactggcaaccgccacgctgtggccgttttccgcgtggggcggtaatgccgtcagcgtaacggtactggtggcactgctggtctgtctgatcccaaccactattggcggcctgttgtcagcgattggcgtcgccggaatgagtcggatgctgggcgcgaatgtgattgccaccagcggacgtgcagttgaagcggcaggtgacgttgacgttctgctactggataaaaccggcaccatcacactcggtaaccgtcaggcgtcagagtttatccccgcacaaggcgtggaggaaaaagcgctggccgacgccgcacaactggcttcgctggctgatgaaacgccggaaggccgcagtattgtgatcctcgccaagcagcgttttaacctgcgcgagcgcgatgtgcagtcgctccatgccacctttgtaccgtttactgcgcaaagccggatgagcgggatcaacatcgacaaccgcatgatccgtaaaggttctgtcgatgccattcgccgccatgttgaggctaacggcggtcacttccctgccgatgttgatcaaaaagtcgatcaggttgcgcgtcagggagccacgccgctggtggtggtggaaggttctcgtgtgctgggcgttattgcgctgaaagatatcgtcaaaggcggtattaaagagcgcttcgcccagctgcgtaaaatgggcattaaaacggtgatgattaccggcgataaccgcctgactgccgccgcgatagctgcggaagcgggtgtcgatgattttctcgccgaagcaacaccggaggccaagctggcactgattcgtcagtatcaggcggaaggccgtttagtggcgatgaccggcgatggcaccaacgatgctccggcgctggcacaggccgatgttgcggtggcgatgaactccggcacccaggcggcgaaagaagcgggcaatatggtggatctcgactccaacccgaccaagttgatcgaggtagtgcacattggcaaacagatgctgatgacccgtggctcgttgaccaccttcagcattgccaacgatgtggcgaaatacttcgccattattccagcggcgttcgcggcaacgtatccgcagttaaatgcgctgaacatcatgcgcctgcattcgcccgactccgccattctcagtgcggtcattttcaacgccttgattatcgtctttttgattcccctggcgttaaaaggcgtgagttataaaccgcttaccgcttctgccatgttgcgccgtaacttatggatttacggtctgggtgggctgctggtgccgtttattggtatcaaagtcattgatttactgctaaccgtttgcggtctggtgtga

SEQ ID NO: 1628 - protein, 682 aa, Escherichia coli
MSRKQLALFEPTLVVQALKEAVKKLNPQAQWRNPVMFIVWIGSLLTTCISIAMASDVMPGNALFSAAISGWLWVTVLFANFAEALAEGRSKAQANSLKGVKKTAFARKLREPKYGAAADKVPADQLRKGDIVLVEASDIIPCDGEVIEGGASVDESAITGESAPVIRESGGDFASVTGGTRILSDWLVIECSVNPGETFLDRMIAMVEGAQRRKTPNEIALTILLIALTIVFLLATATLWPFSAWGGNAVSVTVLVALLVCLIPTTIGGLLSAIGVAGMSRMLGANVIATSGRAVEAAGDVDVLLLDKTGTITLGNRQASEFIPAQGVEEKALADAAQLASLADETPEGRSIVILAKQRFNLRERDVQSLHATFVPFTAQSRMSGINIDNRMIRKGSVDAIRRHVEANGGHFPADVDQKVDQVARQGATPLVVVEGSRVLGVIALKDIVKGGIKERFAQLRKMGIKTVMITGDNRLTAAAIAAEAGVDDFLAEATPEAKLALIRQYQAEGRLVAMTGDGTNDAPALAQADVAVAMNSGTQAAKEAGNMVDLDSNPTKLIEVVHIGKQMLMTRGSLTTFSIANDVAKYFAIIPAAFAATYPQLNALNIMRLHSPDSAILSAVIFNALIIVFLIPLALKGVSYKPLTASAMLRRNLWIYGLGGLLVPFIGIKVIDLLLTVCGLV

SEQ ID NO: 1629 - DNA, 1818 bp, Escherichia coli
ttgcagccagaactctacccttccggtatcacttttaggccactggaggtgcactgtgagtgcaggcgtgataaccggcgtgttgctggtgtttttattactgggttatctggtttatgccctgatcaatgcggaggcgttctgatggctgcgcaagggttcttactgattgccacgtttttactggtatttatggtgctggcgcgtcccttaggtagcgggctggcgcggctgattaatgatatacctcttcctggtacgacgggcgttgaacgcgtactctttagcgcgcttggcgtctctgaccgcgagatgaactggaagcagtatctctcagccattcttggcctgaatatactggggctggcggtgctgttttttatgttgctcggtcagcactatctgccgcttaatccacagcagttgccggggctgtcgtgggatctggcgctcaataccgccgtcagctttgtcacgaataccaactggcaatcttatagcggtgaaaccacgttgagctatttcagccagatggcgggcttaacggtgcaaaactttctttctgccgccagcgggattgcggtgatttttgcgcttattcgcgcgtttacccgccagagcatgaacacgctgggtaatgcgtgggtagacctgttgcggattacgttatgggtgttaacccccgtagcattgctgatcgcactgttttttattcaacaaggtgcgctgcaaaactttttgccttatcaggctgtgacgaccattgaaggagcgcaacagctgttaccaatggggccagtagcttctcaggaagcgatcaaaatgctcggaactaacggcggtggcttttttaatgccaactcgtcgcatccgtttgaaaacccaaccgcactgaccaacttcgtgcaaatgctggcgattttcttgatcccaacagcgctgtgctttgcctttggtgaagtggcgggcgatcgtcgccaggggcgcatgttgctgtgggcgatgtcggtgatttttgtcatctgcgtaggcgtagtgatgtgggcagaagttcagggtaatcctcatctgctggcgctcggcgcggacagcagcatcaatatggaaggtaaagagagccgtttcggcgtgctggtcagtagcctgtttgcggtcgtgactacggcggcttcctgcggcgcggtgattgcgatgcatgattcgtttaccgctcttggtggcatggtgccgatgtggttgatgcaaattggtgaagtggtattcggcggcgtcggttccggcctttacggcatgatgctgtttgtcctgctggcggtgtttattgccgggctgatgattggtcgtacaccggaatatctgggtaaaaaaatcgacgtacgcgagatgaaactgactgcactggcgattctggtcaccccgacgctggtgctgatgggcgcggcgctggcaatgatgaccgacgccggacgtagcgccatgctcaaccctggcccgcatggttttagcgaagtgctgtatgccgtgtcatccgccgctaacaacaacggcagcgcctttgccggattaagcgccaactctccattctggaactgtttactggcgttgtgcatgtttgtcgggcgcttcggggtgattatcccggtgatggcaattgccggttcgctggtgagtaaaaagagccaacccgccagctccggcacattgccaacgcacggcccgctgtttgttggcctgttaatcggcaccgtgttgctggttggcgcactgacctttatccctgccctggcgcttggtccggtggcggaatatctctcctga

SEQ ID NO: 1630 - protein, 605 aa, Escherichia coli
MQPELYPSGITFRPLEVHCECRRDNRRVAGVFITGLSGLCPDQCGGVLMAAQGFLLIATFLLVFMVLARPLGSGLARLINDIPLPGTTGVERVLFSALGVSDREMNWKQYLSAILGLNILGLAVLFFMLLGQHYLPLNPQQLPGLSWDLALNTAVSFVTNTNWQSYSGETTLSYFSQMAGLTVQNFLSAASGIAVIFALIRAFTRQSMNTLGNAWVDLLRITLWVLTPVALLIALFFIQQGALQNFLPYQAVTTIEGAQQLLPMGPVASQEAIKMLGTNGGGFFNANSSHPFENPTALTNFVQMLAIFLIPTALCFAFGEVAGDRRQGRMLLWAMSVIFVICVGVVMWAEVQGNPHLLALGADSSINMEGKESRFGVLVSSLFAVVTTAASCGAVIAMHDSFTALGGMVPMWLMQIGEVVFGGVGSGLYGMMLFVLLAVFIAGLMIGRTPEYLGKKIDVREMKLTALAILVTPTLVLMGAALAMMTDAGRSAMLNPGPHGFSEVLYAVSSAANNNGSAFAGLSANSPFWNCLLALCMFVGRFGVIIPVMAIAGSLVSKKSQPASSGTLPTHGPLFVGLLIGTVLLVGALTFIPALALGPVAEYLS

SEQ ID NO: 1631 - DNA, 75 bp, Escherichia coli
ataaccggcgtgttgctggtgtttttattactgggttatctggtttatgccctgatcaatgcggaggcgttctga

SEQ ID NO: 1632 - protein, 24 aa, Escherichia coli
ITGVLLVFLLLGYLVYALINAEAF

SEQ ID NO: 1633 - DNA, 207 bp, Escherichia coli
atggaactctacaaagaatatcctgcatggcttatctttttacgccgtacttgtgcggttgcagcgggcgttctggcgctgcctttcatgcttttctggaaagaccgcgcccgcttttacagctacctgcaccgcgtctggtcgaaaaccagcgataaaccggtgtggatggatcaggccgaaaaggcaactggtgatttttactga

SEQ ID NO: 1634 - protein, 68 aa, Escherichia coli
MELYKEYPAWLIFLRRTCAVAAGVLALPFMLFWKDRARFYSYLHRVWSKTSDKPVWMDQAEKATGDFY

SEQ ID NO: 1635 - DNA, 510 bp, Escherichia coli
atgaatcaacaactttttgatgacagcacccttatccgcatttttgctttgcatgagttacacaatctcaaagatcgaggactaacgcgcggggcgcttctcgattatcacagccgctataaactcgtctttctggcacattctcagccggagtaccgcaaacttggcccgtttgtggctgatattcaccggtggcaaagtctggatgactattacaaccagtaccgccaacgcgtaattgttttgctttctcaccctgccaaccggcgtgatcatactaacgttttgatgcacgttcagggatattttcgcccacatattgattccacagaacgccagcagctggcggcgcttatcgacagttatcgccgtggcgagcaaccgcttcttgcgccgctgatgcgtatcaaacactatatggcgctttatcctgacgcctggctttcagggcagcgttatttcgaactttggccgcgtgtgattaacttgcgccatgcaggagttttatga

SEQ ID NO: 1636 - protein, 169 aa, Escherichia coli
MNQQLFDDSTLIRIFALHELHNLKDRGLTRGALLDYHSRYKLVFLAHSQPEYRKLGPFVADIHRWQSLDDYYNQYRQRVIVLLSHPANRRDHTNVLMHVQGYFRPHIDSTERQQLAALIDSYRRGEQPLLAPLMRIKHYMALYPDAWLSGQRYFELWPRVINLRHAGVL

SEQ ID NO: 1637 - DNA, 1419 bp, Escherichia coli
atgactacccatctggtctggtttcgccaggatttacgtcagcacgataatctcgcgctggctgccgcctgccgcaattcgtctgcgcgcgtgctggcgttgtatatcgctacaccacgccagtgggcggcgcataatgtgtcgccgcgtcaggctgaacttatcaatacacaacttaatgcgctgcaaaacgcgctggcggaaaaaggcattcctttattgttccgcgaagtggatgactttgctgccagtgtcgaaacagttaaacaggtgtgcgcggaaaatcgcattacccatctgttttataactatcagtatgaggtgaatgagcgggcgcgggatgtgcaggctgagaggacgctgcgtaacgtggtgtgtgaaggatttgatgacagcgtgatcctgccgccgggggcggtgatgactggcaatcatgagatgtacaaagtctttacgccttttaaaaacgcatggttgaaacggctgcgggaagggatgccggagtgcgtcgctgcaccaaaatttcgtagtagcggatcgatagagcccgcgccatccattacgctgaattatcctcgtcagtctttcgatactgcgcatttcccggtggaagaaaaagcggcgattgcgcaattacgccagttttgccagaacggtgccggagagtatgagcaacaacgagattttccggcagtggaaggcaccagtcgtttgtccgccagcctggcaacgggcgggttatcgcctcgccaatgtttacatcgcctgttggcggaacaaccgcaggtgctggaaggcggaccggggagcgtctggcttaatgagctgatatggcgcgagttctaccgccatttgatgacgtattatccttcgctgtgtaaacatcgtccgtttattgcctggacggatcgtgtacagtggcaaagcaatcccgcccatttaaaggcctggcaggagggcaaaacgggatacccgattgtcgatgctgccatgcgtcagcttaacagcactggctggatgcataaccggctacggatgattacagccagttttctggtgaaagatttgttgatcgactggcgcgaaggcgagcgatatttcatgtcgcagttgattgatggtgatttggcagctaataacggtggctggcagtgggctgcttctacgggtactgatgcagcgccgtattttcgtattttcaacccgacaactcagggcgagaaatttgaccgcgaaggcgaatttatccgccagtggctaccggagctgcgcgatgtaccggggaaagcggtgcatgagccgtggaagtgggcagagaaaacaggtgtgacgttggattatccgcaaccgatagtcgatcacaaagaggcaaggctgcgaacgctggcagcgtacgaagaagcgaggaaaggagcctga

SEQ ID NO: 1638 - protein, 472 aa, Escherichia coli
MTTHLVWFRQDLRQHDNLALAAACRNSSARVLALYIATPRQWAAHNVSPRQAELINTQLNALQNALAEKGIPLLFREVDDFAASVETVKQVCAENRITHLFYNYQYEVNERARDVQAERTLRNVVCEGFDDSVILPPGAVMTGNHEMYKVFTPFKNAWLKRLREGMPECVAAPKFRSSGSIEPAPSITLNYPRQSFDTAHFPVEEKAAIAQLRQFCQNGAGEYEQQRDFPAVEGTSRLSASLATGGLSPRQCLHRLLAEQPQVLEGGPGSVWLNELIWREFYRHLMTYYPSLCKHRPFIAWTDRVQWQSNPAHLKAWQEGKTGYPIVDAAMRQLNSTGWMHNRLRMITASFLVKDLLIDWREGERYFMSQLIDGDLAANNGGWQWAASTGTDAAPYFRIFNPTTQGEKFDREGEFIRQWLPELRDVPGKAVHEPWKWAEKTGVTLDYPQPIVDHKEARLRTLAAYEEARKGA

SEQ ID NO: 1639 - DNA, 1482 bp, Escherichia coli
atgaataaacacgcatcacaaccgcgcgctatttactatgtcgttgcgctgcaaatctgggaatattttagcttttacggcatgcgtgccctgctgatcctctatctcaccaatcaactaaaatatagcgataatcacgcctacgagttatttagcgcctactgttcgctggtatatgtcacgccaatcctcggtggctttttggcggataaagttctcggcaatcgcatggcggtgatgctgggggcgttgttgatggcgatcggtcatgtggtgctgggtgccagtgagatccatccgtcattcctctatctgtccctggcgattatcgtctgcggctatggtctgtttaaatccaacgtcagttgcctgctcggcgagctgtatgagccaaccgatccacgtcgtgatggcggtttctcgctgatgtatgcggcgggtaacgtggggtctattatcgcacctatcgcctgtggtttcgcccaggaagagtacagttgggcgatgggctttggcctggcggcggtgggtatgatcgcgggtctggtcattttcttatgtggcaatcgtcatttcacacacacccgcggcgttaacaaaaaggtactgcgtgcgacaaactttctcctgcccaactggggatggctactggttctgctggtggcaacgcctgcgctgattaccgtgttgttctggaaagagtggtcggtatacgccttgattgtcgcgacgatcattggccttggggttctggcaaaaatttatcgcaaagcagaaaaccaaaaacagcgtaaggagctggggctgattgttaccctcaccttcttcagcatgttgttctgggcattcgcacaacaggggggtagctcgattagcctttatatcgaccgcttcgttaaccgcgatatgtttggttataccgttccgactgctatgttccagtcgattaatgccttcgcagttatgctgtgcggtgtgttcctggcgtgggtggttaaagaaagcgtcgcaggtaatcgtaccgtgcgcatctggggaaaatttgctcttggccttggcctgatgagcgccggattctgcattctgaccttaagcgcccgctggtccgcaatgtatggtcactcttctctgccactgatggtgttaggcctggcggtgatgggctttgcggaactgtttatcgatccggttgctatgtcgcagattacgcgcattgaaatccccggcgtgaccggcgtattaaccggcatttatatgctgctttccggcgcgattgcgaactatctggcgggcgtgattgccgatcagacatcgcaggcttcgtttgatgcttccggggcgatcaactactccatcaatgcatatattgaagtatttgatcaaattacctggggcgcactggcgtgtgtaggactggtactgatgatttggctgtatcaggcgcttaagttcagaaaccgcgcgctggcgctggagtcttaa

SEQ ID NO: 1640 - protein, 493 aa, Escherichia coli
MNKHASQPRAIYYVVALQIWEYFSFYGMRALLILYLTNQLKYSDNHAYELFSAYCSLVYVTPILGGFLADKVLGNRMAVMLGALLMAIGHVVLGASEIHPSFLYLSLAIIVCGYGLFKSNVSCLLGELYEPTDPRRDGGFSLMYAAGNVGSIIAPIACGFAQEEYSWAMGFGLAAVGMIAGLVIFLCGNRHFTHTRGVNKKVLRATNFLLPNWGWLLVLLVATPALITVLFWKEWSVYALIVATIIGLGVLAKIYRKAENQKQRKELGLIVTLTFFSMLFWAFAQQGGSSISLYIDRFVNRDMFGYTVPTAMFQSINAFAVMLCGVFLAWVVKESVAGNRTVRIWGKFALGLGLMSAGFCILTLSARWSAMYGHSSLPLMVLGLAVMGFAELFIDPVAMSQITRIEIPGVTGVLTGIYMLLSGAIANYLAGVIADQTSQASFDASGAINYSINAYIEVFDQITWGALACVGLVLMIWLYQALKFRNRALALES

SEQ ID NO: 1641 - DNA, 744 bp, Escherichia coli
atgaaaaacaccgaactggaacaactgattaacgaaaaactgaacagcgcggcgattagtgattacgcgccgaatggtttgcaggtggaaggcaaagagacggtgcaaaaaattgttaccggtgtcactgccagccaggctttgctcgatgaggcagtgcgtctgggcgcggatgcggtcattgtgcatcatggctacttctggaaaggcgaatctccggtcattcgcggaatgaagcgtaaccgcttaaaaacattgctggcgaatgatatcaacctgtatggctggcatttgccgcttgacgcacatcctgagctgggcaataacgcacagctggcggcgttactggggatcacggtcatgggcgaaattgagccgttggtgccgtggggcgaactgaccatgcctgtgccgggactggaactggcctcctggattgaagcgcgtctgggacgtaagccgttatggtgtggcgataccggacctgaggtggtccagcgcgtcgcctggtgcacgggcggcgggcaaagttttatcgatagcgccgcgcgttttggcgtggatgcttttattactggcgaagtttctgaacagaccattcattcagcccgcgagcagggattgcatttttatgctgcaggtcaccatgccactgaacgtggtggtattcgcgcattgagcgagtggctgaatgaaaataccgatcttgatgtgacctttattgatattcctaatcctgcataa

SEQ ID NO: 1642 - protein, 247 aa, Escherichia coli
MKNTELEQLINEKLNSAAISDYAPNGLQVEGKETVQKIVTGVTASQALLDEAVRLGADAVIVHHGYFWKGESPVIRGMKRNRLKTLLANDINLYGWHLPLDAHPELGNNAQLAALLGITVMGEIEPLVPWGELTMPVPGLELASWIEARLGRKPLWCGDTGPEVVQRVAWCTGGGQSFIDSAARFGVDAFITGEVSEQTIHSAREQGLHFYAAGHHATERGGIRALSEWLNENTDLDVTFIDIPNPA

SEQ ID NO: 1643 - DNA, 657 bp, Escherichia coli
gtgcaacgagcgcgttgttatctgataggtgaaacggcggtagtactggaactggaaccgccggtgacgctggctagccagaaacggatctggcgactggcacagcgtctggtggatatgccgaatgtggttgaagccattcctggcatgaacaatatcacagtgattttgcgtaatcctgagtcgctggcgctggatgccatagagcgtttgcaacgctggtgggaggagagtgaggcgctggagccggagtctcgctttattgaaattccggtggtttacggtggcgcagccggaccggatttggcggtggtcgcggcgcattgtggattgagcgaaaaacaggttgttgaattacactcctccgtggaatacgtggtctggtttttaggttttcaaccgggcttcccgtatctcgggagtttgccggaacaactacacacgccacggcgcgctgaaccgcgcttgcacgttccagcaggttctgtcgggatcggcgggccgcagaccggtgtttatccgctggcaacgccgggtggctggcagttgattggtcatacctcactcagcctgtttgatccggagcgtgacgaacccatcttattacgtccgggagacagcgtgcgctttgtaccccagaaggagggagtatgctga

SEQ ID NO: 1644 - protein, 218 aa, Escherichia coli
MQRARCYLIGETAVVLELEPPVTLASQKRIWRLAQRLVDMPNVVEAIPGMNNITVILRNPESLALDAIERLQRWWEESEALEPESRFIEIPVVYGGAAGPDLAVVAAHCGLSEKQVVELHSSVEYVVWFLGFQPGFPYLGSLPEQLHTPRRAEPRLHVPAGSVGIGGPQTGVYPLATPGGWQLIGHTSLSLFDPERDEPILLRPGDSVRFVPQKEGVC

SEQ ID NO: 1645 - DNA, 933 bp, Escherichia coli
atgctgaagattattcgtgcgggcatgtataccactgtgcaggatggcggtcgtcacggttttcgccagtcgggtatcagccactgcggcgcactggatatgcctgcgctgcgcattgctaacctgctggtgggtaatgacgccaacgcccccgcgctggagatcacgctcggtcagttaacggttgagttcgaaactgatgggtggtttgccctgacgggtgccggttgcgaagcgcggctggatgataacgccgtctggaccggctggcgattgccaatgagagcaggccagcgtttaacgcttaaacgcccgcagcacgggatgcgcagttatctggcggtcgcgggtggtattgatgttccgccggtaatgggatcatgcagcaccgatctcaaagtggggattggcgggttggaaggccgtttactgagggatggtgaccgactcccgattggcaaagcgaagcgtgattttatggaagcgcagggcgttaaacagctgctgtggggcaaccgcattcgcgccttgccggggccggaatatcatgagttcgatcgcgcctcgcaggatgcattctggcgttcgccctggcagcttagctcgcaaagtaaccgcatgggctatcgcttacaggggcaaattttaaaacgcaccaccgatcgcgaactgttatctcacggtttgttaccaggtgtggtgcaggtgccgcataacgggcagcccattgtgttgatgaacgatgcgcaaaccaccggtggttacccgcgtattgcctgtatcattgaggctgatatgtaccatctggcgcaaattccgctcggtcagccgattcattttgtccagtgttcactggaagaggcactgaaagcacggcaagatcaacaacgttatttcgaacaattagcgtggcggctgcacaatgaaaattga

SEQ ID NO: 1646 - protein, 310 aa, Escherichia coli
MLKIIRAGMYTTVQDGGRHGFRQSGISHCGALDMPALRIANLLVGNDANAPALEITLGQLTVEFETDGWFALTGAGCEARLDDNAVWTGWRLPMRAGQRLTLKRPQHGMRSYLAVAGGIDVPPVMGSCSTDLKVGIGGLEGRLLRDGDRLPIGKAKRDFMEAQGVKQLLWGNRIRALPGPEYHEFDRASQDAFWRSPWQLSSQSNRMGYRLQGQILKRTTDRELLSHGLLPGVVQVPHNGQPIVLMNDAQTTGGYPRIACIIEADMYHLAQIPLGQPIHFVQCSLEEALKARQDQQRYFEQLAWRLHNEN

SEQ ID NO: 1647 - DNA, 735 bp, Escherichia coli
atgaaaattgacctgaacgccgatctgggcgaaggctgcgccagcgacgcagaactattaacgctggtttcctctgccaatattgcctgtggatttcatgcaggcgatgcgcaaaccatgcaggcttgcgtgcgtgaagcaataaaaaacggtgttgcgattggcgcgcacccgagttttcccgacagggaaaattttggtcgcagcgccatgcagctgccgccagaaaccgttttcgcccagacgctgtatcaaattggcgcgctggcagcgattacccgtgcgcaaggcggcgtaatgtgtcatgtcaaaccgcacggcatgttatacaaccaggcggcgaaagaggcacaactggcagacgccatcgccagagcggtatacgcttgcgatccggcattgattctcgtcgggctggcaggaagcgagctgattcgtgcaggcgaacgatatggcctggtaacgcgcgaggaagtgtttgccgatcgcggttatcaggcagacggttcgctggtgccgcgaagccagccaggcgcgttgattgaaaacgaagaacaggcgctggcgcaaacgttggagatggtgcaatacggcagagtcaaaagtatcaccggcgaatgggcaatggtcacggcgcaaacggtctgcctacatggcgatggcgagcacgcactggcgttcgcccgccgattacgagctacatttgctgaaaaggggattgttgtcgcagcataa

SEQ ID NO: 1648 - protein, 244 aa, Escherichia coli
MKIDLNADLGEGCASDAELLTLVSSANIACGFHAGDAQTMQACVREAIKNGVAIGAHPSFPDRENFGRSAMQLPPETVFAQTLYQIGALAAITRAQGGVMCHVKPHGMLYNQAAKEAQLADAIARAVYACDPALILVGLAGSELIRAGERYGLVTREEVFADRGYQADGSLVPRSQPGALIENEEQALAQTLEMVQYGRVKSITGEWAMVTAQTVCLHGDGEHALAFARRLRATFAEKGIVVAA

SEQ ID NO: 1649 - DNA, 792 bp, Escherichia coli
atgcctgaaggcccggagatccgccgtgcagcggataacctggaggcggcgatcaaaggcaaaccactaactgatgtctggtttgccttcccgcagttaaaatcttatcaatcacgacttatcggtcaacacgttacccatgtggaaacgcgtggtaaggcgttgttaactcatttttccaacgacttaacgctctacagccataatcagctttacggtgtctggcgcgtggttgatacaggcgaagagccgcagaccacgcgagtactgcgggtaaaactgcaaacggctgacaaaaccattctgctttatagcgcctcggatattgagatgttgaccccggaacaactgaccacgcatccgtttttacaacgcgttggtcccgatgtgctggatccgaatctgacgccggaggtggtaaaggaacgattattgtcgccgcgctttcgtaaccgccagtttgctggattactgctcgatcaggcgtttctggcaggacttggcaattatttgcgggtggagatcctctggcaggttgggttgaccggaaatcataaagcgaaagatctcaatgcggcgcaactggatgcactcgcacacgcgttactggatactccgcgactttcttacgctacgcggggccaggtggatgaaaacaaatatcatggggcgctgtttcgctttaaggtttttcatcgtgatggcgaaccttgcgaacgctgtggcggcatcattgagaaaaccacgctgtcatcgcgcccgttttactggtgcccaggctgccagcactag

SEQ ID NO: 1650 - protein, 263 aa, Escherichia coli
MPEGPEIRRAADNLEAAIKGKPLTDVWFAFPQLKSYQSRLIGQHVTHVETRGKALLTHFSNDLTLYSHNQLYGVWRVVDTGEEPQTTRVLRVKLQTADKTILLYSASDIEMLTPEQLTTHPFLQRVGPDVLDPNLTPEVVKERLLSPRFRNRQFAGLLLDQAFLAGLGNYLRVEILWQVGLTGNHKAKDLNAAQLDALAHALLDTPRLSYATRGQVDENKYHGALFRFKVFHRDGEPCERCGGIIEKTTLSSRPFYWCPGCQH

SEQ ID NO: 1651 - DNA, 1047 bp, Escherichia coli
atgcctgtattgcagtggggaatgttatgtgttctgtcacttctcctttctattggcttcctcgctttacatctcccggcggcactcctgcttggcccgatgatcgccgggatcatcttcagtatgcgcggagtcactctgcaacttccccgctccgcttttctcgctgcccaagccattcttggctgcatgattgcacaaaacctcactggttcgattctcaccacgctggccgtcaactggccgatcgtgcttgcgattttactggtgacgctgctttccagcgccatcgtgggttggttattggtgcgctatagctcactgcctggaaataccggggcctggggttcttctcctggcggcgcggcggcaatggtcgcaatggcgcaagattacggcgcagatattcgcctggtggcgtttatgcaatatctgcgagtgctgttcgtcgcgggggccgctgttctggttacccgcatgatgctgggcgataacgctgaagcggttaaccagcagatcgtctggttcccgccagtgagcattaatctcctgcttacgattttgctcgcggtcgttgccggtacggcgggatgcttgctacgtcttccttccggcacgatgctcatcccgatgctggcgggcgcagtgctccagtctggtcagctcatcacgattgaactcccggaatggctgctggcgatggcatatatggcaattggctggcggattggtcttggtttcgataagcaaatattactgcgggcattgcgcccactgccacaaatcctgctgtcgatttttgctctgctggctatttgtgcgggtatggcgtgggggctgacccggtttatgcatattgattttatgaccgcctacctcgccaccagccccggcgggcttgataccgtggcggtcatcgccgcagggagcaatgccgatatggcgctcatcatggcgatgcaaaccctgcgcctgttcagtattttgctgacggggcctgccatcgcacggtttatttcaacctatgcgccgaagcgttcggcctag

SEQ ID NO: 1652 - protein, 348 aa, Escherichia coli
MPVLQWGMLCVLSLLLSIGFLALHLPAALLLGPMIAGIIFSMRGVTLQLPRSAFLAAQAILGCMIAQNLTGSILTTLAVNWPIVLAILLVTLLSSAIVGWLLVRYSSLPGNTGAWGSSPGGAAAMVAMAQDYGADIRLVAFMQYLRVLFVAGAAVLVTRMMLGDNAEAVNQQIVWFPPVSINLLLTILLAVVAGTAGCLLRLPSGTMLIPMLAGAVLQSGQLITIELPEWLLAMAYMAIGWRIGLGFDKQILLRALRPLPQILLSIFALLAICAGMAWGLTRFMHIDFMTAYLATSPGGLDTVAVIAAGSNADMALIMAMQTLRLFSILLTGPAIARFISTYAPKRSA

SEQ ID NO: 1653 - DNA, 375 bp, Escherichia coli
gtgattgatttgggtaaatttaacttactggatattcgccgccacacaatgtcgaaaacattcagtatcaagacaacaaaatcgcaaaatgaccagtgtaccgacggatttaaggtcagctcctcgttttataccgaaaaaacgttggttgaagaagataaagcattgttgattggtaatggtctgaagctacgtatactggatgaaaacgcctcgccttatacattcaataaatatgctgaatacgccgatttcaccagtgatatgctgatctacgaaaaaacctatacggctgaattatcgtccacacctggcactcccatcgcggcgggtcccttcgatacagtggtactttttaagattaactataactga

SEQ ID NO: 1654 - protein, 124 aa, Escherichia coli
MIDLGKFNLLDIRRHTMSKTFSIKTTKSQNDQCTDGFKVSSSFYTEKTLVEEDKALLIGNGLKLRILDENASPYTFNKYAEYADFTSDMLIYEKTYTAELSSTPGTPIAAGPFDTVVLFKINYN

SEQ ID NO: 1655 - DNA, 1284 bp, Escherichia coli
atggctgatacaaaagcaaaactcaccctcaacggggacacagctgttgaactggatgtgctgaaaggcacgctgggtcaagatgttattgatatccgtactctcggttcaaaaggtgtgttcacctttgacccaggcttcacttcaaccgcatcctgcgaatctaaaattacttttattgatggtgatgaaggtattttgctgcaccgcggtttcccgatcgatcagctggcgaccgattctaactacctggaagtttgttacatcctgctgaatggtgaaaaaccgactcaggaacagtatgacgaatttaaaactacggtgacccgtcataccatgatccacgagcagattacccgtctgttccatgctttccgtcgcgactcgcatccaatggcagtcatgtgtggtattaccggcgcgctggcagcgttctatcacgactcgctggatgttaacaatcctcgtcatcgtgaaattgccgcgttccgcctgctgtcaaaaatgccgaccatggccgcgatgtgttacaagtattccattggtcagccatttgtttacccgcgcaacgatctctcctacgccggtaacttcctgaatatgatgttctccacgccgtgcgaaccgtatgaagttaatccgattctggaacgtgctatggaccgtattctgatcctgcacgctgaccatgaacagaacgcctccacctccaccgtgcgtaccgctggctcttcgggtgcgaacccgtttgcctgtatcgcagcaggtattgcttcactgtggggacctgcgcacggtggtgctaacgaagcggcgctgaaaatgctggaagaaatcagctccgttaaacacattccagaatttgttcgtcgagcgaaagacaaaaatgattctttccgcctgatgggcttcggtcaccgcgtgtacaaaaattacgacccgcgcgccaccgtaatgcgtgaaacctgccatgaagttctgaaagagctgggtaccaaagatgacctgctggaagtggctatggagctggaaaacatcgcgctgaacgacccgtactttatcgagaaaaaactgtacccgaacgtcgatttctactctggtatcatcctgaaagcgatgggtattccgtcttctatgttcaccgtgatcttcgctatggcacgtacggttggctggatcgcccactggagcgaaatgcacagtgacggtatgaagattgcccgtccgcgtcagctgtatacaggatatgaaaaacgcgactttaaaagcgatatcaagcgttaa

SEQ ID NO: 1656 - protein, 427 aa, Escherichia coli
MADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFVRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDIKR

SEQ ID NO: 1657 - DNA, 390 bp, Escherichia coli
atgataagaaatgtgaaaaaacaaagacctgttaatctggacctacagaccatccggttccccgtcacggcgatagcgtccattctccatcgcgtttccggtgtgatcacctttgttgcagtgggcatcctgctgtggcttctgggtaccagcctctcttcccctgaaggtttcgagcaagcttccgcgattatgggcagcttcttcgtcaaatttatcatgtggggcatccttaccgctctggcatatcacgtcgtcgtaggtattcgccacatgatgatggattttggctatctggaagaaacattcgaagcgggtaaacgctccgccaaaatctcctttgttattactgtcgtgttttcacttctcgcaggagtcctcgtatggtaa

SEQ ID NO: 1658 - protein, 129 aa, Escherichia coli
MIRNVKKQRPVNLDLQTIRFPVTAIASILHRVSGVITFVAVGILLWLLGTSLSSPEGFEQASAIMGSFFVKFIMWGILTALAYHVVVGIRHMMMDFGYLEETFEAGKRSAKISFVITVVFSLLAGVLVW

SEQ ID NO: 1659 - DNA, 348 bp, Escherichia coli
atggtaagcaacgcctccgcattaggacgcaatggcgtacatgatttcatcctcgttcgtgctaccgctatcgtcctgacgctctacatcatttatatggtcggttttttcgctaccagtggcgagctgacatatgaagtctggatcggtttcttcgcctctgcgttcaccaaagtgttcaccctgctggcgctgttttctatcttgatccatgcctggatcggcatgtggcaggtgttgaccgactacgttaaaccgctggccttgcgcctgatgctgcaactggtgattgtcgttgcactggtggtttacgtgatttatggattcgttgtggtgtggggtgtgtga

SEQ ID NO: 1660 - protein, 115 aa, Escherichia coli
MVSNASALGRNGVHDFILVRATAIVLTLYIIYMVGFFATSGELTYEVWIGFFASAFTKVFTLLALFSILIHAWIGMWQVLTDYVKPLALRLMLQLVIVVALVVYVIYGFVVVWGV

SEQ ID NO: 1661 - DNA, 1767 bp, Escherichia coli
atgaaattgccagtcagagaatttgatgcagttgtgattggtgctggcggcgcaggtatgcgcgcggcgctgcaaatttcccagagtggccagacctgtgcgctgctctctaaagtcttcccgacccgttcccataccgtttctgcgcaaggtggtattaccgttgcgctgggtaatacccatgaagataactgggaatggcatatgtacgacaccgtaaaagggtcggactatatcggtgaccaggacgcgattgaatatatgtgtaaaaccgggccggaagcgattctggaactggaacatatgggcctgccgttctcgcgtcttgatgatggtcgtatctatcaacgtccgtttggcggtcagtcgaaaaacttcggcggcgagcaggcggcacgtactgcggcggctgccgaccgtaccggtcacgcactgttgcacacgctttatcagcagaacctgaaaaaccacaccaccattttctccgagtggtatgcgctggatctggtgaaaaaccaggatggcgcagtggtcggttgtaccgcactgtgcatcgaaactggtgaagtggtttactttaaagctcgcgcgacagtgctggcgactggcggggcagggcgtatttatcagtccaccaccaacgcccacattaacactggcgacggtgtcggcatggctatccgtgcaggcgtaccggtacaggatatggaaatgtggcagttccacccgacaggtattgccggtgcgggcgtactggtcaccgaaggttgccgtggtgaaggcggttatctgctgaacaaacatggcgaacgctttatggaacgttatgcgccgaacgccaaagacctggcgggccgtgacgtggtggcgcgttccatcatgatcgaaatccgtgaaggccgcggctgtgatggtccgtgggggccacacgcaaaactgaaacttgaccatctgggtaaagaagttcttgaatcccgtctgccgggtatccttgaactctcccgcaccttcgctcacgtcgatccggtgaaagagccgattccggttatcccaacctgtcactacatgatgggcggtattccgaccaaagtgaccggtcaggcgctgactgtgaatgagaaaggcgaagatgtggttgttccggggctatttgccgttggtgaaatcgcttgtgtatcggtacatggcgctaaccgtctgggcggcaactcgctgctggacctggtcgtatttggtcgtgcggcaggtctgcatctgcaagagtctatcgccgagcagggcgcactgcgcgatgccagcgagtctgatgtagaagcgtctctggatcgcctgaaccgctggaacaataaccgtaacggtgaagatccggtggcgatccgtaaagcactgcaagaatgtatgcagcataacttctcggtcttccgtgaaggtgatgcgatggcgaaagggcttgagcagttgaaagttatccgcgagcgtctgaaaaatgcccgtctggatgacacttccagcgagttcaacacccagcgcgttgagtgcctggaactggataacctgatggaaacggcgtatgcaacggctgtttctgccaacttccgtaccgaaagccgtggcgcgcatagccgcttcgacttcccggatcgcgatgatgaaaactggctgtgccactccctgtatctgccagagtcggaatccatgacgcgccgaagcgtcaacatggaaccgaaactgcgcccggcattcccgccgaagattcgtacttactaa

SEQ ID NO: 1662 - protein, 588 aa, Escherichia coli
MKLPVREFDAVVIGAGGAGMRAALQISQSGQTCALLSKVFPTRSHTVSAQGGITVALGNTHEDNWEWHMYDTVKGSDYIGDQDAIEYMCKTGPEAILELEHMGLPFSRLDDGRIYQRPFGGQSKNFGGEQAARTAAAADRTGHALLHTLYQQNLKNHTTIFSEWYALDLVKNQDGAVVGCTALCIETGEVVYFKARATVLATGGAGRIYQSTTNAHINTGDGVGMAIRAGVPVQDMEMWQFHPTGIAGAGVLVTEGCRGEGGYLLNKHGERFMERYAPNAKDLAGRDVVARSIMIEIREGRGCDGPWGPHAKLKLDHLGKEVLESRLPGILELSRTFAHVDPVKEPIPVIPTCHYMMGGIPTKVTGQALTVNEKGEDVVVPGLFAVGEIACVSVHGANRLGGNSLLDLVVFGRAAGLHLQESIAEQGALRDASESDVEASLDRLNRWNNNRNGEDPVAIRKALQECMQHNFSVFREGDAMAKGLEQLKVIRERLKNARLDDTSSEFNTQRVECLELDNLMETAYATAVSANFRTESRGAHSRFDFPDRDDENWLCHSLYLPESESMTRRSVNMEPKLRPAFPPKIRTY

SEQ ID NO: 1663 - DNA, 717 bp, Escherichia coli
atgagactcgagttttcaatttatcgctataacccggatgttgatgatgctccgcgtatgcaggattacaccctggaagcggaagaaggtcgtgacatgatgctgctggatgcgcttatccagctgaaagagaaagatcccagcctgtcgttccgccgctcctgccgtgaaggtgtgtgcggttccgacggtctgaacatgaacggtaagaatggtctggcctgtattaccccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggttgtatgaatgtattctctgcgcatgttgttcaacctcttgtccgtctttctggtggaatcccgataagtttatcggcccggcaggcttgttagcggcatatcgtttcctgatcgatagccgtgataccgagactgacagccgcctcgacggtttgagcgatgcattcagtgtattccgctgtcacagcatcatgaactgcgtcagtgtatgtccgaaggggctgaacccgacgcgcgccatcggccatatcaagtcgatgttgttgcaacgtaatgcgtaa

SEQ ID NO: 1664 - protein, 238 aa, Escherichia coli
MRLEFSIYRYNPDVDDAPRMQDYTLEAEEGRDMMLLDALIQLKEKDPSLSFRRSCREGVCGSDGLNMNGKNGLACITPISALNQPGKKIVIRPLPGLPVIRDLVVDMGQFYAQYEKIKPYLLNNGQNPPAREHLQMPEQREKLDGLYECILCACCSTSCPSFWWNPDKFIGPAGLLAAYRFLIDSRDTETDSRLDGLSDAFSVFRCHSIMNCVSVCPKGLNPTRAIGHIKSMLLQRNA

SEQ ID NO: 1665 - DNA, 2802 bp, Escherichia coli
atgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgaactgctggaagcactcaagcaaacctactgcggcccgattggtgccgagtatatgcacattaccagcactgaagaaaaacgctggatccaacagcgtattgagtctggtcgcgcgactttcaatagcgaagagaaaaaacgcttcttaagcgaactgaccgccgctgaaggccttgaacgttacctcggcgcaaaattccctggcgcaaaacgcttctcgctggaaggcggtgacgcgttaatcccgatgcttaaagagatgatccgccacgctggcaacagcggcacccgcgaagtggttctcggaatggcgcaccgtggtcgtctgaacgtgctggtgaacgtgctgggtaaaaaaccgcaagacttgttcgacgagtttgccggtaaacataaagaacacctcggcacgggcgacgtgaaataccacatgggcttctcgtctgacttccagaccgatggcggcctggttcacctggcgctggcgtttaacccgtctcaccttgagattgtaagcccggtcgttatcggttctgttcgtgcccgtctggacagacttgatgagccgagcagcaacaaagtgctgccaatcaccattcatggtgacgccgcagtgaccgggcagggcgtggttcaggaaaccctgaacatgtcgaaagcgcgtggttatgaagttggcggtacggtacgtatcgttatcaacaaccaggttggcttcaccacctctaacccgctggatgcccgttcgacgccgtactgtactgatatcggtaagatggttcaggcaccgattttccacgttaacgcggatgatccggaagccgttgcctttgttacccgtctggcgctcgatttccgtaacacctttaaacgtgatgtcttcatcgacctggtatgctaccgccgtcacggccacaacgaagccgacgagccgagcgcaacccagccgctgatgtatcagaaaatcaaaaaacatccgacgccgcgcaaaatctacgctgacaagctggagcaggaaaaagtcgcgacgctggaagatgccaccgagatggttaacctgtaccgcgatgcgctggatgctggcgattgcgttgtagcagagtggcgtccgatgaacatgcactctttcacctggtcgccgtacctcaaccatgaatgggacgaagagtacccgaacaaagttgagatgaagcgcctgcaggaactggctaaacgcatcagcacggtgccggaagcggttgaaatgcagtctcgcgttgccaagatttatggcgatcgccaggcgatggcagccggtgagaaactgttcgactggggcggcgcggaaaacctcgcttacgccacgttggttgacgaaggcattccggttcgcctgtcgggtgaagactccggtcgcggtaccttcttccaccgccacgcggtgatccacaaccagtctaacggttccacttacacgccgctgcaacatatccataacggccagggcgcgttccgcgtctgggactctgtactgtctgaagaagccgtactggcgtttgaatacggttatgccaccgcagaaccacgcaccctgaccatctgggaagcacagttcggtgacttcgccaacggtgcacaggtggttatcgaccagttcatctcctctggcgaacagaaatggggccggatgtgtggcctggtgatgttgctgccgcacggttacgaagggcaggggccggagcactcctccgcgcgtctggaacgttatctgcaactttgcgctgagcaaaacatgcaggtttgcgtaccttctaccccggcacaggtttaccacatgctgcgtcgtcaggcgttgcgcgggatgcgtcgtccactggtcgtgatgtcgccgaaatccctgctgcgtcatccgctggcggtatccagcctcgaagaactggcgaacggcaccttcctgccagccatcggtgaaatcgacgagcttgatctgaagggcgtgaagcgcgtagtgatgtgttctggtaaggtttattacgacctgctggaacaacgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccagcctccgcctctccggcggtagggtatatgtccgttcaccagaaacagcaacaagatctggttaatgacgcgctgaacgtcgaataa

SEQ ID NO: 1666 - protein, 933 aa, Escherichia coli
MQNSALKAWLDSSYLSGANQSWIEQLYEDFLTDPDSVDANWRSTFQQLPGTGVKPDQFHSQTREYFRRLAKDASRYSSTISDPDTNVKQVKVLQLINAYRFRGHQHANLDPLGLWQQDKVADLDPSFHDLTEADFQETFNVGSFASGKETMKLGELLEALKQTYCGPIGAEYMHITSTEEKRWIQQRIESGRATFNSEEKKRFLSELTAAEGLERYLGAKFPGAKRFSLEGGDALIPMLKEMIRHAGNSGTREVVLGMAHRGRLNVLVNVLGKKPQDLFDEFAGKHKEHLGTGDVKYHMGFSSDFQTDGGLVHLALAFNPSHLEIVSPVVIGSVRARLDRLDEPSSNKVLPITIHGDAAVTGQGVVQETLNMSKARGYEVGGTVRIVINNQVGFTTSNPLDARSTPYCTDIGKMVQAPIFHVNADDPEAVAFVTRLALDFRNTFKRDVFIDLVCYRRHGHNEADEPSATQPLMYQKIKKHPTPRKIYADKLEQEKVATLEDATEMVNLYRDALDAGDCVVAEWRPMNMHSFTWSPYLNHEWDEEYPNKVEMKRLQELAKRISTVPEAVEMQSRVAKIYGDRQAMAAGEKLFDWGGAENLAYATLVDEGIPVRLSGEDSGRGTFFHRHAVIHNQSNGSTYTPLQHIHNGQGAFRVWDSVLSEEAVLAFEYGYATAEPRTLTIWEAQFGDFANGAQVVIDQFISSGEQKWGRMCGLVMLLPHGYEGQGPEHSSARLERYLQLCAEQNMQVCVPSTPAQVYHMLRRQALRGMRRPLVVMSPKSLLRHPLAVSSLEELANGTFLPAIGEIDELDLKGVKRVVMCSGKVYYDLLEQRRKNNQHDVAIVRIEQLYPFPHKAMQEVLQQFAHVKDFVWCQEEPLNQGAWYCSQHHFREVIPFGASLRYAGRPASASPAVGYMSVHQKQQQDLVNDALNVE

SEQ ID NO: 1667 - DNA, 960 bp, Escherichia coli
atgagtagcgtagatattctggtccctgacctgcctgaatccgtagccgatgccaccgtcgcaacctggcataaaaaacccggcgacgcagtcgtacgtgatgaagtgctggtagaaatcgaaactgacaaagtggtactggaagtaccggcatcagcagacggcattctggatgcggttctggaagatgaaggtacaacggtaacgtctcgtcagatccttggtcgcctgcgtgaaggcaacagcgcgggtaaagaaaccagcgccaaatctgaagagaaagcgtccactccggcgcaacgccagcaggcgtctctggaagagcaaaacaacgatgcgttaagcccggcgatccgtcgcctgctggctgaacataacctcgacgccagcgctattaaaggcacgggtgtgggtggtcgtctgacccgtgaagatgtggaaaaacatctggcgaaagccccggcgaaagagtctgctccggcagcgcctgctccggcggcgcaaccggccctggctgcacgtagcgaaaaacgtgtgccgatgactcgcctgcgtaagcgtgtggcagagcgtctgctggaagcgaaaaactccaccgccatgctgaccacgttcaacgaagtcaacatgaagccgattatggatctgcgtaagcagtacggtgaagcgtttgaaaaacgccacggcatccgtctgggctttatgtccttctacgtgaaagcggtggttgaagccctgaaacgttacccggaagtgaatgcgtctatcgacggtgatgatgtggtctaccacaactatttcgacgtcagtatggcggtttctacgccgcgcggtctggtgacgccggttctgcgtgatgtcgataccctcggcatggcagacatcgagaagaaaatcaaagagctggctgttaaaggccgtgacggcaagctgacggttgaagatctgacccggtggtaa

SEQ ID NO: 1668 - protein, 319 aa, Escherichia coli
MSSVDILVPDLPESVADATVATWHKKPGDAVVRDEVLVEIETDKVVLEVPASADGILDAVLEDEGTTVTSRQILGRLREGNSAGKETSAKSEEKASTPAQRQQASLEEQNNDALSPAIRRLLAEHNLDASAIKGTGVGGRLTREDVEKHLAKAPAKESAPAAPAPAAQPALAARSEKRVPMTRLRKRVAERLLEAKNSTAMLTTFNEVNMKPIMDLRKQYGEAFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTRW

SEQ ID NO: 1669 - DNA, 237 bp, Escherichia coli
gtgttcggttccctgatgtcaacgcctatcatcaacccaccgcagagcgcaattctgggtatgcacgctatcaaagatcgtccgatggcagtgaatggtcaggttgagatcctgccgatgatgtacctggcgctgtcctacgatcaccgtttgatcgatggtcgcgaatccgtgggcttccttgtaacgatcaaagagttgctggaagatccgacgcgtctgctgctggacgtgtag

SEQ ID NO: 1670 - protein, 78 aa, Escherichia coli
MFGSLMSTPIINPPQSAILGMHAIKDRPMAVNGQVEILPMMYLALSYDHRLIDGRESVGFLVTIKELLEDPTRLLLDV

SEQ ID NO: 1671 - DNA, 1167 bp, Escherichia coli
atgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgcgtggtctttatggcctccaccgaaggcggcgtggaaattgaaaaagtggcggaagaaactccgcacctgatccacaaagttgcgcttgatccgctgactggcccgatgccgtatcagggacgcgaactggcgtttaaactgggtctggaaggtaaactggttcagcagttcaccaaaatcttcatgggtctggcgaccattttcctggagcgcgacctggcgctgatcgaaatcaacccgctggttattaccaaacagggcgatctgatttgcctcgacggcaaactgggcgctgatggcaacgcactgttccgccagcctgatctgcgtgaaatgcgtgaccagtcgcaggaagatccgcgtgaagcacaggctgcacagtgggaactgaactacgttgcgctggacggtaacatcggttgtatggttaacggcgcaggtctggcaatgggtacgatggacatcgttaaactgcacggcggcgaaccggctaacttcctggacgttggcggcggcgcaaccaaagaacgtgtaaccgaagcgttcaaaatcatcctctctgacgacaaagtgaaagctgttctggttaacatcttcggcggtatcgttcgttgcgacctgatcgctgacggtatcatcggcgcggtagcggaagtgggtgttaacgtaccggtcgtggtacgtctggaaggtaacaacgccgaactcggtgcgaagaaactggctgacagcggcctgaatattattgcagcaaaaggtctgacggatgcagctcagcaggttgttgccgcagtggaggggaaataa

SEQ ID NO: 1672 - protein, 388 aa, Escherichia coli
MNLHEYQAKQLFARYGLPAPVGYACTTPREAEEAASKIGAGPWVVKCQVHAGGRGKAGGVKVVNSKEDIRAFAENWLGKRLVTYQTDANGQPVNQILVEAATDIAKELYLGAVVDRSSRRVVFMASTEGGVEIEKVAEETPHLIHKVALDPLTGPMPYQGRELAFKLGLEGKLVQQFTKIFMGLATIFLERDLALIEINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDKVKAVLVNIFGGIVRCDLIADGIIGAVAEVGVNVPVVVRLEGNNAELGAKKLADSGLNIIAAKGLTDAAQQVVAAVEGK

SEQ ID NO: 1673 - DNA, 870 bp, Escherichia coli
atgtccattttaattgataaaaacaccaaggttatctgccagggctttaccggtagccaggggactttccactcagaacaggctattgcatacggcactaaaatggttggcggcgtaaccccaggtaaaggcggcaccacccacctcggcctgccggtgttcaacaccgtgcgtgaagctgttgctgctactggcgctaccgcttctgttatctacgtaccagcaccgttctgcaaagactccattctggaagccatcgatgcaggcatcaaactgattatcaccatcactgaaggcatcccgacgctggatatgctgaccgtgaaagtgaaactggatgaagcaggcgttcgtatgatcggcccgaactgcccaggcgttatcaccccgggggaatgcaaaatcggtatccagccgggtcacattcacaaaccaggtaaagtgggtatcgtttcccgttccggtacgctgacctatgaagcggttaaacagaccacggattacggtttcggtcagtcgacctgtgttggtatcggcggcgacccgatccctggctctaactttatcgatatcctcgaaatgttcgaaaaagatccgcagaccgaagcgatcgtgatgatcggtgagatcggcggtagcgctgaagaagaagcagcggcgtacatcaaggaacacgttaccaagccagttgtgggttacatcgctggtgtgactgcgccgaaaggcaaacgtatgggtcacgcaggtgcgatcattgccggtggtaaagggactgcggatgagaaattcgctgctctggaagccgcaggcgtgaaaaccgttcgcagcctggcggatatcggtgaagcactgaaaactgttctgaaataa

SEQ ID NO: 1674 - protein, 289 aa, Escherichia coli
MSILIDKNTKVICQGFTGSQGTFHSEQAIAYGTKMVGGVTPGKGGTTHLGLPVFNTVREAVAATGATASVIYVPAPFCKDSILEAIDAGIKLIITITEGIPTLDMLTVKVKLDEAGVRMIGPNCPGVITPGECKIGIQPGHIHKPGKVGIVSRSGTLTYEAVKQTTDYGFGQSTCVGIGGDPIPGSNFIDILEMFEKDPQTEAIVMIGEIGGSAEEEAAAYIKEHVTKPVVGYIAGVTAPKGKRMGHAGAIIAGGKGTADEKFAALEAAGVKTVRSLADIGEALKTVLK

SEQ ID NO: 1675 - DNA, 1026 bp, Escherichia coli
gtgacgctgcaacgcaatggcgcacaatctgtttctggaaccacaaatgcatcgggcagcgttaatctgggttctacatttgctgatgatcaagatgctttattgatcgtcaaaaaagagggctattctaatctggtggtcaaatgttcgtgtgctggcatgacttatgcgattagtccggcaatgactagtctggatggcatgcgtgtagttttgagctggggcgaaaagccttttgatcttgattcacatttgatcttccctggcggacatatctattttgatagtaaagaggggactgatgctaatctggatgttgatgatacggatagctatggatcagaaactgtcactatcagcaaaaagcattttggcgaaagttacatctatgccgtgcaggactatagcaacaaagggttgcccaacagtaattatctctctgccagtaaggcaaaagtgtttgtttatgtagggagctccctggtgcgtagttatagtgtccctgctggaaaacgagggaacatctggaccgtgtttaaactcaatccaaacggcgagtttgaagatatcaactctgttaccagcgccaattttaacgacaccacattaggcgtcagggatttagccactgtgataatgcctgcgacgggttcttcaactccggcttcacctgcgatgcaaaacagtggagatactcaactggcaagaaaatataatcgtgaaggcgaagctgtttacaaaaccggtcaacttgagcaagccattcaactcttccaacaggcaacagaattagacggcaattacggacaggcatttagtaacctggggctggcgtatcagaaaaatggcaacatcgcggaagcaatttgggcaaatcgtaaagcgatctcgttagccagtggagcaaatgcggcgacaacgcgcgctaactcctattataacattgccaaaatttatgaaactgctggacaggacgctgatgcattgcagcattatcaactcgctcttcacgatgccattttataa

SEQ ID NO: 1676 - protein, 341 aa, Escherichia coli
MTLQRNGAQSVSGTTNASGSVNLGSTFADDQDALLIVKKEGYSNLVVKCSCAGMTYAISPAMTSLDGMRVVLSWGEKPFDLDSHLIFPGGHIYFDSKEGTDANLDVDDTDSYGSETVTISKKHFGESYIYAVQDYSNKGLPNSNYLSASKAKVFVYVGSSLVRSYSVPAGKRGNIWTVFKLNPNGEFEDINSVTSANFNDTTLGVRDLATVIMPATGSSTPASPAMQNSGDTQLARKYNREGEAVYKTGQLEQAIQLFQQATELDGNYGQAFSNLGLAYQKNGNIAEAIWANRKAISLASGANAATTRANSYYNIAKIYETAGQDADALQHYQLALHDAIL

SEQ ID NO: 1677 - DNA, 117 bp, Escherichia coli
ttgcagaacaaccttgattccaacggcgaaatcatgtttatcctccaggttgccgcccatatggagctgaatatcattcagtccacgcttgatgagttgatatcgctatatccatag

SEQ ID NO: 1678 - protein, 38 aa, Escherichia coli
MQNNLDSNGEIMFILQVAAHMELNIIQSTLDELISLYP

SEQ ID NO: 1679 - DNA, 1569 bp, Escherichia coli
atgttagatatagtcgaactgtcgcgcttacagtttgccttgaccgcgatgtaccacttcctttttgtgccactgacgctcggtatggcgttcctgctggccattatggaaacggtctacgtcctttccggcaaacagatttataaagatatgaccaagttctggggcaagttgtttggtatcaactttgctctgggtgtggctaccggtctgaccatggagttccagttcgggactaactggtcttactattcccactatgtaggggatatcttcggtgcgccgctggcaatcgaaggtctgatggccttcttcctcgaatccacctttgtaggtctgttcttcttcggttgggatcgtctgggtaaagttcagcatatgtgtgtcacctggctggtggcgctcggttcaaacctgtccgcactgtggattctggttgcaaacggctggatgcaaaacccaatcgcgtccgatttcaactttgaaactatgcgtatggagatggtgagcttctccgagctggtgcttaacccggttgctcaggtgaaattcgttcacaccgtagcttctggttatgtgactggcgcaatgttcatcctcggtatcagcgcatggtatatgctgaaaggtcgtgacttcgccttcgctaaacgctcctttgctatcgctgccagcttcggtatggctgccgttctgtctgttattgttctgggtgatgaatccggctacgaaatgggcgacgtgcagaaaaccaaactggctgctatcgaagccgagtgggaaacgcaacctgcacctgctgcctttactctgttcggcattcctgatcaggaagaggaaacgaacaaatttgcgatccagatcccttacgcgctgggcatcattgcaacgcgttccgtggatactccagttatcggtctgaaagaactgatggtgcagcatgaagaacgcattcgtaacgggatgaaggcgtactctctgctcgaacaactgcgttctggttctactgaccaggccgttcgtgaccagttcaatagcatgaagaaagatctcggttacggtctgctgctgaaacgctatacgccaaacgtggctgatgcgactgaagctcagattcaacaggcaaccaaagactccattccgcgtgtagcgccgctgtactttgcgttccgtatcatggtggcgtgtggcttcctgctgctggcaatcatcgcgctctctttctggagtgtcatccgcaaccgcattggcgagaaaaaatggctgctgcgcgccgcgctgtacggtattccgctgccgtggattgctgtagaagcgggctggttcgtggctgaatatggccgccaaccgtgggctatcggtgaagtgctgccgacagctgtggcgaactcgtcactgaccgcaggcgatctcatcttctcgatggtgctgatttgcggcctgtataccctgttcctggtggcagaattgttcttaatgttcaagtttgcacgcctcggcccaagcagcctgaaaaccggtcgctatcactttgagcagtcttccacgactactcagccggcacgctaa

SEQ ID NO: 1680 - protein, 522 aa, Escherichia coli [sequence omitted]

SEQ ID NO: 1681 - DNA, 1140 bp, Escherichia coli
atgatcgattatgaagtattgcgttttatctggtggctgctggttggcgttctgctgattggttttgcagtcactgacggtttcgacatgggggtgggcatgctcacccgtttcctcggtcgtaacgacaccgagcgtcgaattatgattaactccatcgcaccacactgggacggtaaccaggtttggctgatcaccgcaggcggcgcactgtttgctgcctggccgatggtctatgccgctgcgttctccggcttctatgtggcgatgatcctcgtgctggcgtctttgttcttccgtccggtcggttttgactaccgctccaagattgaagaaacccgctggcgtaacatgtgggactggggcatcttcattggtagcttcgttccgccgctggtgattggtgtagcgttcggtaacctgttgcagggcgtaccattcaacgttgatgaatatctgcgtctgtactacaccggtaacttcttccagctgcttaacccgttcggcctgctggcaggtgtggtgagcgtagggatgatcattactcagggcgcaacctatctgcaaatgcgtaccgtgggcgaactgcacctgcgtacccgtgcaacggctcaggtggcggcactggtgacgctggtctgcttcgcactggctggcgtatgggtgatgtacggtatcgatggttatgtcgtgaaatcgacaatggaccattacgcagcctctaacccgctgaataaagaagtggttcgtgaagctggcgcatggctggttaacttcaacaacacgccaattctgtgggctattccggcactgggtgtggttctgccgctgctgaccatcctgactgcacgtatggataaagccgcgtgggcgtttgtattctcctccctgacgctggcctgcatcatcctgactgccggtatcgcaatgttcccgtttgtgatgccgtccagcaccatgatgaacgcaagtctgacaatgtgggatgcaacttccagccagctgacgcttaacgtcatgacctgggttgcggtggttctggtaccgatcattctgctctacaccgcctggtgttactggaaaatgttcggtcgtatcaccaaagaagatattgaacgtaacacccactctctgtactaa

SEQ ID NO: 1682 - protein, 379 aa, Escherichia coli
MIDYEVLRFIWWLLVGVLLIGFAVTDGFDMGVGMLTRFLGRNDTERRIMINSIAPHWDGNQVWLITAGGALFAAWPMVYAAAFSGFYVAMILVLASLFFRPVGFDYRSKIEETRWRNMWDWGIFIGSFVPPLVIGVAFGNLLQGVPFNVDEYLRLYYTGNFFQLLNPFGLLAGVVSVGMIITQGATYLQMRTVGELHLRTRATAQVAALVTLVCFALAGVWVMYGIDGYVVKSTMDHYAASNPLNKEVVREAGAWLVNFNNTPILWAIPALGVVLPLLTILTARMDKAAWAFVFSSLTLACIILTAGIAMFPFVMPSSTMMNASLTMWDATSSQLTLNVMTWVAVVLVPIILLYTAWCYWKMFGRITKEDIERNTHSLY

SEQ ID NO: 1683 - DNA, 114 bp, Escherichia coli
atgtggtatttcgcatggattctgggaacgcttcttgcctgttcgtttggggtaatcaccgcgctggcgcttgagcacgtcgaatcaggcaaagccggtcaagaagacatctga

SEQ ID NO: 1684 - protein, 37 aa, Escherichia coli
MWYFAWILGTLLACSFGVITALALEHVESGKAGQEDI

SEQ ID NO: 1685 - DNA, 294 bp, Escherichia coli
atgagtaagattatcgcaaccttgtatgcggtaatggacaagcgccccctgcgggcgctttccttcgtgatggcacttctgttagcaggatgtatgttttgggacccatcacgtttcgccgcgaagaccagtgaactggaaatctggcatggcttactgcttatgtgggccgtctgtgctggtgtgattcacggcgtgggctttcgtccgcagaaggttctctggcaagggattttttgcccattgcttgccgatattgttctcattgtcgggctgattttcttcttcttttaa

SEQ ID NO: 1686 - protein, 97 aa, Escherichia coli
MSKIIATLYAVMDKRPLRALSFVMALLLAGCMFWDPSRFAAKTSELEIWHGLLLMWAVCAGVIHGVGFRPQKVLWQGIFCPLLADIVLIVGLIFFFF

SEQ ID NO: 1687 - DNA, 405 bp, Escherichia coli
gtgaatacaacgctgtttcgatggccggttcgcgtctactatgaagataccgatgccggtggtgtggtgtaccacgccagttacgtcgctttttatgaaagagcacgcacagagatgctgcgtcatcatcatttcagtcaacaggcgctgatggctgaacgcgttgcctttgtggtacgtaaaatgacggtggaatattacgcacctgcgcggctcgacgatatgctcgaaatacagactgaaataacatcaatgcgtggcacctctttggttttcacgcaacgtattgtcaacgccgagaatactttgttgaatgaagcagaggttctggttgtttgcgttgacccactcaaaatgaagcctcgtgcgcttcccaagtctattgtcgcggagtttaagcagtga

SEQ ID NO: 1688 - protein, 134 aa, Escherichia coli
MNTTLFRWPVRVYYEDTDAGGVVYHASYVAFYERARTEMLRHHHFSQQALMAERVAFVVRKMTVEYYAPARLDDMLEIQTEITSMRGTSLVFTQRIVNAENTLLNEAEVLVVCVDPLKMKPRALPKSIVAEFKQ

SEQ ID NO: 1689 - DNA, 684 bp, Escherichia coli
atgaatatccttgatttgttcctgaaggctagccttctggttaaacttatcatgttgattttgattggtttttcaatcgcatcctgggccattattatccagcggacccgtattcttaacgcagcggcgcgcgaagccgaagcgtttgaagataaattctggtctggaatcgaactctctcgcctctatcaagagagccaggggaaacgggataatctgagcggttcggaacaaatcttttacagcggcttcaaagagtttgtgcgcctgcatcgtgccaatagccatgcgccggaagccgtagtggaaggggcgtcgcgtgcgatgcgtatttccatgaatcgtgaacttgaaaatctggaaacgcacattccgttcctcggtacggttggctccatcagcccgtatattggtctgtttggtacggtctgggggatcatgcacgcctttatcgccctcggggcggtaaaacaagcaacactgcaaatggttgcgcccggtatcgcagaagcgttgattgcgacggcaattggtttgttcgccgcaattccggcggtaatggcttataaccgcctaaaccagcgcgtaaacaaactggaactgaattacgacaactttatggaagagtttaccgcgattctgcaccgccaggcgtttaccgttagcgagagcaacaaggggtaa

SEQ ID NO: 1690 - protein, 227 aa, Escherichia coli
MNILDLFLKASLLVKLIMLILIGFSIASWAIIIQRTRILNAAAREAEAFEDKFWSGIELSRLYQESQGKRDNLSGSEQIFYSGFKEFVRLHRANSHAPEAVVEGASRAMRISMNRELENLETHIPFLGTVGSISPYIGLFGTVWGIMHAFIALGAVKQATLQMVAPGIAEALIATAIGLFAAIPAVMAYNRLNQRVNKLELNYDNFMEEFTAILHRQAFTVSESNKG

SEQ ID NO: 1691 - DNA, 429 bp, Escherichia coli
atggccagagcgcgtggacgaggtcgtcgcgatctcaagtccgaaatcaacattgtaccgttgctggacgtactgctggtgctgttgctgatctttatggcgacagcgcccatcatcacccagagcgtggaggtcgatctgccagacgctactgaatcacaggcggtgagcagtaacgataatccgccagtgattgttgaagtgtctggtattggtcagtacaccgtggtggttgagaaagatcgtctggagcgtttaccaccagagcaggtggtggcggaagtgtccagccgtttcaaggccaacccgaaaacggtctttctgatcggtggcgcaaaagatgtgccttacgatgaaataattaaagcactgaacttgttacatagtgcgggtgtgaaatcggttggtttaatgacgcagcctatctaa

SEQ ID NO: 1692 - protein, 142 aa, Escherichia coli
MARARGRGRRDLKSEINIVPLLDVLLVLLLIFMATAPIITQSVEVDLPDATESQAVSSNDNPPVIVEVSGIGQYTVVVEKDRLERLPPEQVVAEVSSRFKANPKTVFLIGGAKDVPYDEIIKALNLLHSAGVKSVGLMTQPI

SEQ ID NO: 1693 - DNA, 963 bp, Escherichia coli
gtgtcaaaggcaaccgaacaaaacgacaagctcaagcgggcgataattatttcagcagtgctgcatgtcatcttatttgcggcgctgatctggagttcgttcgatgagaatatagaagcttcagccggaggcggcggtggttcgtccatcgacgctgtcatggttgattcaggtgcggtagttgagcagtacaaacgtatgcaaagccaggaatcaagcgcgaagcgttctgatgagcagcgcaagatgaaggagcagcaggctgctgaagaactgcgtgagaaacaagcggctgaacaggaacgcctgaagcaacttgagaaagagcggttagcggctcaggagcagaaaaagcaggctgaagaagccgcaaaacaggccgagttaaagcagaagcaagcggaagaggcggcagcgaaagcggcggcagatgctaaagcgaaggccgaagcggatgctaaagctgcggaagaagcagcgaagaaagcggcggcagacgcgaagaaaaaagcagaagcagaagccgccaaagccgcagtcgaagcgcagaaaaaagccgaggctgctgctgcggcgctgaagaagaaagctgaagcggcagaagcagctgcagctgaagcaagaaagaaagcggcaaccgaagctgctgaaaaagccaaggcagaagctgagaagaaagcggctgctgaaaaggctgcagctgataagaaagcggcagccgacaaaaaagcagcagaaaaagcggctgctgaaaaggcagcagctgataagaaagcagcggcagaaaaagccgccgcagacaaaaaagcggcagcggcaaaagcagcagctgaaaaagccgctgcagcaaaagctgccgcagaggcagatgatattttcggtgagctaagctctggtaagaatgcaccgaaaacgggggggaggggcgaaagggaacaatgcttcgcctgccgggagtggtaa

SEQ ID NO: 1694 - protein, 320 aa, Escherichia coli
MSKATEQNDKLKRAIIISAVLHVILFAALIWSSFDENIEASAGGGGGSSIDAVMVDSGAVVEQYKRMQSQESSAKRSDEQRKMKEQQAAEELREKQAAEQERLKQLEKERLAAQEQKKQAEEAAKQAELKQKQAEEAAAKAAADAKAKAEADAKAAEEAAKKAAADAKKKAEAEAAKAAVEAQKKAEAAAAALKKKAEAAEAAAAEARKKAATEAAEKAKAEAEKKAAAEKAAADKKAAADKKAAEKAAAEKAAADKKAAAEKAAADKKAAAAKAAAEKAAAAKAAAEADDIFGELSSGKNAPKTGGRGEREQCFACREW

SEQ ID NO: 1695 - DNA, 147 bp, Escherichia coli
atgttactggatatcaaacctgaaggtggcgatcccgcactttgtcaagctgcgttggcagcagctaaacttgcgaagatcccgaaaccaccaagccaggcagtatatgaagtgttcaaaaacgcgccattggacttcaaaccgtaa

SEQ ID NO: 1696 - protein, 48 aa, Escherichia coli
MLLDIKPEGGDPALCQAALAAAKLAKIPKPPSQAVYEVFKNAPLDFKP

SEQ ID NO: 1697 - DNA, 1293 bp, Escherichia coli
atgaagcaggcattacgagtagcatttggttttctcatactgtgggcatcagttctgcatgctgaagtccgcattgtgatcgacagcggtgtagattccggtcgtcctattggtgttgttcctttccagtgggcggggcctggtgcggcacctgaagatattggcggcatcgttgctgctgacttgcgtaacagcggtaaatttaatccgttagatcgtgctcgtctgccacagcagccgggtagtgcgcaggaagtacaaccagctgcatggtccgcgctgggcattgacgctgtggttgtcggtcaggtcactccgaatccggatggttcttacaatgtcgcttatcaacttgttgacactggcggcgcaccgggtactgtacttgctcagaactcgtacaaagtgaacaagcagtggctgcgttatgctggtcataccgccagtgacgaagtatttgaaaaactgaccggtattaaaggtgcgttccgtacccgtattgcctacgttgttcagactaacggcggtcagttcccgtatgaactgcgcgtatctgactatgacggttacaaccagtttgtcgttcaccgttcaccgcaaccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagcctgaacctgtacgtaatggatttggcttctggtcagatccgccaggtaactgatggtcgcagtaacaataccgaaccgacctggttcccggacagccagaacctggcatttacttctgaccaggccggtcgtccgcaggtttataaagtgaatatcaacggcggtgcgccacaacgtattacctgggaaggttcgcagaaccaggatgcggatgtcagcagcgacggtaaatttatggtaatggtcagctccaacggtgggcagcagcacattgccaaacaagatctggcaacgggaggcgtacaagttctgtcgtccacgttcctggatgaaacgccaagtctggcacctaacggcactatggtaatctacagctcttctcaggggatgggatccgtgctgaatttggtttctacagatgggcgtttcaaagcgcgtcttccggcaactgatggacaggtcaaattccctgcctggtcgccgtatctgtga

SEQ ID NO: 1698 - protein, 430 aa, Escherichia coli
MKQALRVAFGFLILWASVLHAEVRIVIDSGVDSGRPIGVVPFQWAGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 1699 - DNA, 522 bp, Escherichia coli
atgcaactgaacaaagtgctgaaagggctgatgattgctctgcctgttatggcaattgcggcatgttcttccaacaagaacgccagcaatgacggcagcgaaggcatgctgggtgccggcactggtatggatgcgaacggcggcaacggcaacatgtcttccgaagagcaggctcgtctgcaaatgcaacagctgcagcagaacaacatcgtttacttcgatctggacaagtacgatatccgttctgacttcgctcaaatgctggatgcacacgcaaacttcctgcgtagcaacccgtcttacaaagtcaccgtagaaggtcacgcggacgaacgtggtactccggaatacaacatctccctgggtgaacgtcgtgcgaacgctgttaagatgtatctgcagggtaaaggcgtttctgctgaccagatctccatcgtttcttacggtaaagaaaaacctgcagtactgggtcatgacgaagcggcgtatgccaaaaaccgtcgtgcggtactggtttactaa

SEQ ID NO: 1700 - protein, 173 aa, Escherichia coli
MQLNKVLKGLMIALPVMAIAACSSNKNASNDGSEGMLGAGTGMDANGGNGNMSSEEQARLQMQQLQQNNIVYFDLDKYDIRSDFAQMLDAHANFLRSNPSYKVTVEGHADERGTPEYNISLGERRANAVKMYLQGKGVSADQISIVSYGKEKPAVLGHDEAAYAKNRRAVLVY

SEQ ID NO: 1701 - DNA, 792 bp, Escherichia coli
atgagcagtaacttcagacatcaactattgagtctgtcgttactggttggtatagcggccccctgggccgcttttgctcaggcaccaatcagtagtgtcggctcaggctcggtcgaagaccgcgtcactcaacttgagcgtatttctaatgctcacagccagcttttaacccaactccagcaacaactctctgataatcaatccgatattgattccctgcgtggtcagattcaggaaaatcagtatcaactgaatcaggtcgtggagcggcaaaagcagatcctgttgcagatcgacagcctcagcagcggtggtgcagcggcgcaatcaaccagcggcgatcaaagcggtgtggcggcatcaacgacgccgacagctgatgctggtactgcgaatgctggcgcgccggtgaaaagcggtgatgcaaacacggattacaatgcagctattgcgctggtgcaggataaatcccgccaggatgacgcaatggtggcatttcagaatttcatcaaaaattaccctgattcaacttacctgccaaacgccaattattggctgggtcagttaaactacaacaagggtaaaaaagatgatgcggcgtattattttgcttcggtagtgaaaaactatccgaagtcaccgaaggctgcagatgcgatgtttaaagtcggcgtcatcatgcaggacaaaggtgacaccgcaaaagcgaaagccgtataccagcaggttatcagtaaataccctggtactgatggcgctaaacaggcgcaaaaacgtctgaacgcgatgtaa

SEQ ID NO: 1702 - protein, 263 aa, Escherichia coli
MSSNFRHQLLSLSLLVGIAAPWAAFAQAPISSVGSGSVEDRVTQLERISNAHSQLLTQLQQQLSDNQSDIDSLRGQIQENQYQLNQVVERQKQILLQIDSLSSGGAAAQSTSGDQSGVAASTTPTADAGTANAGAPVKSGDANTDYNAAIALVQDKSRQDDAMVAFQNFIKNYPDSTYLPNANYWLGQLNYNKGKKDDAAYYFASVVKNYPKSPKAADAMFKVGVIMQDKGDTAKAKAVYQQVISKYPGTDGAKQAQKRLNAM

SEQ ID NO: 1703 - DNA, 1044 bp, Escherichia coli
atgagcgtgatgtttgatccagacacggcgatttatcctttccccccgaagccgacgccgttaagcattgatgaaaaagcgtattaccgcgagaagataaaacgtctactaaaagaacgtaatgcggtgatggttgcccactactataccgatcccgaaattcaacaactggcagaagaaaccggtggctgtatttctgattctctggaaatggcgcgcttcggtgcaaagcatcccgcttctacgttgttagttgctggggtgagatttatgggagaaaccgccaaaattctcagtccggaaaaaacaattctgatgccgacacttcaggctgaatgttcactggatctcggctgccctgttgaagaatttaacgcattttgcgatgcccatcccgatcgtactgtcgtcgtctacgccaacacttctgctgcggtaaaagcgcgcgcagattgggtggtaacttcaagcattgccgtcgaacttattgatcatctggatagtttgggtgaaaaaatcatctgggcacctgacaaacatctggggtgttacgtgcaaaaacagacgggcgcagacattttatgctggcagggtgcctgcattgtgcatgatgagtttaagactcaggcgttaacccgcttgcaagaagaatacccggatgctgccatactggtgcatccagaatcaccgcaagctattgtagagatggcggatgcggtcggttccaccagtcaactgatcgctgctgcgaaaacattgccacatcagcggcttatcgtggcaaccgatcggggcattttctacaaaatgcagcaggcggtgccagataaagagttactggaagcaccaaccgcgggtgagggcgcaacctgtcgcagctgcgcgcattgcccgtggatggccatgaatggccttcaggccatcgcagaggcattagaactggaaggaagcaatcacgaggtttatgttgatgaaaggctgctagagagggcgctggtgccgctcaatcgtatgctggattttgcggctacactacgtggataa

SEQ ID NO: 1704 - protein, 347 aa, Escherichia coli
MSVMFDPDTAIYPFPPKPTPLSIDEKAYYREKIKRLLKERNAVMVAHYYTDPEIQQLAEETGGCISDSLEMARFGAKHPASTLLVAGVRFMGETAKILSPEKTILMPTLQAECSLDLGCPVEEFNAFCDAHPDRTVVVYANTSAAVKARADWVVTSSIAVELIDHLDSLGEKIIWAPDKHLGCYVQKQTGADILCWQGACIVHDEFKTQALTRLQEEYPDAAILVHPESPQAIVEMADAVGSTSQLIAAAKTLPHQRLIVATDRGIFYKMQQAVPDKELLEAPTAGEGATCRSCAHCPWMAMNGLQAIAEALELEGSNHEVYVDERLLERALVPLNRMLDFAATLRG

SEQ ID NO: 1705 - DNA, 621 bp, Escherichia coli
ttgctgtgtattggccttgccagtctggagaagatcagtaactacttctttggcctgatcaacgtcaccttgtttggcattattttctttcagattcagctgtatgccagcctgctattacaggtgtttttctttgccgcgaatatttacggctggtatgcgtggtcgcgacaaaccagtcagaacgaggcggagttgaaaattcgctggttgccattgccgaaggcgctaagctggttggcggtttgcgttgtttcgattggtctgatgacggtatttatcaatccggtgtttgcatttttgacccgcgtggcagtcatgatcatgcaagcattaggattacaggttgcgatgcctgaactacagccggacgctttcccgttctgggattcatgcatgatggtgttatctatcgtggcaatgattctgatgacgcgtaagtatgtggaaaactggctgttgtgggtgattattaacgtgattagcgtcgttatttttgcacttcagggcgtttacgccatgtctctggagtacatcatcctgacctttattgccctcaacggcagccggatgtggatcaacagcgcacgcgaaagaggttcacgcgcgctgtcccattaa

SEQ ID NO: 1706 - protein, 206 aa, Escherichia coli
MLCIGLASLEKISNYFFGLINVTLFGIIFFQIQLYASLLLQVFFFAANIYGWYAWSRQTSQNEAELKIRWLPLPKALSWLAVCVVSIGLMTVFINPVFAFLTRVAVMIMQALGLQVAMPELQPDAFPFWDSCMMVLSIVAMILMTRKYVENWLLWVIINVISVVIFALQGVYAMSLEYIILTFIALNGSRMWINSARERGSRALSH

SEQ ID NO: 1707 - DNA, 942 bp, Escherichia coli
atggcgcactcacactcacacgcttcctcacacctgccagaagataataatgctcgtcgcttgttgtatgctttcggcgtgactgccgggtttatgctcgtagaagtcattggcggttttctttccggttctctggcattgctggccgatgcgggtcatatgttgaccgatactgccgccctgcttttcgccctactcgccgtgcaattttcacgtcgacctcccaccattcgccacactttcggttggctaagattgaccacgctcgcagcatttgtgaatgctatcgccctggtggtgattaccattttgattgtctgggaggcgatagaacgcttccgcacaccgcgtccggtcgagggcggcatgatgatggcaattgccgtggctgggctgttggcaaatatactttctttctggttacttcatcacggtagcgaagagaaaaacctcaacgtgcgagcagcggcactgcatgtgctcggggacctgctgggttcggttggggctattattgccgcgttgattattatctggaccggctggacacctgctgaccccattctctcaatactggtgtcgcttctggttctgcgtagcgcgtggcgactgttgaaagatagtgtgaatgaattacttgaaggtgcaccggtatcgctggatatcgctgaactgaagcgtcgcttgtgccgggaaatcccggaagtccgcaatgtgcaccatgtgcatgtatggatggtaggcgagaagccggtgatgacgctgcatgtgcaggtgatcccgccacacgatcacgatgccttgttagatcagatccaacactacctgatggatcactatcagattgagcacgccactattcagatggaatatcaaccttgtcatgggccagactgccacctgaatgaaggggtgtctggccattcacatcatcaccattaa

SEQ ID NO: 1708 - protein, 313 aa, Escherichia coli
MAHSHSHASSHLPEDNNARRLLYAFGVTAGFMLVEVIGGFLSGSLALLADAGHMLTDTAALLFALLAVQFSRRPPTIRHTFGWLRLTTLAAFVNAIALVVITILIVWEAIERFRTPRPVEGGMMMAIAVAGLLANILSFWLLHHGSEEKNLNVRAAALHVLGDLLGSVGAIIAALIIIWTGWTPADPILSILVSLLVLRSAWRLLKDSVNELLEGAPVSLDIAELKRRLCREIPEVRNVHHVHVWMVGEKPVMTLHVQVIPPHDHDALLDQIQHYLMDHYQIEHATIQMEYQPCHGPDCHLNEGVSGHSHHHH

SEQ ID NO: 1709 - DNA, 381 bp, Escherichia coli
atgaaaatgacaaaactggccacactatttttgactgccactctaagccttgccagcggtgccgcactggctgccgatagcggagcgcaaagcaataacggccaggcaaacgccgcagctgatgcgggccaggtagcccctgacgcccgtgaaaatgtcgcgccaaataacgtcgacaataacggggtaaataccggttccgacggcacaatgctgcatccggatggttcttcaatgaacaatgacggcatgaccaaagatgaagagcacaagaacaccatgtgtaaagatggtcgctgcccggatatcaataaaaaggtacaaactggtgatggcatcaataatgatgtcgataccaaaaccgacggtaccacgcagtaa

SEQ ID NO: 1710 - protein, 126 aa, Escherichia coli
MKMTKLATLFLTATLSLASGAALAADSGAQSNNGQANAAADAGQVAPDARENVAPNNVDNNGVNTGSDGTMLHPDGSSMNNDGMTKDEEHKNTMCKDGRCPDINKKVQTGDGINNDVDTKTDGTTQ

SEQ ID NO: 1711 - DNA, 1053 bp, Escherichia coli
atgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataacagcttccagatcaacgacggtctgcgtattgcccgtaaattgctgcttgatattaacgacagcggtctgccagcggcgggtgagtttctcgatatgatcaccccacaatatctcgctgacctgatgagctggggcgcaattggtgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctttcagtgaccaaatggggtcattcggcgattgtgaataccagcggtaacggcgattgccatatcattctgcgcggtggtaaagagcctaactacagcgcgaagcacgttgctgaagtgaaagaagggctgaacaaagcaggcctgccagcacaggtgatgatcgatttcagccatgctaactcgtcgaaacaattcaaaaagcagatggatgtttgtgctgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgaatgcagtaaacgcgcgtcgcgggtaa

SEQ ID NO: 1712 - protein, 350 aa, Escherichia coli
MNYQNDDLRIKEIKELLPPVALLEKFPATENAANTVAHARKAIHKILKGNDDRLLVVIGPCSIHDPVAAKEYATRLLALREELKDELEIVMRVYFEKPRTTVGWKGLINDPHMDNSFQINDGLRIARKLLLDINDSGLPAAGEFLDMITPQYLADLMSWGAIGARTTESQVHRELASGLSCPVGFKNGTDGTIKVAIDAINAAGAPHCFLSVTKWGHSAIVNTSGNGDCHIILRGGKEPNYSAKHVAEVKEGLNKAGLPAQVMIDFSHANSSKQFKKQMDVCADVCQQIAGGEKAIIGVMVESHLVEGNQSLESGEPLAYGKSITDACIGWDDTDALLRQLANAVNARRG

SEQ ID NO: 1713 - DNA, 108 bp, Escherichia coli
ttgtcggatgcgccgtcagagtggcgtatccgattaatcaccggaggcctgataaaacgcgcagcgtcgcatcaggcaatgtgctccattggtagcaacgaaaaataa

SEQ ID NO: 1714 - protein, 35 aa, Escherichia coli
MSDAPSEWRIRLITGGLIKRAASHQAMCSIGSNEK

SEQ ID NO: 1715 - DNA, 753 bp, Escherichia coli
atggctgtaactaagctggttctggttcgtcatggcgaaagtcagtggaacaaagaaaaccgtttcaccggttggtacgacgtggatctgtctgagaaaggcgtaagcgaagcaaaagcagcaggtaagctgctgaaagaggaaggttacagctttgactttgcttacacctctgtgctgaaacgcgctattcataccctgtggaatgtgctggacgaactggatcaggcatggctgcccgttgagaaatcctggaaactgaacgaacgtcactacggtgcgttgcagggtctgaacaaagcggaaaccgctgaaaagtatggcgacgagcaggtgaaacagtggcgtcgtggttttgcggtgactccgccggaactgactaaagatgatgagcgttatccgggtcacgatccgcgttacgcgaaactgagcgagaaagaactgccgctgacggaaagcctggcgctgaccattgaccgcgtgatcccttactggaatgaaaccattctgccgcgtatgaagagcggtgagcgcgtcatcatcgccgcacacggtaactcgttacgtgcgctggtgaaatatctcgataacatgagcgaagaagagattcttgagctgaatatcccgaccggcgtgccgctggtttatgagtttgacgagaacttcaaaccgctgaaacgctattatctgggtaatgctgacgagatcgcggcgaaagcagcggcggttgctaaccagggtaaagcgaagtaa

SEQ ID NO: 1716 - protein, 250 aa, Escherichia coli
MAVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 1717 - DNA, 1041 bp, Escherichia coli
gtgctgaacgaaactcccgcactggcacccgatggtcagccgtaccgactgttaactttgcgtaacaacgcagggatggtagtcacgctgatggactggggtgcgactttactttccgcccgtattccgctttccgatggcagcgtccgcgaggcgctgcttggctgcgccagcccggaatgctatcaggatcaggccgcatttctgggggcctctattggtcgttatgccaaccgcatcgccaatagccgttatacctttgacggtgaaaccgtgacgctttcaccaagtcagggcgtcaaccaattgcatggcggcccggaagggttcgacaaacgtcgctggcagattgtgaaccagaacgatcgtcaggtgctgtttgccctgagttcagatgatggcgatcagggtttcccgggtaatctcggcgcgacggtgcaatatcgtctgaccgacgataaccgtatctccattacttatcgcgccacagttgataaaccttgcccggtgaatatgactaatcacgtctatttcaatcttgacggcgagcaatctgacgtgcgcaatcacaagttgcagattctggcggaagaatatctgccggttgatgaaggcggcattccgcacgacggcctgaaatctgtcgccggaacctcttttgatttccgcaacgccaaaatcatcgccagtgagtttcttgccgacgacgatcagcgcaaagtgaaaggttacgatcacgcgttcttgttacaggccaaaggcgatggcaagaaagtggcggcgcatgtctggtcagcagatgaaaaattgcagctgaaggtctacaccaccgctccggctctgcaattctactccggcaacttcctcggcggcacaccgtcgcggggaaccgaaccttacgccgactggcaagggctggctctggaaagcgaatttctgccggacagcccgaaccaccctgaatggccgcaaccggactgcttcctgcgtcctggcgaagagtattccagcctgacggaatatcagtttattgctcagtaa

SEQ ID NO: 1718 - protein, 346 aa, Escherichia coli
MLNETPALAPDGQPYRLLTLRNNAGMVVTLMDWGATLLSARIPLSDGSVREALLGCASPECYQDQAAFLGASIGRYANRIANSRYTFDGETVTLSPSQGVNQLHGGPEGFDKRRWQIVNQNDRQVLFALSSDDGDQGFPGNLGATVQYRLTDDNRISITYRATVDKPCPVNMTNHVYFNLDGEQSDVRNHKLQILAEEYLPVDEGGIPHDGLKSVAGTSFDFRNAKIIASEFLADDDQRKVKGYDHAFLLQAKGDGKKVAAHVWSADEKLQLKVYTTAPALQFYSGNFLGGTPSRGTEPYADWQGLALESEFLPDSPNHPEWPQPDCFLRPGEEYSSLTEYQFIAQ

SEQ ID NO: 1719 - DNA, 1149 bp, Escherichia coli
atgagtctgaaagaaaaaacacaatctctgtttgccaacgcatttggctaccctgccactcacaccattcaggcgcctggccgcgtgaatttgattggtgaacacaccgactacaacgacggtttcgttctgccctgcgcgattgattatcaaaccgtgatcagctgtgcgccacgcgatgaccgtaaagttcgcgtaatggcagccgattatgaaaatcagctcgacgagttttccctcgatgcgcccattgtcgcgcatgaaaactatcaatgggctaactacgttcgtggcgtggtgaaacatctgcaactgcgtaacaacagcttcggcggtgtggacatggtgatcagcggcaatgtgccgcagggtgcagggttaagttcttccgcttcactggaagtcgcggtcggaaccgtattgcagcagctttatcatctgccgctggacggcgcacaaatcgcgcttaatggtcaggaagcagaaaaccagtttgtaggctgtaactgtggaatcatggatcaactgatttccgcactcggcaagaaagatcatgccttgctgattgactgccgctcactggggaccaaagcagtttccatgcccaaaggtgtggctgtcgtcatcatcaacagtaacttcaaacgtaccctggttggcagcgaatacaacacccgtcgtgaacagtgcgaaaccggtgcgcgtttcttccagcagccagccctgcgcgatgtcaccattgaagagttcaacgctgttgcgcatgaactggacccaatcgtggcgaaacgcgtgcgtcatatcctgactgaaaacgcccgcaccgttgaagctgccagcgcactggagcaaggcgacctgaaacgtatgggcgagttgatggcggagtctcatgcctctatgcgcgatgatttcgaaatcaccgtaccgcaaattgacactctggtagaaatcgtcaaagctgtgattggcgacaaaggtggcgtacgcatgaccggcggcggatttggtggctgtatcgtcgcgttgttcccggaagagctggtgcctgccgtacagcaagctgtcgctgaacaatatgaagcaaaaacaggtattaaagagactttttacgtttgtaaaccatcacaaggagcaggacagtgctga

SEQ ID NO: 1720 - protein, 382 aa, Escherichia coli
MSLKEKTQSLFANAFGYPATHTIQAPGRVNLIGEHTDYNDGFVLPCAIDYQTVISCAPRDDRKVRVMAADYENQLDEFSLDAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALFPEELVPAVQQAVAEQYEAKTGIKETFYVCKPSQGAGQC

SEQ ID NO: 1721 - DNA, 1047 bp, Escherichia coli
atgacgcaatttaatcccgttgatcatccacatcgccgctacaacccgctcaccgggcaatggattctggtttcaccgcaccgcgctaagcgcccctggcagggggcgcaggaaacgccagccaaacaggtgttacctgcgcacgatccagattgcttcctctgcgcaggtaatgtgcgggtgacaggcgataaaaaccccgattacaccgggacttacgttttcactaatgactttgcggccttgatgtctgacacgccagatgcgccagaaagcaacgatccgctaatgcgttgccagagcgcgcgcggtaccagccgggtgatctgcttttcaccggatcacagtaaaacgttgccagaactgagcgttgcggcattgacggaaatcgtcaaaacctggcaggagcaaaccgcagagctgggggaaacgtacccatgggtgcaggtctttgaaaacaaaggcgcggcgatgggctgctctaacccgcatccgcacggacagatttgggcaaatagcttcctgcctaacgaagctgagcgcgaagaccgtctgcaaaaagaatatttcgccgcacagaaatcgccaatgctggtggactatgttcagcgcgagctggcagacggtagccgtaccgttgtcgaaaccgaacactggttagccgttgtaccttactgggctgcctggccgttcgaaacgctactgctgcccaaagcccacgttttgcggatcaccgatttgaccgacgcccagcgcagcgatttggcactggcgttgaaaaagctaaccagtcgttatgacaacctcttccagtgctccttcccctactctatgggctggcacggcgcgccatttaatggcgaagagaatcaacactggcagctgcacgcgcacttttatccgcctctgttgcgctccgccaccgtacgtaaatttatggttggttatgaaatgctggcagaaacccagcgagacctgaccgcagaacaggcagcagagcgtttgcgcgcagtcagcgatatccattttcgcgaatccggagtgtaa

SEQ ID NO: 1722 - protein, 348 aa, Escherichia coli
MTQFNPVDHPHRRYNPLTGQWILVSPHRAKRPWQGAQETPAKQVLPAHDPDCFLCAGNVRVTGDKNPDYTGTYVFTNDFAALMSDTPDAPESNDPLMRCQSARGTSRVICFSPDHSKTLPELSVAALTEIVKTWQEQTAELGETYPWVQVFENKGAAMGCSNPHPHGQIWANSFLPNEAEREDRLQKEYFAAQKSPMLVDYVQRELADGSRTVVETEHWLAVVPYWAAWPFETLLLPKAHVLRITDLTDAQRSDLALALKKLTSRYDNLFQCSFPYSMGWHGAPFNGEENQHWQLHAHFYPPLLRSATVRKFMVGYEMLAETQRDLTAEQAAERLRAVSDIHFRESGV

SEQ ID NO: 1723 - DNA, 1017 bp, Escherichia coli
atgagagttctggttaccggtggtagcggttacattggaagtcatacctgtgtgcaattactgcaaaacggtcatgatgtcatcattcttgataacctctgtaacagtaagcgcagcgtactgcctgttatcgagcgtttaggcggcaaacatccaacgtttgttgaaggcgatatccgtaacgaagcgttgatgaccgagatcctgcacgatcacgctatcgacaccgtgatccacttcgccgggctgaaagccgttggcgaatcggtacaaaaaccgcttgaatattacgacaacaatgtcaacggtactctgcgcctgattagcgccatgcgcgccgctaacgtcaaaaactttatctttagctcctccgccaccgtttatggcgatcagcccaaaattccatatgttgaaagcttcccgaccggcacaccgcaaagcccttacggcaaaagcaagctgatggtggaacagatcctcaccgatctgcaaaaagcccagccggactggagcattgccctgctgcgctacttcaacccagttggcgcgcatccgtcgggcgatatgggcgaagatccgcaaggcattccgaataacctgatgccatacatcgcccaggttgctgtaggccgtcgcgactcgctggcgatttttggtaacgattatccgaccgaagacggtactggcgtgcgcgattacatccacgtaatggatctggcggacggtcacgtcgtggcgatggaaaaactggcgaacaagccaggcgtacacatctacaacctcggcgctggcgtgggcagcagcgtgctggacgtggttaatgccttcagcaaagcctgcggcaaaccggttaattatcattttgcaccgcgtcgcgagggcgaccttccggcctactgggcggacgccagcaaagccaaccatgaactgaactggcgcgtaacgcgcacactcgatgaaatggcgcaggacacctggcactggcagtcacgccatccacagggatatcccgattaa

SEQ ID NO: 1724 - protein, 338 aa, Escherichia coli
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSSATVYGDQPKIPYVESFPTGTPQSPYGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGSSVLDVVNAFSKACGKPVNYHFAPRREGDLPAYWADASKANHELNWRVTRTLDEMAQDTWHWQSRHPQGYPD

SEQ ID NO: 1725 - DNA, 1473 bp, Escherichia coli
atgtcatcgttgcaaattttgcaaggcacgtttcgtcttggcgacacaaaaacgctgcaattgcctcggctaacgttaaacgcgggtgatagttgggcgtttgtcggttcgaatggaagcgggaaatcggcgctggcccgcgcgctgtcgggggaacttccgcttttgaaaggtgaacggcaaagccagttttcccacatcactcgtctctccttcgagcaattgcaaaagctcgtcagcgacgaatggcagcggaataacaccgatatgcttagtcctggcgaagatgacaccgggcgtaccacggctgagatcattcaggatgaagtaaaggatgctccgcgttgcatgcaactggcgcagcagttcggtattaccgccctcctcgaccgacgctttaaatacctttccactggcgagacgcgaaaaaccctgctgtgtcaggcgctgatgtcggagcctgacttgttgatccttgatgagccgttcgatggcctggatgttgcctcacgtcagcatctggctgagctactcgcctcgttacatcagtccggtattactctggtactggtgctcaatcgcttcgatgagatcccggaatttgtccagtttgctggcgtgctggcggattgcacgttagcggaaactggcgctaaagaagaactgctccaacaagcactcgttgcgcaactggcgcatagcgaactgcttgaaggtgtgcaaatgccggagccagatgaaccttcagcacgtcacgccttacccgccaacgaaccgcgcattgtgctgaacaatggcgtggtttcttataacgatcgccccattcttaataaccttagctggcaggtgaatccaggcgaacactggcaaattgtcgggccaaatggcgcgggaaaatcgacgttattaagcctgattactggcgatcatccgcaaggttacagcaacgatttgacgcttttcggacgacgtcgcggcagcggcgaaaccatctgggatatcaaaaagcatatcggttacgtcagcagtagtttgcatctggattaccgggtcagcactactgtgcgtaatgtgattctttctggctattttgattcgattggcatttatcaggccgtttcggatcgccagcaaaaactggtgcagcagtggctggatattctcggcattgataaacgcacggctgacgctcctttccatagtctttcctggggacagcagcgtctggcgctgatcgtccgtgcgctagtgaaacatccgacgttgcttattctcgatgaaccactacaggggcttgatccgctcaatcgccagcttatccgccgttttgttgatgtgctgattagcgaaggtaaaacgcaattgttgtttgtttcgcaccacgctgaagatgcgcctgcctgtattacccatcgtcttgagttcgtgccggacggtgacttttatcgctatgcgctgacaaaaataaactga

SEQ ID NO: 1726 - protein, 490 aa, Escherichia coli
MSSLQILQGTFRLGDTKTLQLPRLTLNAGDSWAFVGSNGSGKSALARALSGELPLLKGERQSQFSHITRLSFEQLQKLVSDEWQRNNTDMLSPGEDDTGRTTAEIIQDEVKDAPRCMQLAQQFGITALLDRRFKYLSTGETRKTLLCQALMSEPDLLILDEPFDGLDVASRQHLAELLASLHQSGITLVLVLNRFDEIPEFVQFAGVLADCTLAETGAKEELLQQALVAQLAHSELLEGVQMPEPDEPSARHALPANEPRIVLNNGVVSYNDRPILNNLSWQVNPGEHWQIVGPNGAGKSTLLSLITGDHPQGYSNDLTLFGRRRGSGETIWDIKKHIGYVSSSLHLDYRVSTTVRNVILSGYFDSIGIYQAVSDRQQKLVQQWLDILGIDKRTADAPFHSLSWGQQRLALIVRALVKHPTLLILDEPLQGLDPLNRQLIRRFVDVLISEGKTQLLFVSHHAEDAPACITHRLEFVPDGDFYRYALTKIN

SEQ ID NO: 1727 - DNA, 132 bp, Escherichia coli
ttgcgctttttatctgaaaaaaaagacgcggtttcatgcctggatgcgtcaaaccgttggccggataacacgtttacgccgcctccggcacggtcagcactaccgactcagtttatttttgtcagcgcatag

SEQ ID NO: 1728 - protein, 43 aa, Escherichia coli
MRFLSEKKDAVSCLDASNRWPDNTFTPPPARSALPTQFIFVSA

SEQ ID NO: 1729 - DNA, 789 bp, Escherichia coli
atgcaggccgaaatccttctcacccttaagctccaacaaaaattattcgccgacccgcgccgcatttcgctactaaaacacattgcgctttccggttccattagccagggagcgaaagatgccggtatcagctataaaagcgcctgggatgccattaacgagatgaatcagttaagtgagcatattctggttgagcgcgcaacaggcggtaaaggtggcggcggcgcagtactgacccgctatggtcagcgactgattcagctctatgacttactggcgcaaatacagcaaaaagcctttgatgtgttaagtgacgatgacgccctgccgctgaacagcctgctggccgcgatctcacgtttttcactgcaaaccagcgcccgtaaccagtggttcggtaccatcaccgcccgcgatcatgatgacgttcaacagcatgttgatgtcttactggctgatggaaaaacacgcctgaaagtcgcagttaccgcacaaagcggcgcgcgtctggggctggatgaaggcaaagaagtgttgatattgctaaaagcgccgtgggtaggtattactcaggacgatgcggtcgcgcaaaacgctgacaaccaattaccaggtattattagtcatattgagcgcggcgcagagcagtgcgaagtattaatggcgctacccgacgggcaaacactgtgcgccacagtgccggtaaatgaagcgacttctcttcagcaaggacagaatgtcacggcctactttaatgccgacagcgtgattatcgccacgctgtgctaa

SEQ ID NO: 1730 - protein, 262 aa, Escherichia coli
MQAEILLTLKLQQKLFADPRRISLLKHIALSGSISQGAKDAGISYKSAWDAINEMNQLSEHILVERATGGKGGGGAVLTRYGQRLIQLYDLLAQIQQKAFDVLSDDDALPLNSLLAAISRFSLQTSARNQWFGTITARDHDDVQQHVDVLLADGKTRLKVAVTAQSGARLGLDEGKEVLILLKAPWVGITQDDAVAQNADNQLPGIISHIERGAEQCEVLMALPDGQTLCATVPVNEATSLQQGQNVTAYFNADSVIIATLC

SEQ ID NO: 1731 - DNA, 150 bp, Escherichia coli
atgttagagttattaaaaagtctggtattcgccgtaatcatggtacctgtcgtgatggccatcatcctgggtctgatttacggtcttggtgaagtattcaacatcttttctggtgttggtaaaaaagaccagcccggacaaaatcattga

SEQ ID NO: 1732 - protein, 49 aa, Escherichia coli
MLELLKSLVFAVIMVPVVMAIILGLIYGLGEVFNIFSGVGKKDQPGQNH

SEQ ID NO: 1733 - DNA, 774 bp, Escherichia coli
atggctcgtaaatggttgaacttgtttaccggggcggcactctctttcgctgttgctggcaatgcactggcagatgaagggaaaatcacggtgttcgccgccgcatcactgactaacgcaatgcaggacattgctacgcagtataaaaaagagaaaggcgtggatgtggtttcttctttcgcttcgtcatctactttggcccgtcagattgaagcgggtgcgcctgcggatctatttatttctgccgatcagaaatggatggattatgcggttgataaaaaagcgatcgatacggcttcgcgccagacactgctcggcaatagcctggtcgttgtagcaccgaaagccagcgagcagaaagatttcaccatcgacagcaaaaccaactggacttcgctgctgaatggcggtcgcctcgcggttggtgatccggaacatgtccctgctggcatttatgcgaaagaagcactgcaaaaactgggcgcatgggatacgctctccccgaaactggctccggcggaagatgttcgtggcgcgctggcgttggtcgaacgcaatgaagcgccgctgggtattgtttacggttctgacgcagttgccagcaaaggggtaaaagtggttgccaccttcccggaagattcacataaaaaagtggaatatccggttgctgttgtggaagggcataacaatgcgacagtgaaagcattttatgattatctgaaggggccgcaggctgcggaaatctttaaacgttacggatttacaaccaagtaa

SEQ ID NO: 1734 - protein, 257 aa, Escherichia coli
MARKWLNLFTGAALSFAVAGNALADEGKITVFAAASLTNAMQDIATQYKKEKGVDVVSSFASSSTLARQIEAGAPADLFISADQKWMDYAVDKKAIDTASRQTLLGNSLVVVAPKASEQKDFTIDSKTNWTSLLNGGRLAVGDPEHVPAGIYAKEALQKLGAWDTLSPKLAPAEDVRGALALVERNEAPLGIVYGSDAVASKGVKVVATFPEDSHKKVEYPVAVVEGHNNATVKAFYDYLKGPQAAEIFKRYGFTTK

SEQ ID NO: 1735 - DNA, 690 bp, Escherichia coli
atgatactgaccgatccagaatggcaggcagttttattaagcctgaaagtttcttccctggctgtgctgtttagcctgccgtttgggatcttttttgcctggttactggtacgttgcacgtttccgggcaaagctctgctcgacagtgtactgcatctaccgctggtgttaccgcccgtggtcgtcggttacctattattagtttcgatgggacggcgcggatttatcggtgaacgtctgtatgactggtttggtctttctttcgcgtttagctggcgcggtgcggttctcgctgccgctgtcatgtcttttccgctgatggtgcgggcgattcgtctggcgctggaaagtgttgatatcaaactggagcaggccgcaagaacactgggggccgggcgctggcgcgttttctttactatcacgttaccgctgaccttaccgggaattattgttggtacggtgctggcattcgctcgttcgctcggtgaatttggcgcaaccatcacctttgtgtcgaacattcctggtgaaacgcgaaccattccttctgccatgtataccctgatccagacccctggcggggaaagtggcgcggcgagactgtgtattatttctattgcgctggcgatgatctccctgttgatttcagaatggctggccagaatcagccgtgaacgggcggggcgctaa

SEQ ID NO: 1736 - protein, 229 aa, Escherichia coli
MILTDPEWQAVLLSLKVSSLAVLFSLPFGIFFAWLLVRCTFPGKALLDSVLHLPLVLPPVVVGYLLLVSMGRRGFIGERLYDWFGLSFAFSWRGAVLAAAVMSFPLMVRAIRLALESVDIKLEQAARTLGAGRWRVFFTITLPLTLPGIIVGTVLAFARSLGEFGATITFVSNIPGETRTIPSAMYTLIQTPGGESGAARLCIISIALAMISLLISEWLARISRERAGR

SEQ ID NO: 1737 - DNA, 1059 bp, Escherichia coli
atgctggaactgaatttttcccagacgttgggcaaccattgcctgacgattaatgaaacgctgcccgccaatggcatcaccgctatttttggtgtctctggtgccggaaaaacctcgctgattaacgccatcagtgggctgacacgtccgcaaaaagggcggattgtcctcaatggtcgggtactaaatgatgccgaaaaaggtatctgcctgtcgccggaaaagcgtcgcgttggctatgtttttcaggatgcgcggctgttcccgcattacaaagtgcgtggcaatctgcgctacggcatggcgaaaagcatggtcaatcagttcgataagctggtggcgcttttaggcattgaaccgttgcttgatcgtttaccaggcagcctgtccggaggcgaaaaacagcgcgtggcgattggtcgggctttgctgacagcaccggaattgctgttgctggatgaaccgctggcgtcactggatattccgcgtaaacgcgaactgttgccttatctgcaacgtctgacgcgggaaatcaacattccgatgttgtatgtcagccattcgctggatgagatcctccatctggcagacagagtgatggtactggaaaacggtcaggtgaaagcctttggcgcgctggaggaagtgtggggcagtagcgtgatgaatccgtggctgccgaaagagcaacaaagtagcattctgaaagtgacggtgcttgagcatcatccgcattacgcgatgaccgcgctggcgctgggcgatcagcatttgtgggttaataagctggacgaaccgctgcaagctgcgctacgtatccgcattcaggcttccgatgtttctctggttttacaaccgccgcagcaaaccagcattcgtaacgtattgcgggcaaaagttgttaatagttatgacgacaacggccaggtggaagtggagctggaagtcggcggtaaaacgctgtgggcgcgtatcagcccgtgggccagggatgaactggcgatcaaacctggcctgtggctgtacgcgcaaattaaaagtgtgtcgataaccgcctga

SEQ ID NO: 1738 - protein, 352 aa, Escherichia coli
MLELNFSQTLGNHCLTINETLPANGITAIFGVSGAGKTSLINAISGLTRPQKGRIVLNGRVLNDAEKGICLSPEKRRVGYVFQDARLFPHYKVRGNLRYGMAKSMVNQFDKLVALLGIEPLLDRLPGSLSGGEKQRVAIGRALLTAPELLLLDEPLASLDIPRKRELLPYLQRLTREINIPMLYVSHSLDEILHLADRVMVLENGQVKAFGALEEVWGSSVMNPWLPKEQQSSILKVTVLEHHPHYAMTALALGDQHLWVNKLDEPLQAALRIRIQASDVSLVLQPPQQTSIRNVLRAKVVNSYDDNGQVEVELEVGGKTLWARISPWARDELAIKPGLWLYAQIKSVSITA

SEQ ID NO: 1739 - DNA, 921 bp, Escherichia coli
ttggcggtgaatgctgaattaaaacgcagaattttgtccgatagtggtatcggtgtaccattcgcgcagaagaaaattcttaaccttaatctggaatacgccatgaccacacgcgtgattgctctcgacttagacggcaccttattgaccccgaaaaagaccctgcttccttcatcgatagaagccctggcccgcgctcgcgaagcaggctatcaattaatcatcgtcacaggtcgccatcacgtcgctattcatcctttttatcaggcgctggcgctggatacacctgctatttgctgtaatggcacctatttgtatgattatcatgcaaaaacagtgctggaagcggacccaatgcccgttaataaagccctgcaactcattgagatgctgaatgaacaccacattcacggtctgatgtatgtggatgatgcgatggtctatgagcacccgaccgggcatgtcattcgcacgtctaactgggcgcaaaccctgccgccggaacagcgtccgactttcacacaagtcgcttctctggctgaaacggcgcaacaagttaacgccgtatggaagttcgccctgacgcacgatgacctgccgcaattgcagcattttggtaagcatgtcgaacatgaactgggacttgagtgtgaatggtcctggcacgatcaggttgatattgcacgcggcggcaacagcaaaggtaaacgtttgacgaaatgggttgaggcgcaaggctggtcgatggaaaacgtcgtggccttcggcgataactttaatgatatcagtatgctggaggccgctggtacaggcgtggcgatgggcaacgccgatgacgcggtaaaagcgcgcgccaacattgtgattggtgataacaccaccgacagcattgcccagttcatttatagccacctgatttaa

SEQ ID NO: 1740 - protein, 306 aa, Escherichia coli
MAVNAELKRRILSDSGIGVPFAQKKILNLNLEYAMTTRVIALDLDGTLLTPKKTLLPSSIEALARAREAGYQLIIVTGRHHVAIHPFYQALALDTPAICCNGTYLYDYHAKTVLEADPMPVNKALQLIEMLNEHHIHGLMYVDDAMVYEHPTGHVIRTSNWAQTLPPEQRPTFTQVASLAETAQQVNAVWKFALTHDDLPQLQHFGKHVEHELGLECEWSWHDQVDIARGGNSKGKRLTKWVEAQGWSMENVVAFGDNFNDISMLEAAGTGVAMGNADDAVKARANIVIGDNTTDSIAQFIYSHLI

SEQ ID NO: 1741 - DNA, 996 bp, Escherichia coli
atgaagcaaacagtttatatcgccagccctgagagccagcaaattcacgtctggaacctgaatcatgaaggcgcactgacgctgacacaggtagtcgatgtgccggggcaggtgcagccgatggtggtcagcccggacaaacgctatctctatgttggtgttcgccctgagtttcgcgtcctggcgtatcgtatcgccccggacgatggcgcgctgacctttgctgcagagtctgcgctgccggggagcccgacgcatatttccaccgatcacctggggcagtttgtctttgtcggttcttataatgcgggtaacgtgagcgtaacgcgtctggaagatggcctgccagtgggcgtcgtcgatgtggtcgaggggctggacggttgccattccgccaatatctcaccggacaaccgtacgttgtgggttccggcattaaagcaggatcgcatttgcctgtttacggtcagcgatgatggtcatctggtagcgcaggaccctgcggaagtgactaccgttgaaggggccggcccgcgtcatatggtattccatccaaacgaacaatatgcctattgcgtcaatgagttaaacagctcagtggatgtctgggaactgaaagatccgcacggcaatatcgaatgtgtccagacgctggatatgatgccggaaaacttctccgacacccgttgggcggctgatattcatatcaccccggatggtcgtcatttatacgcctgcgaccgtaccgccagtctgattaccgttttcagcgtttcggaagatggcagcgtgttgagtaaagaaggcttccagccaacggaaacccagccgcgcggcttcaatgttgatcacagcggcaagtatctgattgccgccgggcaaaaatctcaccacatctcggtatacgaaattgttggcgagcaggggctactgcatgaaaaaggccgctatgcggttgggcaggggccaatgtgggtagtggtcaacgcgcactaa

SEQ ID NO: 1742 - protein, 331 aa, Escherichia coli
MKQTVYIASPESQQIHVWNLNHEGALTLTQVVDVPGQVQPMVVSPDKRYLYVGVRPEFRVLAYRIAPDDGALTFAAESALPGSPTHISTDHLGQFVFVGSYNAGNVSVTRLEDGLPVGVVDVVEGLDGCHSANISPDNRTLWVPALKQDRICLFTVSDDGHLVAQDPAEVTTVEGAGPRHMVFHPNEQYAYCVNELNSSVDVWELKDPHGNIECVQTLDMMPENFSDTRWAADIHITPDGRHLYACDRTASLITVFSVSEDGSVLSKEGFQPTETQPRGFNVDHSGKYLIAAGQKSHHISVYEIVGEQGLLHEKGRYAVGQGPMWVVVNAH

SEQ ID NO: 1743 - DNA, 954 bp, Escherichia coli
atgaagcatgaattatcaagtatgaaggcatttgtcatactggcagagtccagttcatttaacaatgctgctaaattactcaatattacgcaacctgcattaacgcgaagaataaaaaagatggaggaagatttacacattcaactatttgagcgtacaactcgcaaggttacgttaacaaaagcaggaaaaaggttgctcccggaggcgcgggaattaataaaaaaattcgatgaaacgctttttaatattcgtgatatgaatgcttatcatcgtggtatggtgacgttagcgtgtattccgaccgcagtattttattttttaccgctggcaatcggtaaatttaatgagctgtatcccaatattaaagtgcggattctggaacaaggcacgaataattgcatggaatcggtgctgtgtaacgaatcagactttggcataaacatgaacaacgtcacaaattcatccattgattttaccccactggtcaacgagccgttcgtgctggcctgtcggcgtgaccatccattggccaaaaagcagcttgtagaatggcaggagttagtgggttacaaaatgattggcgtacgctcctccagcggcaaccgactattgatagaacaacagctagccgacaagccctggaagctggactggttttacgaagtgcgtcatctttcgacgtcattagggctggtggaggcgggactggggatttcggcgcttcctggtctggcaatgccccatgcgccctattcttcgattattggtatcccactggtggaacccgttatacgtcggacattggggattattcgccgcaaagatgccgtgctttctccggcagctgaacgcttttttgccttgctgattaatttgtggactgacgataaagacaatttgtggaccaatatcgtcgaacgccagagacatgcgttacaggagataggttaa

SEQ ID NO: 1744 - protein, 317 aa, Escherichia coli
MKHELSSMKAFVILAESSSFNNAAKLLNITQPALTRRIKKMEEDLHIQLFERTTRKVTLTKAGKRLLPEARELIKKFDETLFNIRDMNAYHRGMVTLACIPTAVFYFLPLAIGKFNELYPNIKVRILEQGTNNCMESVLCNESDFGINMNNVTNSSIDFTPLVNEPFVLACRRDHPLAKKQLVEWQELVGYKMIGVRSSSGNRLLIEQQLADKPWKLDWFYEVRHLSTSLGLVEAGLGISALPGLAMPHAPYSSIIGIPLVEPVIRRTLGIIRRKDAVLSPAAERFFALLINLWTDDKDNLWTNIVERQRHALQEIG

SEQ ID NO: 1745 - DNA, 1053 bp, Escherichia coli
atgaaaaaaataccctgcgtgatgatgcgaggtggaacctcgaggggcgcgttcctgttagcggaacatttacccgaagatcaaacgcagcgcgataaaatattgatggcaattatgggttccggtaacgatctggaaattgacggtattggcggcggtaatccgctgaccagtaaagtcgccattattagccgctccagcgatccgcatgcagatgtcgattatctgtttgctcaagttatcgtccatgagcaacgtgtcgataccacgcctaactgcggcaatatgctgtctggcgttggggcattcgccattgaaaatggtttgattgcagcgacttcgccagttacccgcgtacgtatccgcaacgtcaatacgggtacgttcatcgaagctgatgtgcaaacgccaaatggtgttgtcgagtacgagggtagcgccagaattgacggcgtaccgggtactgccgcaccggttgcgctcactttcctgaatgccgccggaacgaaaaccggaaaagtcttcccgactgataatcagattgattattttgacgatgtcccggtgacctgtatcgatatggcgatgccagttgtcattattcctgctgaatatctgggaaaaacaggctatgaattaccggcagagctggatgccgacaaagcattattagcccgcattgaatctatccgtctacaagcgggtaaagcaatgggcttaggcgatgtcagtaatatggttatccctaaacctgtacttatttctccagcgcagaaaggcggggcaattaatgtgcgttattttatgccgcattcttgccatcgcgctttggcgataaccggtgctattgctatttccagtagttgtgcattggaaggtaccgtcacccgacaaatcgtcccttctgtaggatacggcaatatcaatattgaacaccccagtggtgcgctcgacgttcatttaagtaatgaaggtcaggatgccacgacgttacgcgcatctgttattcggacgaccagaaaaatattttccggtgaagtttatcttccctga

SEQ ID NO: 1746 - protein, 350 aa, Escherichia coli
MKKIPCVMMRGGTSRGAFLLAEHLPEDQTQRDKILMAIMGSGNDLEIDGIGGGNPLTSKVAIISRSSDPHADVDYLFAQVIVHEQRVDTTPNCGNMLSGVGAFAIENGLIAATSPVTRVRIRNVNTGTFIEADVQTPNGVVEYEGSARIDGVPGTAAPVALTFLNAAGTKTGKVFPTDNQIDYFDDVPVTCIDMAMPVVIIPAEYLGKTGYELPAELDADKALLARIESIRLQAGKAMGLGDVSNMVIPKPVLISPAQKGGAINVRYFMPHSCHRALAITGAIAISSSCALEGTVTRQIVPSVGYGNINIEHPSGALDVHLSNEGQDATTLRASVIRTTRKIFSGEVYLP

SEQ ID NO: 1747 - DNA, 1434 bp, Escherichia coli
atgaataaaaaatcgttatggaagctaattctgatattagcgatcccatgtattattggctttatgccagctccggcaggattaagcgaactggcgtgggtgctttttggtatttacctggcggccattgtggggctggttatcaagcctttcccggaacctgtcgtactgttaattgccgtcgccgcatcgatggtcgtggtgggtaacttatcaggtggggaatttaaaaccaccgccgtattaagcggttactcttccggtaccacctggctggtgttttctgcgtttactttaagcgccgcgtttgtaaccacaggcttaggtaaacgtattgcctatctgctgattggtaaaattggtagcactaccctgggtctgggttacgttacggtatttctcgatctggtactggctccggcaacaccgtctaacaccgcgcgtgcgggcggcatcgtgttaccgatcatcaacagcgtggcagtggctttgggatcagaaccggaaaaaagtccgcgtcgtgttggacattacctgatgatgtccatttacatggtcaccaaaaccaccagctatatgttctttaccgcaatggcggggaacattctggcgctgaaaatgatcaacgacattctgcacctgcaaattagctggggtggatgggcgttagccgccggattgccgggcatcattatgctgctggtcaccccgctggtgatttacaccatgtatccaccagaaattaagaaggtggataacaaaaccatcgctaaagcgggccttgccgaactgggaccgatgaaaatccgcgaaaaaatgctgctcggtgtctttgtactggcgctgctgggctggattttcagtaagtctctgggggttgatgaatccaccgtggcaatcgttgttatggcaactatgctgctgctgggcatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcatcatcgtgcgttatttcttcgcttctggtagtgcctatatcgttgccatgttaccggtatttgccatgctggcgaacgtctccggcgcaccgttaatgttaaccgcgctggcactgttgttctctaactcctatggcggcatggttactcactatggcggcgcggcaggtccggtcatctttggcgtgggttacaacgatattaaatcctggtggttggtcggtgcggtactgacgatattaaccttcctggtgcatatcaccctcggcgtgtggtggtggaatatgctgatcggctggaacatgctgtaa

SEQ ID NO: 1748 - protein, 477 aa, Escherichia coli
MNKKSLWKLILILAIPCIIGFMPAPAGLSELAWVLFGIYLAAIVGLVIKPFPEPVVLLIAVAASMVVVGNLSGGEFKTTAVLSGYSSGTTWLVFSAFTLSAAFVTTGLGKRIAYLLIGKIGSTTLGLGYVTVFLDLVLAPATPSNTARAGGIVLPIINSVAVALGSEPEKSPRRVGHYLMMSIYMVTKTTSYMFFTAMAGNILALKMINDILHLQISWGGWALAAGLPGIIMLLVTPLVIYTMYPPEIKKVDNKTIAKAGLAELGPMKIREKMLLGVFVLALLGWIFSKSLGVDESTVAIVVMATMLLLGIVTWEDVVKNKGGWNTLIWYGGIIGLSSLLSKVKFFEWLAEVFKNNLAFDGHGNVAFFVIIFLSIIVRYFFASGSAYIVAMLPVFAMLANVSGAPLMLTALALLFSNSYGGMVTHYGGAAGPVIFGVGYNDIKSWWLVGAVLTILTFLVHITLGVWWWNMLIGWNML

SEQ ID NO: 1749 - DNA, 2262 bp, Escherichia coli
atgatcaagttatctgaaaaaggcgtgtttctcgccagcaataacgaaataattgccgaagaacatttcaccggcgaaataaaaaaagaagaagcaaaaaaaggcactattgcctggtctattctctcttctcataatacgtccggaaatatggataaacttaaaattaagtttgattcattagcctctcacgatattacctttgttggtattgtacagaccgctaaagcgtccggtatggaacgtttcccgctgccgtatgtgctgaccaactgccataactcactctgtgctgtgggcggcaccattaacggtgatgaccatgtttttggtttatcggcggcccagcgttatggcggtatttttgtgccaccgcatattgcggtcatccatcaatatatgcgtgaaatgatggcgggcggcggcaaaatgatcctcggatcagacagccatacccgttacggtgcgttagggacaatggcggttggcgagggcggcggcgagttggtaaaacagctgcttaatgacacctgggatatcgactatccgggcgtggttgcggtgcatctgaccggaaaacctgcgccgtatgtggggccgcaggatgtggcgctggctatcatcggtgccgtgttcaaaaacggttacgtcaaaaacaaagtgatggagttcgtaggtcccggtgttgcagcgctctctaccgatttccgtaacagcgttgacgtgatgaccactgaaacgacctgtttaagttctgtctggcaaaccgatgaagaagtccataactggctggcgctgcacggtcgcggccaggattactgccaacttaaccctcaaccaatggcgtactacgatggcagcatcagcgttgatttaagcgccatcaaaccaatgattgcgctgccattccacccgagcaacgtgtatgaaatcgacacgctgaaccagaatctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactacgaaaacgtcatcgcggcggcgaatgcgctgcgcggtcaatcctgcggcaacgataccttctcgttggcggtttacccgtcatcacagccggtgtttatggatctcgccaaaaaaggtgtggtagcagatttgattggcgcaggcgcaatcatcagaaccgcgttctgcggcccatgctttggtgcgggcgatacgccaatcaacaacggtttgagtattcgccacaccacgcgtaacttcccgaaccgcgaaggctctaagccagctaatgggcagatgtcagcggtggcgttgatggacgctcgttctatcgctgcgactgcggcaaacggtggctatttaacctctgccagcgaactcgattgctgggacaacgtgccggagtacgccttcgatgtaacgccgtataaaaatcgcgtctatcaaggctttgtgaaaggggcgacccagcaaccgctgatctacggaccgaacatcaaagactggccggaattgggcgcgctgactgacaatatcgtcctcaaagtgtgctcgaagatcctcgacgaagtaaccaccaccgacgaactgattccttccggtgaaacctcttcttatcgttcaaatccgattggtctggcggagtttaccctgtcacgccgcgatccaggttatgttggcagaagtaaagcgactgctgagctggaaaatcagcgtctggcgggaaatgtcagtgagctggcagatatgtttgcgcgcattaagcagattgctggtcaggaacatgttgatccgctgcaaactgaaattggcagcatggtttatgcggtgaaaccaggcgatggttctgcgcgtgaacaggcggcgagttgtcagcgtgtgattggcggtctggcgaatattgccgaggagtacgcgactaaacgctatcgttctaacgtcatcaactgggggatgttaccgctgcagatggcggaagtaccgaactttgacgtaggtgattacatttatatccctggcattaaagcggcgctggataatcctggaacgacgtttaaaggttatgtgatccatgaagatgcaccggtaacggagattacgctctatatggaaagtctgactgctgaagagcgcgagattatcaaggcgggtagtttgattaacttcaataaaaaccgtcagatgtaa

SEQ ID NO: 1750 - protein, 753 aa, Escherichia coli
MIKLSEKGVFLASNNEIIAEEHFTGEIKKEEAKKGTIAWSILSSHNTSGNMDKLKIKFDSLASHDITFVGIVQTAKASGMERFPLPYVLTNCHNSLCAVGGTINGDDHVFGLSAAQRYGGIFVPPHIAVIHQYMREMMAGGGKMILGSDSHTRYGALGTMAVGEGGGELVKQLLNDTWDIDYPGVVAVHLTGKPAPYVGPQDVALAIIGAVFKNGYVKNKVMEFVGPGVAALSTDFRNSVDVMTTETTCLSSVWQTDEEVHNWLALHGRGQDYCQLNPQPMAYYDGSISVDLSAIKPMIALPFHPSNVYEIDTLNQNLTDILREIEIESERVAHGKAKLSLLDKVENGRLKVQQGIIAGCSGGNYENVIAAANALRGQSCGNDTFSLAVYPSSQPVFMDLAKKGVVADLIGAGAIIRTAFCGPCFGAGDTPINNGLSIRHTTRNFPNREGSKPANGQMSAVALMDARSIAATAANGGYLTSASELDCWDNVPEYAFDVTPYKNRVYQGFVKGATQQPLIYGPNIKDWPELGALTDNIVLKVCSKILDEVTTTDELIPSGETSSYRSNPIGLAEFTLSRRDPGYVGRSKATAELENQRLAGNVSELADMFARIKQIAGQEHVDPLQTEIGSMVYAVKPGDGSAREQAASCQRVIGGLANIAEEYATKRYRSNVINWGMLPLQMAEVPNFDVGDYIYIPGIKAALDNPGTTFKGYVIHEDAPVTEITLYMESLTAEEREIIKAGSLINFNKNRQM

SEQ ID NO: 1751 - DNA, 1284 bp, Escherichia coli
gtgaacacattttcagtttcccgtctggcgctggcattggcttttggcgtgacgctgaccgcctgtagctcaacaccgcccgatcaacgtccttctgatcaaaccgcgcctggtacctcttcgcgcccgattctgtcggcaaaagaagcgcagaatttcgatgctcaacactattttgcatccctgacaccaggtgcggcagcgtggaatccttccccgattaccctgcctgcgcaacctgactttgttgtcggcccggcgggtactcaaggtgtaacgcataccacgattcaggcggcggtagatgcggcaattatcaagcgtaccaacaagcgccagtatattgccgtgatgcctggtgagtatcagggaacggtgtatgtccctgccgctccgggtggaattactctgtacggtacaggtgaaaaaccgattgatgtgaagattgggctttcccttgatggtggcatgagccctgccgactggcgtcacgacgtcaacccgcgcggcaaatatatgccaggtaaaccggcgtggtatatgtacgatagctgccagagtaaacgcagcgacagtatcggtgttctctgctctgcggtcttctggtcacaaaacaatggcctgcaactgcaaaacctgaccatcgaaaacacgctgggcgatagcgtagatgcgggtaaccatccggcggtggcactgcgtactgatggcgacaaagtgcagatcaataacgtcaacattctcggtcgtcagaacaccttctttgtcaccaacagcggtgtgcagaaccgtctggaaacgaatcgccagccgcgtacgctggtgaccaacagctatattgaaggggatgtggatatcgtttctggtcgcggcgcagtggtgttcgataacaccgaattccgcgtggtgaactcccgtacccagcaagaagcgtatgtgtttgcaccggctacgctgtccaacatttactacggtttcctcgccgtaaacagccgtttcaatgcttccggtgatggcgtggcgcaactgggccgctcgctggatgttgatgccaataccaacggtcaggtagtgatccgtgatagcgccatcaacgaaggttttaacacagccaaaccgtgggctgatgcggtgatctctaatcgtccgtttgcgggtaacaccggcagcgttgatgataacgacgaagtacagcgcaatctgaatgacactaactacaaccgcatgtgggaatacaataaccgcggcgtgggtagcaaagtggttgcagaggcgaagaagtag

SEQ ID NO: 1752 - protein, 427 aa, Escherichia coli
MNTFSVSRLALALAFGVTLTACSSTPPDQRPSDQTAPGTSSRPILSAKEAQNFDAQHYFASLTPGAAAWNPSPITLPAQPDFVVGPAGTQGVTHTTIQAAVDAAIIKRTNKRQYIAVMPGEYQGTVYVPAAPGGITLYGTGEKPIDVKIGLSLDGGMSPADWRHDVNPRGKYMPGKPAWYMYDSCQSKRSDSIGVLCSAVFWSQNNGLQLQNLTIENTLGDSVDAGNHPAVALRTDGDKVQINNVNILGRQNTFFVTNSGVQNRLETNRQPRTLVTNSYIEGDVDIVSGRGAVVFDNTEFRVVNSRTQQEAYVFAPATLSNIYYGFLAVNSRFNASGDGVAQLGRSLDVDANTNGQVVIRDSAINEGFNTAKPWADAVISNRPFAGNTGSVDDNDEVQRNLNDTNYNRMWEYNNRGVGSKVVAEAKK

SEQ ID NO: 1753 - DNA, 477 bp, Escherichia coli
atgaaactcatcagtaacgatctgcgcgatggcgataagctgccgcatcgtcatgtctttaacggcatgggttacgatggcgataatatttcaccgcatctggcgtgggatgatgttcctgtgggaacgaaaagttttgttgtcacctgctatgacccggatgcgccaaccggctccggctggtggcactgggtagttgttaatttacccgctgatacccgcgtattaccgcaagggtttggctctggtctggtagctatgccagacggcgttttgcagacgcgtaccgactttggtaaaaccgggtacgatggcgcagcgccgccgaaaggcgaaacccatcgctacatttttaccgttcacgcgctggatgtagaacgtattgatgtcgatgaaggtgccagcggcgcgatggtcgggtttaacgttcattttcactctctggcgagtgcctcgattactgcgatgtttagttaa

SEQ ID NO: 1754 - protein, 158 aa, Escherichia coli
MKLISNDLRDGDKLPHRHVFNGMGYDGDNISPHLAWDDVPVGTKSFVVTCYDPDAPTGSGWWHWVVVNLPADTRVLPQGFGSGLVAMPDGVLQTRTDFGKTGYDGAAPPKGETHRYIFTVHALDVERIDVDEGASGAMVGFNVHFHSLASASITAMFS

SEQ ID NO: 1755 - DNA, 1401 bp, Escherichia coli
atgtccagcgtgggcggtgagccatggggcttctccaaaacgtgttttttgttgttaattcggtgtagactcgtaaacctaaatcttttcaatttggtttacaagtcgattatgacaacggacgatcttgcctttgaccaacgccatatctggcacccatacacatccatgacctccccgctgccggtttatccggtggcaagcgccgaaggttgcgagctaattttgtctgacggcaggcgcctggttgacggtatgtcgtcctggtgggcggcgatccacggttacaatcacccgcagcttaatgcggcgatgaagtcgcaaattgatgctatgtcgcatgtgatgtttggcggtatcacccatgcgcccgccattgagctgtgccgcaaattggtggcaatgacgccgcaaccgctggagtgcgtttttctcgcggactccggctccgtagcggtagaagtggcgatgaaaatggcgttgcagtactggcaggccaaaggcgaagcgcgccagcgttttctaaccttccgcaatggttatcatggcgatacctttggcgcgatgtcggtgtgcgatccggacaactcaatgcacagcctgtggaaaggctatctgccagaaaacctgtttgctcccgccccgcaaagccgcatggatggcgaatgggatgagcgcgatatggtgggctttgcccgcctgatggcagcgcatcgtcatgaaatcgcggcggtgatcattgaaccgattgtccagggcgcaggcgggatgcgcatgtaccatccggaatggttaaaacgaatccgcaaaatgtgcgatcgcgaaggtatcttgctgattgccgacgagatcgccaccggatttggtcgtaccggcaaactgtttgcctgtgaacatgcagaaatcgcgccggatattttgtgtctcggtaaagccttaaccggcggcacaatgaccctttccgccacgctcaccacgcgcgaggttgcggaaaccatcagtaacggcgaagccggctgctttatgcatgggccaacttttatgggcaatccgctggcctgcgcagcagcaaacgccagcctggcgattcttgaatctggcgactggcagcatcaggtggcggctattgaagcgcagctacgcgagcaacttgcccccgcctgtgacgccgaaatggttgccgatgtgcgcgtactgggggcaatcggcgtggtcgaaaccactcgtccggtgaatatggcagcgctgcaaaaattctttgtcgaacagggtgtctggatccggccttttggcaaactgatttacctgatgccgccctatattattctcccgcaacagttgcagcgtctgaccgcagcggttaaccgtgcggtgcaggatgaaacatttttttgccaataa

SEQ ID NO: 1756 - protein, 466 aa, Escherichia coli
MSSVGGEPWGFSKTCFLLLIRCRLVNLNLFNLVYKSIMTTDDLAFDQRHIWHPYTSMTSPLPVYPVASAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKMCDREGILLIADEIATGFGRTGKLFACEHAEIAPDILCLGKALTGGTMTLSATLTTREVAETISNGEAGCFMHGPTFMGNPLACAAANASLAILESGDWQHQVAAIEAQLREQLAPACDAEMVADVRVLGAIGVVETTRPVNMAALQKFFVEQGVWIRPFGKLIYLMPPYIILPQQLQRLTAAVNRAVQDETFFCQ

SEQ ID NO: 1757 - DNA, 1041 bp, Escherichia coli
atggctcaccgcccacgctggacattgtcgcaagtcacagaattatttgaaaaaccgttgctggatctgctgtttgaagcgcagcaggtgcatcgtcagcatttcgatcctcgtcaggtgcaggtcagcactttgctgtcgattaagaccggagcttgtccggaagattgcaaatattgcccgcaaagctcgcgctacaaaaccgggctggaagccgagcggttgatggaagttgaacaggtgctggagtcggcgcgcaaagcgaaagcggcgggatcgacgcgtttctgtatgggcgcggcgtggaagaatccccacgaacgcgatatgccgtacctggaacaaatggtgcagggggtaaaagcgatgggtctggaggcgtgtatgacgctgggcacgttgagtgaatctcaagcgcagcgcctggcgaatgccgggctggattactataaccacaacctcgacacctcgccggagttttacggcaatatcatcaccacccgcacctatcaggaacgtctcgatacgctggaaaaagtgcgagaagctgggattaaagtctgttcaggtggcattgtgggcttaggcgaaacggtgaaagatcgcgccggattattactgcaactggcaaacctgccgacgccgccggaaagcgtgccaatcaacatgctggtgaaggtgaaaggcacaccgctggcggataacgatgatgtcgatgcctttgattttattcgcaccattgccgtagcgcggatcatgatgccgacctcttacgtacgcctttctgccggacgcgagcagatgaacgaacagactcaggcgatgtgctttatggctggcgcaaactcgattttctacggttgcaaactgctgactacgccgaatccggaagaagataaagacctgcaactgttccgcaaactggggctaaatccgcagcaaactgccgtgctggcgggcgataacgaacaacagcagcgtctggagcaggcgctgatgaccccggacactgacgaatattacaacgcggcagcactatga

SEQ ID NO: 1758 - protein, 346 aa, Escherichia coli
MAHRPRWTLSQVTELFEKPLLDLLFEAQQVHRQHFDPRQVQVSTLLSIKTGACPEDCKYCPQSSRYKTGLEAERLMEVEQVLESARKAKAAGSTRFCMGAAWKNPHERDMPYLEQMVQGVKAMGLEACMTLGTLSESQAQRLANAGLDYYNHNLDTSPEFYGNIITTRTYQERLDTLEKVREAGIKVCSGGIVGLGETVKDRAGLLLQLANLPTPPESVPINMLVKVKGTPLADNDDVDAFDFIRTIAVARIMMPTSYVRLSAGREQMNEQTQAMCFMAGANSIFYGCKLLTTPNPEEDKDLQLFRKLGLNPQQTAVLAGDNEQQQRLEQALMTPDTDEYYNAAAL

SEQ ID NO: 1759 - DNA, 1155 bp, Escherichia coli
atgatctggcaggagaaaatcgacgcggcgcttgatgcgcggcgtgttgctgatgccttgcgtcgccgttatccggtggcacaaggagccggacgctggctggtggcagatgattgccagtatctgaacttttccagtaacgattatttaggtttaagccatcatccgcaaattatccgcgcctggcagcagggcgcggatcaatttggtgtcggtagcggcggttccggtcacgtcagcggttatagcgtggcgcaccaggtgctggaagaagaactggccgaatggctgggctattcgcgggcgctgctgtttatttctggttttgccgctaatcaggctgtcattgccgcgatgatggcgaaagaggaccgtattgttgccgaccggcttagccatgcctcattgctggaggctgcaagtttaagcccgtcgccgcttcgccgttttgctcataacgatgtcactcatctggcgcgactgcttgcttccccctgtccggggcagcaactggtagtgacagaaggtgtgttcagcatggacggcgatagtgcgccactggaggaaatccagcaggtaacgcaacagcacgatggctggttgatggtcgatgacgcccacggcacgggcgttatcggggagcaggggcgtggcagctgctggctgcaaaaggtaaaaccagaattgctggtggtgacgtttggcaaaggatttggcgtcagcggggcagcggtgctttgctccaatacggtggcggattatctgctgcaattcgctcgccatcttatctacagcaccagtatgccgcccgctcaggcgcaggcattacgtgcgtcgctggcggtcattcgcagtgatgagggggatgcacggcgcgaaaaactggcggcactcattacgcgttttcgtgccggagtgcaggatttgccgtttacgcttgctggctcatgcagcgccatccagccattgatcgtcggtgataacagccgtgcgttacaactggcagaaaaactgcgccagcaaggctgctgggtcacggcgattcgcccgccaaccgtacccgctggtactgcgcgactgcgcttaacgctaaccgcagcgcatgaaatgcaggatatcgaccgtctgctggaggtgctgcatggcaacggttaa

SEQ ID NO: 1760 - protein, 384 aa, Escherichia coli
MIWQEKIDAALDARRVADALRRRYPVAQGAGRWLVADDCQYLNFSSNDYLGLSHHPQIIRAWQQGADQFGVGSGGSGHVSGYSVAHQVLEEELAEWLGYSRALLFISGFAANQAVIAAMMAKEDRIVADRLSHASLLEAASLSPSPLRRFAHNDVTHLARLLASPCPGQQLVVTEGVFSMDGDSAPLEEIQQVTQQHDGWLMVDDAHGTGVIGEQGRGSCWLQKVKPELLVVTFGKGFGVSGAAVLCSNTVADYLLQFARHLIYSTSMPPAQAQALRASLAVIRSDEGDARREKLAALITRFRAGVQDLPFTLAGSCSAIQPLIVGDNSRALQLAEKLRQQGCWVTAIRPPTVPAGTARLRLTLTAAHEMQDIDRLLEVLHGNG

SEQ ID NO: 1761 - DNA, 756 bp, Escherichia coli
atggcaacggttaataaacaagccattgctgcggcatttggacgggcagccgcacactatgagcaacacgccgatctacagcgccagagtgctgacgccttactggcaatgctcccacagcgtaaatacacccgcgtactggatgcgggttgtggaccaggctggatgagccgccgctggcgagagcgtcacgcgcaggtgactgcgttagatctctctccgccaatgcttgttcaggcacgccagaaggatgccgcagaccattatctggcgggagatatcgaatccctgccgttagcgactgcgacgttcgatcttgcatggagcaatctcgcggtgcagtggtgcggtaatttatccacggcactccgcgagctgtatcgggtggtgcgccccggaggcgtggtcgcgtttaccacgctggtgcagggatcgttacccgaactgcatcaggcgtggcaggcggtggacgagcgtccgcatgctaatcgctttttaccgccagatgaaatcgaacagtcgctaaacgccgtgcattatcaacattatattcagcccatcacgctgtggtttgatgatgcgctcagtgccatgcgttcgctgaaaggcatcggtgccacgcatcttcatgaagggcgtgacccgcgaatattaacgcgttcgcagttgcagcgattgcaactggcctggccgcaacaacaggggcgatatcctctgacgtatcatctttttttgggagtgattgctcgtgagtaa

SEQ ID NO: 1762 - protein, 251 aa, Escherichia coli
MATVNKQAIAAAFGRAAAHYEQHADLQRQSADALLAMLPQRKYTRVLDAGCGPGWMSRRWRERHAQVTALDLSPPMLVQARQKDAADHYLAGDIESLPLATATFDLAWSNLAVQWCGNLSTALRELYRVVRPGGVVAFTTLVQGSLPELHQAWQAVDERPHANRFLPPDEIEQSLNAVHYQHYIQPITLWFDDALSAMRSLKGIGATHLHEGRDPRILTRSQLQRLQLAWPQQQGRYPLTYHLFLGVIARE

SEQ ID NO: 1763 - DNA, 678 bp, Escherichia coli
gtgagtaaatgttattttgtcaccggaacggataccgaagtggggaaaactgtcgccagctgcgcgcttttacaagccgcaaaggcagcaggctaccggacggcaggttacaaaccggtggcctctggcagcgaaaagaccccgaaaggcttacgtaatagtgacgcgctggcgttacagcgcaacagtagcctgcagctggattacgcaacggtaaatccttacaccttcgcagaacccacctcgccgcatatcatcagcgcgcaagagggcaggccgatagaagcattggtaatgagcgccggattacgcgcgcttgaacaacaggctgactgggtgttagtggaaggtgctggcggctggtttacgccgctttctgacactttcacttttgcggattgggtaacacaggaacaactgccagtgatactggttgtgggcgtgaaactcggctgtattaatcacgcgatgttgactgcgcaggcaatactacacgccggactgactctggcggggtgggtggcgaacgatgtcacgcctccgggaaaacgtcacgctgaatatatgaccacgctcacccgcatgattcccgcgccgctgctgggcgaaattccctggcttgcagaaaatccagaaaatgcggcaaccggaaagtacatcaatcttgccttaatgtag

SEQ ID NO: 1764 - protein, 225 aa, Escherichia coli
MSKCYFVTGTDTEVGKTVASCALLQAAKAAGYRTAGYKPVASGSEKTPKGLRNSDALALQRNSSLQLDYATVNPYTFAEPTSPHIISAQEGRPIEALVMSAGLRALEQQADWVLVEGAGGWFTPLSDTFTFADWVTQEQLPVILVVGVKLGCINHAMLTAQAILHAGLTLAGWVANDVTPPGKRHAEYMTTLTRMIPAPLLGEIPWLAENPENAATGKYINLALM

SEQ ID NO: 1765 - DNA, 384 bp, Escherichia coli
  n 8, 9, 10, 11, 12: n is any nucleotide
atgaatgnnnnnaggcacagatgcgcgatggtggtctgtctccggaggtggacgatgaaaaccttccgctggaaagtgaaacccgggatggatgtgacatcggctccttccgtcagggaggtgcgctttggtgatggctattcccagcgtgcgcctgccgggctgaacgctgacctgaaaacgtacagcgtgacgctgtctgtctcccgtgaggaggccacggcgctggagtcgtttctggctgagcacgggggctggaaggcctttctgtggacgccgccttatggttacaggcagataaaggtgacctgcgcaaaatggtcgtcgcaggtcagtatgttgcgtgttgggttcagcgcagagtttaaacaggtggtgaactga

SEQ ID NO: 1766 - protein, 127 aa, Escherichia coli
  Xaa 3, 4: Xaa is any amino acid
MNXXRHRCAMVVCLRRWTMKTFRWKVKPGMDVTSAPSVREVRFGDGYSQRAPAGLNADLKTYSVTLSVSREEATALESFLAEHGGWKAFLWTPPYGYRQIKVTCAKWSSQVSMLRVGFSAEFKQVVN

SEQ ID NO: 1767 - DNA, 699 bp, Escherichia coli; identical to SEQ ID NO: 1347

SEQ ID NO: 1768 - protein, 232 aa, Escherichia coli; identical to SEQ ID NO: 1348

SEQ ID NO: 1769 - DNA, 447 bp, Escherichia coli
ttggcggcttcctttccattaacaaactttcgcagtaatcccatgacagagacagaatcagcgattctggcgcacgcccggcgatgtgcgccagcggagtcgtgcggcttcgtggtaagcacgccggagggggaaagatatttcccctgcgtgaatatctccggtgagccggaggcgtatttccggatggctccggaggactggctgcaggcagagatgcagggtgagattgtggcgctggtccacagccaccccggtggtctgccctggctgagtgaggctgaccggcggctgcaggtgcagagcgatttgccgtggtggctggtctgccggggggcgattcacaagttccgctgtgtgccgcatctcaccgggcggcgctttgagtacggggtgacagactgttacacactgttccgggatgcttaccatctgggcggggattga

SEQ ID NO: 1770 - protein, 148 aa, Escherichia coli
MAASFPLTNFRSNPMTETESAILAHARRCAPAESCGFVVSTPEGERYFPCVNISGEPEAYFRMAPEDWLQAEMQGEIVALVHSHPGGLPWLSEADRRLQVQSDLPWWLVCRGAIHKFRCVPHLTGRRFEYGVTDCYTLFRDAYHLGGD

SEQ ID NO: 1771 - DNA, 2064 bp, Escherichia coli
atgctggtcctgtccagagccgggcaggcggcagggctgacgtttaaccagaccagcgagtcactcagcgcactggttaaggcgggagtaagcggtgaggctcagattgcatccatcagccagagtgtggcgcgtttctcctctgcatccggcgtggaggtggacaaggtcgctgaagccttcgggaagctgaccactgacccgacgtcggggctgacggcgatggcgcgccagttccataacgtaacggcggagcagattgcgtatgttgctcagttgcagcgttccggcgatgaatccggggcattgcaggcggcgaacgaggccgcaacgaaagggtttgatgaccagacccgacgcctgaaagagaacatgggcacgctggaaacctgggcagacaggacagcacgggcattcaaatccatgtgggatgcggtgctggatattggtcgtcctgataccgctcaggagatgctgattaaggcagaggctgcgtttaagaaagcggacgacatctggaatctgcgcaaggatgattattttgttaacgatgaagcgcgggcgcgttactgggatgatcgtgaaaaggcccgtcttgcgcttgaagccgcccgaaagaaggctgaacagcagagtcaacaggacaaaaatgcgcagcagcagagcgataccgaagcatcacggctgaaatataccgaagaggcgcagaaggcttacgaacggctgcagacaccgctggagaaatataccgcccgtcaggaagaactgaacaaggcactgaaagacgggaaaatcctgcaggcagattacaacacgctgatggcggcggcgaaaaaggattatgaagcgacgctgaaaaagccgaaacagtccggcgtgaaggtgtctgcgggcgatcgtcaggaagacagtgctcatgctgccctgctgacgcttcaggctgaactccggacgctggagaagcatgccggagcaaatgagaaaatcagccagcagcgccgggatttgtggaaggcggagagtcagttcgcggtactggaggaggcggcgcaacgtcgccagctgtctgcacaggagaaatccctgctggcgcataaagatgagacgctggagtacaaacgccagctggctgcacttggcgacaaggttacgtatcaggagcgcctgaacgcgctggcgcagcaggcggataaattcgcacagcagcaacgggcaaaacgggccgctattgatgcgaaaagccgggggctgactgaccggcaggcagaacgggaagccacggaacagcgcctgaaggaacagtatggcgataatcctctggcgctgaataacgtcatgtcagagcagaaaaagacctgggcggctgaagacctgcttcgcgggaactggatggcaggcctgaagtccggctggagtgagtgggaagagagtgccacggacagtatgtcgcaggttaaaagtgctgccacgcagacctttgatggtattgcgcagaatatggcggcgatgctgaccggcagtgaacagaactggcgcagcttcacccgttccgtgctgtccatgatgacagaaattctgcttaagcaggcaatggtggggattgtcgggagtatcggcagcgctattggcggggctgttggtggcggcgcatccgcgtcaggcggtacagccattcaggccgctgcggcgaaactccattttgcaaccggaggatttacgggaaccggcggcaaatatgagccagcggggattgttcaccgtggtgaatttgtcttcacgaaggaggcaaccagccggattggcgtgggaaatctctaccggctgatgcgcggctatgccaccggcggttatgtcggtggcaccggaagtccggcgcaaatgcggcgttcagagggtatcaggtttgagcagaacaacaacgtggtgattcagaacgacggtacgaatggtctgccaggtccacagatgatgaaggcggtgtatgacatggcccgcaagggtgcccgtgatgaaatccaggcacagatgcgcgatggtggtctgttctccggaggtggacgatga

SEQ ID NO: 1772 - protein, 687 aa, Escherichia coli
MLVLSRAGQAAGLTFNQTSESLSALVKAGVSGEAQIASISQSVARFSSASGVEVDKVAEAFGKLTTDPTSGLTAMARQFHNVTAEQIAYVAQLQRSGDESGALQAANEAATKGFDDQTRRLKENMGTLETWADRTARAFKSMWDAVLDIGRPDTAQEMLIKAEAAFKKADDIWNLRKDDYFVNDEARARYWDDREKARLALEAARKKAEQQSQQDKNAQQQSDTEASRLKYTEEAQKAYERLQTPLEKYTARQEELNKALKDGKILQADYNTLMAAAKKDYEATLKKPKQSGVKVSAGDRQEDSAHAALLTLQAELRTLEKHAGANEKISQQRRDLWKAESQFAVLEEAAQRRQLSAQEKSLLAHKDETLEYKRQLAALGDKVTYQERLNALAQQADKFAQQQRAKRAAIDAKSRGLTDRQAEREATEQRLKEQYGDNPLALNNVMSEQKKTWAAEDLLRGNWMAGLKSGWSEWEESATDSMSQVKSAATQTFDGIAQNMAAMLTGSEQNWRSFTRSVLSMMTEILLKQAMVGIVGSIGSAIGGAVGGGASASGGTAIQAAAAKLHFATGGFTGTGGKYEPAGIVHRGEFVFTKEATSRIGVGNLYRLMRGYATGGYVGGTGSPAQMRRSEGIRFEQNNNVVIQNDGTNGLPGPQMMKAVYDMARKGARDEIQAQMRDGGLFSGGGR

SEQ ID NO: 1773 - DNA, 330 bp, Escherichia coli
atgaaaaccttccgctggaaagtgaaacccgggatggatgtgacatcggctccttccgtcagggaggtgcgctttggtgatggctattcccagcgtgcgcctgccgggctgaacgctgacctgaaaacgtacagcgtgacgctgtctgtctcccgtgaggaggccacggcgctggagtcgtttctggctgagcacgggggctggaaggcctttctgtggacgccgccttatggttacaggcagataaaggtgacctgcgcaaaatggtcgtcgcgggtcagtatgctgcgtgttgagttcagcgcagagtttgaacaggtggtgaactga

SEQ ID NO: 1774 - protein, 109 aa, Escherichia coli
MKTFRWKVKPGMDVTSAPSVREVRFGDGYSQRAPAGLNADLKTYSVTLSVSREEATALESFLAEHGGWKAFLWTPPYGYRQIKVTCAKWSSRVSMLRVEFSAEFEQVVN

SEQ ID NO: 1775 - DNA, 699 bp, Escherichia coli
atgcaggatatccggcaggaaacattgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggcgacagtatcagccgtatcccattcaggggagtagttttgaactgaatggcaaaggcaccagtacgcgccccacgctgacggtttctaacctgtacggtatggtcaccgggatggtggaagatctgcagagtctggtcggcggaacggtggtcaggcgtaaggtttacgcccgttttctggatgcggtgaacttcgtcaacggaaacagcgacgccgatccggagcaggaggtgatcagccgctggcgcatcgagcagtgcagcgaactgagtgcggtcagtgcctcctttgtactgtccacaccgacggaaacggatggtgccgtttttccggggcgcatcatgctggctaatacctgcacctggacctatcgcggtgatgagtgcggttatcacggtccggcggtcgcggatgaatatgatcagccgacttccgatatcacgaaggataaatgcagcaaatgcctgagcggctgtaagtttcgcaataacgtcggcaactttggcggcttcctttccattaacaaactttcgcagtaa

SEQ ID NO: 1776 - protein, 232 aa, Escherichia coli
MQDIRQETLNECTRAEQSASVVLWEIDLTEVGGERYFFCNEQNEKGEPVTWQGRQYQPYPIQGSSFELNGKGTSTRPTLTVSNLYGMVTGMVEDLQSLVGGTVVRRKVYARFLDAVNFVNGNSDADPEQEVISRWRIEQCSELSAVSASFVLSTPTETDGAVFPGRIMLANTCTWTYRGDECGYHGPAVADEYDQPTSDITKDKCSKCLSGCKFRNNVGNFGGFLSINKLSQ

SEQ ID NO: 1777 - DNA, 756 bp, Escherichia coli
  n 733, 734, 735, 736, 737: n is any nucleotide
atgacagagacagaatcagcgattctggcgcatgcccggcgatgtgcgccagcggagtcgtgcggcttcgtggtgagagcgccggagggggaaagatattttccctgcgtgaatatctccggtgagccggaggcgtatttccggatggctccggaggactggctgcaggcagagatgcagggtgagattgtggcgctggtccacagtcatcccggtggtctgccctggctgagtgaggccgaccggcggctgcaggtgcagagtgatttgccgtggtggctggtctgccggggggcgattcataagttccgctgtgtgccgcatctcaccgggcggcgctttgagcacggggtgacggactgttacacgctgttccgggacgcttaccatctggcggggattgagatgccggactttcatcgtgaggatgactggtggcgtaacggccagaatctctatcttgataatctggaggccacagggctgtatcaggtgccgttgtcagcggcgcagccgggcgatgtgctgctgtgctgctttggttcatcggtgccgaatcatgccgctatttactgtggtgacggcgagctgctgcaccatattcctgaacaactgagtaaacgagagaggtataccgacaaatggcagcgacgcacacactccctctggcgtcaccgggcatggcgcgcatctgcctttacgggatttacaacgatttggccgccgcatcgannnnncattccattcattaattaa

SEQ ID NO: 1778 - protein, 251 aa, Escherichia coli
  Xaa 245, 246: Xaa is any amino acid
MTETESAILAHARRCAPAESCGFVVRAPEGERYFPCVNISGEPEAYFRMAPEDWLQAEMQGEIVALVHSHPGGLPWLSEADRRLQVQSDLPWWLVCRGAIHKFRCVPHLTGRRFEHGVTDCYTLFRDAYHLAGIEMPDFHREDDWWRNGQNLYLDNLEATGLYQVPLSAAQPGDVLLCCFGSSVPNHAAIYCGDGELLHHIPEQLSKRERYTDKWQRRTHSLWRHRAWRASAFTGFTTIWPPHRXXIPFIN

SEQ ID NO: 1779 - DNA, 429 bp, Escherichia coli
atggtggaagatctgcagagtctggtcggcggaacggtggtcaggcgtaaggtttacgcccgttttctggatgcggtgaacttcgtcaacggaaacagcgacgccgatccggagcaggaggtgatcagccgctggcgcatcgagcagtgcagcgaactgagtgcggtcagtgcctcctttgtactgtccacaccgacggaaacggatggtgccgtttttccggggcgcatcatgctggctaatacctgcacctggacctatcgcggtgatgagtgcggttatcacggtccggcggtcgcggatgaatatgatcagccgacttccgatatcacgaaggataaatgcagcaaatgcctgagcggctgtaagtttcgcaataacgtcggcaactttggcggcttcctttccattaacaaactttcgcagtaa

SEQ ID NO: 1780 - protein, 142 aa, Escherichia coli
MVEDLQSLVGGTVVRRKVYARFLDAVNFVNGNSDADPEQEVISRWRIEQCSELSAVSASFVLSTPTETDGAVFPGRIMLANTCTWTYRGDECGYHGPAVADEYDQPTSDITKDKCSKCLSGCKFRNNVGNFGGFLSINKLSQ

SEQ ID NO: 1781 - DNA, 753 bp, Escherichia coli
  n 734, 735, 736, 737, 738: n is any nucleotide
atgacagagacagaatcagcgattctggcgcatgcccggcgatgtgcgccagcggagtcgtgcggcttcgtggtgagagcgccggagggggaaagatattttccctgcgtgaatatctccggtgagccggaggcgtatttccggatggctccggaggactggctgcaggcagagatgcagggtgagattgtggcgctggtccacagtcatcccggtggtctgccctggctgagtgaggccgaccggcggctgcaggtgcagagtgatttgccgtggtggctggtctgccggggggcgattcataagttccgctgtgtgccgcatctcaccgggcggcgctttgagcacggggtgacggactgttacacgctgttccgggacgcttaccatctggcggggattgagatgccggactttcatcgtgaggatgactggtggcgtaacggccagaatctctatcttgataatctggaggccacagggctgtatcaggtgccgttgtcagcggcgcagccgggcgatgtgctgctgtgctgctttggttcatcggtgccgaatcatgccgctatttactgtggtgacggcgagctgctgcaccatattcctgaacaactgagtaaacgagagaggtataccgacaaatggcagcgacgcacacactccctctggcgtcaccgggcatggcgcgcatctgcctttacggggatttacaacgatttggccgccgcatcgannnnncattccattcattaa

SEQ ID NO: 1782 - protein, 250 aa, Escherichia coli
  Xaa 245, 246: Xaa is any amino acid
MTETESAILAHARRCAPAESCGFVVRAPEGERYFPCVNISGEPEAYFRMAPEDWLQAEMQGEIVALVHSHPGGLPWLSEADRRLQVQSDLPWWLVCRGAIHKFRCVPHLTGRRFEHGVTDCYTLFRDAYHLAGIEMPDFHREDDWWRNGQNLYLDNLEATGLYQVPLSAAQPGDVLLCCFGSSVPNHAAIYCGDGELLHHIPEQLSKRERYTDKWQRRTHSLWRHRAWRASAFTGIYNDLAAASXXHSIH

SEQ ID NO: 1783 - DNA, 420 bp, Escherichia coli
  n 8, 9, 10, 11, 12: n is any nucleotide
atgaatgnnnnnctggtcggcggaacggtggtccggcgtaaggtttacgcccgttttctggatgcggtgaacttcgtcaacggaaacagagacgccgatccggagcaggaggtgatcagccgctggcgcatcgagcagtgcagcgaactgagcgcggtgagtgcctcctttgtactgtccacgccgacggaaacggatggcgctgtttttccggggcgtatcatgctggccaacacctgcacctggacctatcgcggtgatgagtgcggttatcacggtccggcagtcgcggatgaatatgaccagccgacgtccgatatcacgaaggataaatgcagcaaatgcctgagcggctgtaagtttcgcaataacgtcggcaactttggcggcttcctttccattaacaaactttcgcagtaa

SEQ ID NO: 1784 - protein, 139 aa, Escherichia coli
  Xaa 3, 4: Xaa is any amino acid
MNXXLVGGTVVRRKVYARFLDAVNFVNGNRDADPEQEVISRWRIEQCSELSAVSASFVLSTPTETDGAVFPGRIMLANTCTWTYRGDECGYHGPAVADEYDQPTSDITKDKCSKCLSGCKFRNNVGNFGGFLSINKLSQ

SEQ ID NO: 1785 - DNA, 786 bp, Escherichia coli
ttggcggcttcctttccattaacaaactttcgcagtaatcccatgacagagacagaatcagcgattctggcgcacgcccggcgatgtgcgccagcggagtcgtgcggcttcgtggtaagcacgccggagggggaaagatatttcccctgcgtgaatatctccggtgagccggaggcgtatttccggatggctccggaggactggctgcaggcagagatgcagggtgagattgtggcgctggtccacagccaccccggtggtctgccctggctgagtgaggctgaccggcggctgcaggtgcagagcgatttgccgtggtggctggtctgccggggggcgattcacaagttccgctgtgtgccgcatctcaccgggcggcgctttgagtacggggtgacagactgttacacactgttccgggatgcttaccatctggcggggattgagatgccggattttcatcgcggggatgactggtggcgtcacggtcagaatctctatcttgacaatatggaggctactggtttttaccgtgtcgcactgacagaggcgcagccgggcgatgtgctgctgtgctgttttggttcatcggtgccgaatcacgccgccatttactgcggcgacggtgagctgctgcaccatattcctgaacaactgagtaaacgagagaggtataccgacaaatggcagcgacgcacacactccctctggcgtcaccgggaatggcacgcatctgcctttacggggatttgcaacgatttggccgccgcatcgaccttcgtgtga

SEQ ID NO: 1786 - protein, 261 aa, Escherichia coli
MAASFPLTNFRSNPMTETESAILAHARRCAPAESCGFVVSTPEGERYFPCVNISGEPEAYFRMAPEDWLQAEMQGEIVALVHSHPGGLPWLSEADRRLQVQSDLPWWLVCRGAIHKFRCVPHLTGRRFEYGVTDCYTLFRDAYHLAGIEMPDFHRGDDWWRHGQNLYLDNMEATGFYRVALTEAQPGDVLLCCFGSSVPNHAAIYCGDGELLHHIPEQLSKRERYTDKWQRRTHSLWRHREWHASAFTGICNDLAAASTFV

SEQ ID NO: 1787 - DNA, 744 bp, Escherichia coli
atgacagagacagaatcagcgattctggcgcacgcccggcgatgtgcgccagcggagtcgtgcggcttcgtggtaagcacgccggagggggaaagatattttccctgcgtgaatatctccggtgagccggaggcgtatttccggatggctccggaggactggctgcgggcagaaatgcagggtgagattgtggcgctggtccacagtcaccccggtggtctgccctggctgagtgaggccgatcggcggctgcaggtgcagagtgatttgccgtggtggctggtctgccgcggggcgattcacaagttccgctgtgtgccacatcttaccgggcggcgctttgagcacggggtgacggactgttacacgctgttccgggatgcataccatctggcgggaattgagatgccggattttcatcgcggagatgactggtggcgtaacggccagaatctctatcttgacaatatggaggcgactggtttttaccgtgtcgcactgacagaggcgcagccgggcgatgtgctgctgtgctgttttggttcatcggtgccgaatcatgccgccatttactgtggtgatggcgagctgctgcaccatattcctgaacaactgagcaaacgagagaggtataccgacaaatggcagcgacgcacacactccctctggcgtcaccgggcatggcacgcatctgcctttacggggatttacaacgatttggccgccgcatcgaccttcgtgtga

SEQ ID NO: 1788 - protein, 247 aa, Escherichia coli
MTETESAILAHARRCAPAESCGFVVSTPEGERYFPCVNISGEPEAYFRMAPEDWLRAEMQGEIVALVHSHPGGLPWLSEADRRLQVQSDLPWWLVCRGAIHKFRCVPHLTGRRFEHGVTDCYTLFRDAYHLAGIEMPDFHRGDDWWRNGQNLYLDNMEATGFYRVALTEAQPGDVLLCCFGSSVPNHAAIYCGDGELLHHIPEQLSKRERYTDKWQRRTHSLWRHRAWHASAFTGIYNDLAAASTFV

SEQ ID NO: 1789 - DNA, 549 bp, Escherichia coli
gtgaaaacgggggctgaagccatccgggcgctggccacgcagcttccgtcgtttcgccagaaactgaatgagggctggtatcaggtgcgcattgccgggcgtgatgcaggcgaaaatgaattatctgcccgtcttaatgaaccgctggcaaatggtgccgtgattcacatcgtgccgcgtctggcgggagctaaaagtggcggtgtgtttcaggtggtgctgggggcggcgctgattgcggtggcatggtggaaccctgtgggctggctgggtgctgcggctgtatcgggcatgtatgcggcaggggccagtatgattctgggtggtgtggcccagatgctggcaccgaaagccaggacgcccacggcagccagtacagataacggcaaacagaacacctatttctcctcactggataacatggttgctcagggcaatgttctgcctgttctgtacggtgaaatgcgtgtggggtcgcgggtggtttctcaggagatcagcacggcagacgaaggtgacggtggtcaggttgtggtgattggtcgctga

SEQ ID NO: 1790 - protein, 182 aa, Escherichia coli; identical to SEQ ID NO: 1352

SEQ ID NO: 1791 - DNA, 609 bp, Escherichia coli
  n 590, 591, 592, 593, 594: n is any nucleotide
atgggtaaaggcagcagtaaggggcataccccgcgcgaagcgaaggacaacctgaagtccacgcagttgctgagtgtgatcgatgccatcagcgaagggccggttgaaggtccggtggatgggttaaaaagcgtgctgctgaacagtacgccggtgctggacagtgaggggaataccaatatctccggtgtcacggtggtgttccgggcaggtgagcaggagcagacaccgccggaggggtttgaatcctccggttccgagacggtgctgggtacggaagtgaaatatgacacgccgatcacccgcaccattacgtcggcaaacatcgaccgactgcgctttaccttcggtgtgcaggcactggtggaaaccacttcaaagggtgaccggaatccgtcggaagtccgcctgctggttcagatacagcgtaacggtggctgggtgacggaaaaagacatcaccattaagggcaaaaccacctcgcagtatctggcctcggtggtggtggataacctgccgccgcgcccgtttaatatccggatgcgcaggatgacgccggacagcaccacagaccagctgcagaacaaaannnnncattccattcattaa

SEQ ID NO: 1792 - protein, 202 aa, Escherichia coli
  Xaa 197, 198: Xaa is any amino acid
MGKGSSKGHTPREAKDNLKSTQLLSVIDAISEGPVEGPVDGLKSVLLNSTPVLDSEGNTNISGVTVVFRAGEQEQTPPEGFESSGSETVLGTEVKYDTPITRTITSANIDRLRFTFGVQALVETTSKGDRNPSEVRLLVQIQRNGGWVTEKDITIKGKTTSQYLASVVVDNLPPRPFNIRMRRMTPDSTTDQLQNKXXHSIH

SEQ ID NO: 1793 - DNA, 600 bp, Escherichia coli
atggctccggaggactggctgcaggcagagatgcagggtgagattgtggcgctggtccacagtcatcccggtggtctgccctggctgagtgaggccgaccggcggctgcaggtgcagagtgatttgccgtggtggctggtctgccggggggcgattcataagttccgctgtgtgccgcatctcaccgggcggcgctttgagcacggggtgacggactgttacacgctgttccgggacgcttaccatctggcggggattgagatgccggactttcatcgtgaggatgactggtggcgtaacggccagaatctctatcttgataatctggaggccacagggctgtatcaggtgccgttgtcagcggcgcagccgggcgatgtgctgctgtgctgctttggttcatcggtgccgaatcatgccgctatttactgtggtgacggcgagctgctgcaccatattcctgaacaactgagtaaacgagagaggtataccgacaaatggcagcgacgcacacactccctctggcgtcaccgggcatggcgcgcatctgcctttacggggatttacaacgatttggccgccgcatcgaccttcgtgtga

SEQ ID NO: 1794 - protein, 199 aa, Escherichia coli
MAPEDWLQAEMQGEIVALVHSHPGGLPWLSEADRRLQVQSDLPWWLVCRGAIHKFRCVPHLTGRRFEHGVTDCYTLFRDAYHLAGIEMPDFHREDDWWRNGQNLYLDNLEATGLYQVPLSAAQPGDVLLCCFGSSVPNHAAIYCGDGELLHHIPEQLSKRERYTDKWQRRTHSLWRHRAWRASAFTGIYNDLAAASTFV

SEQ ID NO: 1795 - DNA, 633 bp, Escherichia coli
atggcgcgcatctgcctttacggggatttacaacgatttggccgccgcatcgaccttcgtgtgaaaacgggggctgaagccatccgcgcactggccacacagctcccggtgtttcgtcagaaactgagcgacggctggtatcaggtacggattgccgggcgggacgtcagcacgtccgggttaacggcgcagttacatgagactctgcctgatggcgctgtgattcatattgttcccagagtcgccggggccaagtcaggtggcgtattccagattgtcctgggggctgccgccattgccggatcattctttaccgccggagccacccttgcagcatggggggcagccattggggccggtggtatgaccggcatcctgttttctctcggtgccagtatggtgctcggtggtgtggcgcagatgctggcaccgaaagccagaactccccgtacacagacaacggataacggcaaacagaacacctatttctcctcactggataacatggttgcccagggcaatgttctgccggttctgtacggtgaaatgcgcgtggggtcacgcgtggtttctcaggagatcagcacggcagacgaaggggatggtggtcaggttgtggtgattggtcgctga

SEQ ID NO: 1796 - protein, 210 aa, Escherichia coli
MARICLYGDLQRFGRRIDLRVKTGAEAIRALATQLPVFRQKLSDGWYQVRIAGRDVSTSGLTAQLHETLPDGAVIHIVPRVAGAKSGGVFQIVLGAAAIAGSFFTAGATLAAWGAAIGAGGMTGILFSLGASMVLGGVAQMLAPKARTPRTQTTDNGKQNTYFSSLDNMVAQGNVLPVLYGEMRVGSRVVSQEISTADEGDGGQVVVIGR

SEQ ID NO: 1797 - DNA, 2352 bp, Escherichia coli
atgggtaaaggcagcagtaaggggcataccccgcgcgaagcgaaggacaacctgaaatccacgcagctgctgagtgtgattgatgccatcagcgaagggccggttgaaggtccggtggatggattaaaaagcgtgctgctgaacagtacgccggtgctggacagtgaggggaataccaatatatccggcgtcacggtggtgttccgggcaggtgagcaggagcagtcaccgccggagggatttgaatcctccggctccgagacggtgctgggtacggaagtgaaatatgacacgccgatcacccgcaccattacgtcggcaaacatcgaccgtctgcgctttaccttcggtgtacaggcactggtggaaaccacctcaaagggtgaccggaatccgtcggaagtccgcctgctggttcagatacagcgtaacggtggctgggtgacggaaaaagacatcaccattaagggcaaaaccacctcgcagtatctggcctcggtggtggtgggtaacctgccgccgcgcccgttcaatatccggatgcgcaggatgacgccggacagcaccacagaccagctgcagaacaaaacgctctggtcgtcatacaccgaaatcatcgatgtgaaacagtgctacccgaacacggcactggtcggcgtgcaggtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacgttcgtgcaggaccgaccgtcggataaggtgtggacctataaccgcagtaatgtggtgatgccggatgatggcgcgccgttccgctacagcttcagcgccctgaaggaccgccataatgccgttgaggtgaactggattgacccggataacggctgggagacggcgacagagcttgtggaggacacgcaggccattgcccgttacggtcgtaacgtcacgaagatggatgcctttggctgtaccagccgggggcaggcacaccgcgccgggctgtggctgattaaaacggaactgctggaaacgcagaccgtggacttcagcgtgggtgcagaagggcttcgccatgtaccgggcgatgtcattgaaatctgcgatgatgactatgcgggtatcagcaccggcgggcgcgtgctggcggtgaacagccagacccggacgctgacgctcgaccgtgaaatcacgctgccatcctccggcaccacgctgataagcctggttgacggacaggggaatccggtcagcgtggaggtccagtccgtcaccgacggcgtgaaggtgaaagtgagccgtgttcctgacggcgttgcagaatacagcgtgtgggggctgaagctgccgacgctgcgccagcgcctgttccgctgtgtgagtatccgtgagaacgacgacggcacgtatgccatcactgccgtgcagcatgtaccggaaaaagaggccatcgtggataacggggcgcactttgacggcgaccagagcggcacggtgaatggtgtcacgccgccagcagtgcagcatctgaccgccgaagtcactgcagacagcggggaatatcaggtgctggcgcgatgggacacaccgaaggtggtgaagggcgtgagcttcatgctccgtctgaccgtgacagcggatgacggcagtgagcggctgatcagcacagccaggacgacggaaaccacataccgcttcacacaactggcgctggggaactacaggctgacagtccgggcggtaaatgcatgggggcagcagggcgatccggcatcggtatcgttccggattgccgcaccggcagcgccgtcgcagattgagctgacaccggggtattttcagataaccgccacgccgcatcttgcggtttatgatccgacggtacagtttgagttctggttctcggaaaagcggattgcggatatcaggcaggttgaaaccacagcacgctatccttggcacggcgctgtactggatagccgccagtatcaatatcaaaccgggccatga

SEQ ID NO: 1798 - protein, 783 aa, Escherichia coli
MGKGSSKGHTPREAKDNLKSTQLLSVIDAISEGPVEGPVDGLKSVLLNSTPVLDSEGNTNISGVTVVFRAGEQEQSPPEGFESSGSETVLGTEVKYDTPITRTITSANIDRLRFTFGVQALVETTSKGDRNPSEVRLLVQIQRNGGWVTEKDITIKGKTTSQYLASVVVGNLPPRPFNIRMRRMTPDSTTDQLQNKTLWSSYTEIIDVKQCYPNTALVGVQVDSEQFGSQQVSRNYHLRGRILQVPSNYNPQTRQYSGIWDGTFKPAYSNNMAWCLWDMLTHPRYGMGKRLGAADVDKWALYVIGQNCDQSVPDGFGGTEPRITCNAWLTTQRKAWDVLSDFCSAMRCMPVWNGQTLTFVQDRPSDKVWTYNRSNVVMPDDGAPFRYSFSALKDRHNAVEVNWIDPDNGWETATELVEDTQAIARYGRNVTKMDAFGCTSRGQAHRAGLWLIKTELLETQTVDFSVGAEGLRHVPGDVIEICDDDYAGISTGGRVLAVNSQTRTLTLDREITLPSSGTTLISLVDGQGNPVSVEVQSVTDGVKVKVSRVPDGVAEYSVWGLKLPTLRQRLFRCVSIRENDDGTYAITAVQHVPEKEAIVDNGAHFDGDQSGTVNGVTPPAVQHLTAEVTADSGEYQVLARWDTPKVVKGVSFMLRLTVTADDGSERLISTARTTETTYRFTQLALGNYRLTVRAVNAWGQQGDPASVSFRIAAPAAPSQIELTPGYFQITATPHLAVYDPTVQFEFWFSEKRIADIRQVETTARYPWHGAVLDSRQYQYQTGP

SEQ ID NO: 1799 - DNA, 1254 bp, Escherichia coli
ttgagttctggttctcggaaaagcggattgcggatatcaggcaggttgaaaccacagcacgctatccttggcacggcgctgtactggatagccgccagtatcaatatcaaaccgggccatgattattatttttacatccgcagtgtgaacaccgttggcaaatcggcatttgtggaggctgttggccagccgagtgatgatgcatccggctatctgaattttttcaaaggagagatagggaaaacccatctggctcaggagttgtggacgcagattgataacggtcagcttgcgcctgacctggctgaaatcaggacgtccattacgggtgtcagcaatgaaatcacgcagaccgtcaataagaaactggaagaccagagtgcagcgatccagcagatacagaaggttcaggttgatacaaataataacctgaacagcatgtgggctgtgaagctgcagcagatgcaggacggacgcctttatatcgcgggtattggtgccggtgttgagaatactcctgacggtatgcagagtcaggtgctgctggcggcggacaggattgcgatgattaatcctgcgaatggcaacacaaagccgatgtttgttgggcagggcgatcagatattcatgaacgaagtgttcctgaaatatctgacggctcccaccattaccagcggtggcaatcccccaacgttttcactgacacctgatggtcgactttctgcgaaaaatgcggatatcagcggtaacgtgaacgcgaactccgggacgctcaacaacgtcacgattaatcagaactgtcggattctgggaaaactgtcagctaaccagattgaaggtgatattgtcaaaacggtgggaaaagcctttccgagaaatggcagttatgccagcggtacaataacggtcactgtgtacgatgaccaggcttttgaccgtcagatagtagtcccccccgttctgtttcgtgggggtaagcatgaaaacttcaacagcaacaaccaacagtcatactggtattcaacctgtaagctgcaggtactgaagaacggacaggaaatctttcagcaacccgcgacggatgtcagcagggtattttcatcagtcattgatatgcctgccggacacggccatgtcaccctgactttcaatgtttcttcatatggtgctaataactggacgccaacgaccagtatcagcgaccttcttgttgttgtgatgaagaaatctacagccggtatcagtatcagttga

SEQ ID NO: 1800 - protein, 417 aa, Escherichia coli
MSSGSRKSGLRISGRLKPQHAILGTALYWIAASINIKPGHDYYFYIRSVNTVGKSAFVEAVGQPSDDASGYLNFFKGEIGKTHLAQELWTQIDNGQLAPDLAEIRTSITGVSNEITQTVNKKLEDQSAAIQQIQKVQVDTNNNLNSMWAVKLQQMQDGRLYIAGIGAGVENTPDGMQSQVLLAADRIAMINPANGNTKPMFVGQGDQIFMNEVFLKYLTAPTITSGGNPPTFSLTPDGRLSAKNADISGNVNANSGTLNNVTINQNCRILGKLSANQIEGDIVKTVGKAFPRNGSYASGTITVTVYDDQAFDRQIVVPPVLFRGGKHENFNSNNQQSYWYSTCKLQVLKNGQEIFQQPATDVSRVFSSVIDMPAGHGHVTLTFNVSSYGANNWTPTTSISDLLVVVMKKSTAGISIS

SEQ ID NO: 1801 - DNA, 255 bp, Escherichia coli
gtggtggcgactccggcattttcagcggctgactctgcattacggcgggaagcctcttcactgtctgcggaggcttcttctgacgcacgggcatttgtctctgaacgttctgccgctgttgctgcgttttgtgcggctgtttttgaagaagctgccgctttcgcgctgttacctgcattcgtctctgatgttttcgccgcattcctggacgatgccgctgctgtttctgatttctttgctgccgctgcgctctga

SEQ ID NO: 1802 - protein, 84 aa, Escherichia coli
MVATPAFSAADSALRREASSLSAEASSDARAFVSERSAAVAAFCAAVFEEAAAFALLPAFVSDVFAAFLDDAAAVSDFFAAAAL

SEQ ID NO: 1803 - DNA, 2061 bp, Escherichia coli
atggcagtacagatttcaggcgtgctgaaagacggtgcaggaaaaccgatacagaactgcaccattcagctcaaagcaaaacgtaacagcaccacggttgtggtgaacacggtggcctcagaaaatccggatgaagccggacgttacagcatggatgtcgagtatggccagtacagcgttatcctgctggttgaaggttttccgccttcacatgccggggccatcaccgtgtatgaggattctaagccggggacattgaatgattttctgggcgctgcaacagaagatgatgttcgtccggaggcactgtatcgttttgaaaagatggtggaagaggtggcacgcaacgctgaagccgcctctcagagcgcagcggcagcaaagaaatcagaaacagcagcggcatcgtccaggaatgcggcgaaaacatcagagacgaatgcaggtaacagcgcgaaagcggcagcttcttcaaaaacagccgcacaaaacgcagcaacagcggcagaacgttcagagacaaatgcccgtgcgtcagaagaagcctccgcagacagtgaagaggcttcccgccgtaatgcagagtcagccgctgaaaatgccggagtcgccaccacaaaagcgcgggaggccgcagcagacgcaacaaaggccgggcagaaaaaggatgaggctctgtcggcagcgacacgggctgaaaaggcggcagaccgcgcagaagtcgcagcggaagtgactgcagagccctatgcgaatatagtgccgccgctgcctgatgtgtggataccgtttaacgattcactggatatgattgcgggtttttctccgggctataaaaaaatagctattggtgacgatgtggttcaggtcgccagtgataaacaggttaatttcagtcgcgcatcaacggcaacatatatcaacaaatctggcgaactgaaaacggcggaaattaatgagccgcgatttgagtgtgatggcctgcttattgagggacaaagaacgaactacatgctcaattcggaaagtccagccagctgggggaagtcatcaaacatggatgtgcccgaaaccgggacagatagttttggttttacttatggaaagtttgtctgcaacgattctctggttgggcaaacttcggctattaatatggcatcaattgctgcaacaaagtcagttgatgtctcaggcgataacaagtacgtgacaacctcatgccgttttaaaacagaacgacaggtaaggttacgtatacggtttgataagtatgatggtagtgcaacaacttttcttggcgatgcgtacattgatacgcaaacgcttgaaattaatatgacaggtggggctgccggcagaattacggcacgagtcaggaaggataagaccacaggctggatttttgcagaggcaacgattcaggcaattgatggtgagttaaaaataggctctcagatacagtattctcctgagcggggtggggcaacagtatctggtgactatatttatcttgccaccccacaagtagagaatgggccgtgtgtatcatcatttattatttcaggaggcagcgcaacgacaagagccagtgatttggttagtatccccaccagaaataatctttataagttaccatttacttttttacttgagattcataaaaactgggatattgcaccaaacgccgcaccccgcgtgtgggatatagcagcagccaataccgggcaatcagcaattgcagcaatcaacagaggtagtggtaagttatatatgagtctgtcaaacccttcaggcttgtatgttaatagcgcagcgacagatgtatttgcagagaaaaccacatttggatgtattgcaaaagctgatggtcactttcatgtggtgacaaatggtaaagcggttaatgaagtttattgtgaatataatggtgtgaccgctgataaaaatatccgatttggagggcagacgaatactggagaacgacatctgtttggccatattcgcaatttccgcatatggcataaagaattaaatgacaggcaattaaaagaggtcgtatga

SEQ ID NO: 1804 - protein, 686 aa, Escherichia coli
MAVQISGVLKDGAGKPIQNCTIQLKAKRNSTTVVVNTVASENPDEAGRYSMDVEYGQYSVILLVEGFPPSHAGAITVYEDSKPGTLNDFLGAATEDDVRPEALYRFEKMVEEVARNAEAASQSAAAAKKSETAAASSRNAAKTSETNAGNSAKAAASSKTAAQNAATAAERSETNARASEEASADSEEASRRNAESAAENAGVATTKAREAAADATKAGQKKDEALSAATRAEKAADRAEVAAEVTAEPYANIVPPLPDVWIPFNDSLDMIAGFSPGYKKIAIGDDVVQVASDKQVNFSRASTATYINKSGELKTAEINEPRFECDGLLIEGQRTNYMLNSESPASWGKSSNMDVPETGTDSFGFTYGKFVCNDSLVGQTSAINMASIAATKSVDVSGDNKYVTTSCRFKTERQVRLRIRFDKYDGSATTFLGDAYIDTQTLEINMTGGAAGRITARVRKDKTTGWIFAEATIQAIDGELKIGSQIQYSPERGGATVSGDYIYLATPQVENGPCVSSFIISGGSATTRASDLVSIPTRNNLYKLPFTFLLEIHKNWDIAPNAAPRVWDIAAANTGQSAIAAINRGSGKLYMSLSNPSGLYVNSAATDVFAEKTTFGCIAKADGHFHVVTNGKAVNEVYCEYNGVTADKNIRFGGQTNTGERHLFGHIRNFRIWHKELNDRQLKEVV

SEQ ID NO: 1805 - DNA, 279 bp, Escherichia coli
atgaaagatttaactttgaagtttcatgacaaactgcagtttaaggccttcctgtcatctcttgactgggaggaggatgaagacctccagaataaactgttagtcgatgaaattggtttcacctacacagaaacaggggtaacagaagagggagaacctgtctgtgtccggaatgacggttattttgtcaacattcgcattcttgatgacttgtttgatgtttctgtattctctgattatgtcgtggagctggaaacaccgcttcgggaatggagctga

SEQ ID NO: 1806 - protein, 92 aa, Escherichia coli
MKDLTLKFHDKLQFKAFLSSLDWEEDEDLQNKLLVDEIGFTYTETGVTEEGEPVCVRNDGYFVNIRILDDLFDVSVFSDYVVELETPLREWS

SEQ ID NO: 1807 - DNA, 294 bp, Escherichia coli
atggatataagccccttacttcatgcgctttgtgctgtggctgcgcagatactggttggtctttttaccggaaactgggcttacggagcgatagccggttgtacgttcttcattgcgcgtgaacatacccaggcagaatatcgctggattgaaatgttcgggcatggcaagcgaatgaatatgccgtggtggggcggttttgatccgcgagcttgggatgtggcaagcctgatggattttgctgtgccggtggtggcgtgtctgctggtctggctgttggttaatcgtgggtga

SEQ ID NO: 1808 - protein, 97 aa, Escherichia coli
MDISPLLHALCAVAAQILVGLFTGNWAYGAIAGCTFFIAREHTQAEYRWIEMFGHGKRMNMPWWGGFDPRAWDVASLMDFAVPVVACLLVWLLVNRG

SEQ ID NO: 1809 - DNA, 858 bp, Escherichia coli
atgatggcattattactggagccactgcagttcacctttatgagtcacgcactgctgatttcactggtagtttccataccctgtgcgctgctgtcggtctttctggtcctgaaaggttgggcactgatgggtgacgcgatgagtcatgcggtttttcctggaatcgtgcttgcctggattctggggttacctttggctacaggggcattcgtcgccggagtattctgcgcggtggcgacgggatacctgaaagacaacagccgaatcaagcaagatacagtgatggggattgttttttctggcatgtttgccgcaggtctgatcttgtatattgcagtcaaaccagacgtacatcttgaccatattcttttcggcgacatgctcgggataaccatcggcgatataatccagacgatgattattgccgggctggttacacttgttattagcgtaaaatggcgggattttttgctgttcagctttgattatcaacaggcgcaggtaagcggtttgcatacgagatggctgcattatgggctgctgtgcatggtctctctgaccattgtggcgacgctgaaagcggtaggtatcattctctccatttctctgctcattgcgcctggcgccattgcggtactcctgacacaacgctttcatattgcgctcctactggcgactggcatatcggtaatagtgtcaatgactggtgtctggttgtccttttttatcgacagcgcaccagctccgacgattgtcgtcttattcgcggttttgttcatcatgacgtttgccgttaccagcatcaacgcacgcaaaaagggaaactcccatacacaggatctgttatcacccaattag

SEQ ID NO: 1810 - protein, 285 aa, Escherichia coli
MMALLLEPLQFTFMSHALLISLVVSIPCALLSVFLVLKGWALMGDAMSHAVFPGIVLAWILGLPLATGAFVAGVFCAVATGYLKDNSRIKQDTVMGIVFSGMFAAGLILYIAVKPDVHLDHILFGDMLGITIGDIIQTMIIAGLVTLVISVKWRDFLLFSFDYQQAQVSGLHTRWLHYGLLCMVSLTIVATLKAVGIILSISLLIAPGAIAVLLTQRFHIALLLATGISVIVSMTGVWLSFFIDSAPAPTIVVLFAVLFIMTFAVTSINARKKGNSHTQDLLSPN

SEQ ID NO: 1811 - DNA, 858 bp, Escherichia coli
atgaacgtgctactggaacccttcagctatgaatatatgctcaatgcgatgtgggtctcggcgatggtcggcggtctctgcgctttcctgtcatgctatctgatgctaaaaggctggtcgctgattggcgatgcgttgtcgcactctattgtcccgggtgttgcgggggcatatatgctggggcttccgttttctctgggagccttcttttccggcggactggctgcgggcagcatgctgtttcttaaccaacgcacccgcttaaaagaagatgccatcatcggtctgatcttctcgtccttttttggcctggggctgtttatggtgtcattgaacccgacatctgtgaacattcagaccatcgtcctgggcaatattctggcaatcgatccggcggatatcctgcaactcactatcattggcattctctcgatcatcgtgctttttttcaaatggaaagatcttatggtgacctttttcgacgagaatcacgcccgtgctattggattgcatccgggcagattaaaactcatcttcttcaccctgctgtcggtttcgaccgttgcggcgctgcaaacggttggtgcctttctggtgatctgtctggtggtgactcccggtgcaacagcatggttgttaaccgatcgttttccccgcctgctcatgattgctgtaactattggcagtgtgaccagtttcctcggcgcgtgggtcagttactttctggacggcgcgacaggtggaatcatcgtggtggcgcagacactgctgtttcttttagcatttgtctttgcgcccacccatgggcttttggcaaatcgtcggcgtgcgcataaggcgctggaggatcgctcatga

SEQ ID NO: 1812 - protein, 285 aa, Escherichia coli
MNVLLEPFSYEYMLNAMWVSAMVGGLCAFLSCYLMLKGWSLIGDALSHSIVPGVAGAYMLGLPFSLGAFFSGGLAAGSMLFLNQRTRLKEDAIIGLIFSSFFGLGLFMVSLNPTSVNIQTIVLGNILAIDPADILQLTIIGILSIIVLFFKWKDLMVTFFDENHARAIGLHPGRLKLIFFTLLSVSTVAALQTVGAFLVICLVVTPGATAWLLTDRFPRLLMIAVTIGSVTSFLGAWVSYFLDGATGGIIVVAQTLLFLLAFVFAPTHGLLANRRRAHKALEDRS

SEQ ID NO: 1813 - DNA, 828 bp, Escherichia coli
atgatgcaatctgcaggcattgtcgttaatgatgttactgtcacctggcgtaacgggcacacagcactgcgcgatgcatccttcacagtaccaagtggatctattgccgctctggttggggtaaacggttccggaaaatcgacgttgtttaaagcgattatgggatttgtgcgtctgaccagcggaaagatatctgttctgggtattcccacgcgacaggcgttacagaaaaacctggttgcctacgtccctcagtcagaagatgttgactggtcatttcctgtactggtggaagatgtggtgatgatgggccgctatgggcatatgggtatgttgcgtatcgccaaaaagagggatcgtcaaattgtcaccgatgcgctggaacgtgtcgatatggtgaattttcgccatcgacaaatcggcgagctttccggtggacaaaagaaacgcgtctttctggcgagagcgattgcacagcagggtgatgtgatcctgctggatgaaccttttaccggcgttgatgtgaaaaccgaagccaaaatcatcagcctgttgagggagttacgcgcggaaggcaaaacgatgcttgtctcaacacacaatctcggatccgtcacgacattttgcgattatacggtcatggtcaaaggcaccgtcctggcaagcgggccgacagacaccacttttacagccgagaacctggagctggcttttagcggcgtactgcgccatgtcacacttaacggctcggaagaaagcattattactgacgatgaacgcccttttgtggctcatcgaccgtcagcggtgcagagggaagaaagatga

SEQ ID NO: 1814 - protein, 275 aa, Escherichia coli
MMQSAGIVVNDVTVTWRNGHTALRDASFTVPSGSIAALVGVNGSGKSTLFKAIMGFVRLTSGKISVLGIPTRQALQKNLVAYVPQSEDVDWSFPVLVEDVVMMGRYGHMGMLRIAKKRDRQIVTDALERVDMVNFRHRQIGELSGGQKKRVFLARAIAQQGDVILLDEPFTGVDVKTEAKIISLLRELRAEGKTMLVSTHNLGSVTTFCDYTVMVKGTVLASGPTDTTFTAENLELAFSGVLRHVTLNGSEESIITDDERPFVAHRPSAVQREER

SEQ ID NO: 1815 - DNA, 915 bp, Escherichia coli
atgcactcgataaaaaaagtaaccatgctcttggggggcctcgcactcacctgctcgatcgcatttcaggcaagtgcaactgaaaaattcaaggtcattacaacatttaccatcatcgcggatatggccaaaaacgtggcgggagatgctgcagaagtctcatccataaccaagcctggtgcagaaattcatgagtatcagcctacccctggcgatattaaacgtgcgcagggggcacaactgattctcgccaatggtatgaatctggaattgtggttccaacgcttttaccagcatctcaatggggttccagaagtaattgtctcttcgggtgtgacgcctgtagggatcaccgaaggaccctatgagggcaaacctaacccccatgcatggatgtcgccagataatgctctgatttacgtcgataatattcgtgatgcgttgataaaatacgatccggcaaatgcacaaacctaccaacgcaatgccgatacttataaagccaagattacccaaacccttgcccccctgcgtaagcagattacggaactccctgagaatcagcgatggatggtcaccagtgaaggggctttttcttatctcgcacgcgatttggggctaaaagagctttatctgtggccgattaatgccgatcaacaaggaacaccgcagcaggtacgtaaggttgttgatatagttaagaaaaatcatatcccggcagtctttagcgagagtacgatttccgataaaccagcgcgtcaggttgcgcgtgaaaccggcgcacactacggcggtgtgctctatgtcgattccctgagcacagaaaacggcccggtaccgacgtatatcgaccttcttaaggttactaccagtacgctggtacagggaattaaagctgggaaaagggagaaataa

SEQ ID NO: 1816 - protein, 304 aa, Escherichia coli
MHSIKKVTMLLGGLALTCSIAFQASATEKFKVITTFTIIADMAKNVAGDAAEVSSITKPGAEIHEYQPTPGDIKRAQGAQLILANGMNLELWFQRFYQHLNGVPEVIVSSGVTPVGITEGPYEGKPNPHAWMSPDNALIYVDNIRDALIKYDPANAQTYQRNADTYKAKITQTLAPLRKQITELPENQRWMVTSEGAFSYLARDLGLKELYLWPINADQQGTPQQVRKVVDIVKKNHIPAVFSESTISDKPARQVARETGAHYGGVLYVDSLSTENGPVPTYIDLLKVTTSTLVQGIKAGKREK

SEQ ID NO: 1817 - DNA, 99 bp, Escherichia coli
ttgcagggagacttacacggtaagcgttattccgaagagcttaaaattgaagcagtcaaacgggttgttgagcgtgtttatgcgctgccatctgattaa

SEQ ID NO: 1818 - protein, 32 aa, Escherichia coli
MQGDLHGKRYSEELKIEAVKRVVERVYALPSD

SEQ ID NO: 1819 - DNA, 771 bp, Escherichia coli
gtgattgatacaatgaaaaccttaagtgggaaagagtttaggaaattatttaatcgttatgagacaggattctatctaagtgagtttgaatacttaaaggactttgatcctttgtttcctgaatgcgtagggaaagaattaaagttgggttataaacgaaaagttgatgtatggtgcgaagaggatgctgcgctatatgcagaatttatagctacaaaagaaaggctgaaaagaggccggttaatcctaaaaataaaccaagtgtggtcgcgtgtatatcctgcttatatttatgcaattgaagaaagaataaatgtcagggcaaaggggagagagtcatttaagtatgaaactgtgcaagaaaaacaatgtaaactttccataatgttagatggtctgaaagaccttgaatgtgaaatagctatgatttcaagtgagtttgaaattgaaaaacactctatgcactatttttatatgatttttgatattgaacgctatataaatgactgcagttactttgttttttctgctgctaaagttgttaaaggcgtgattcaatgcattggttacattgacaaaaataacaaagcaagttgcgatgaattttattcaggcagctatgaatgcttggatgatgatcaggaaacactgaactatttaaatgaatcatgcgcagagggtatagacgctgataaagatctcatcaggaagaatgagttattagccttatccctgaaggaattgtatcaacttctcgtttcaaaaaaataa

SEQ ID NO: 1820 - protein, 256 aa, Escherichia coli
MIDTMKTLSGKEFRKLFNRYETGFYLSEFEYLKDFDPLFPECVGKELKLGYKRKVDVWCEEDAALYAEFIATKERLKRGRLILKINQVWSRVYPAYIYAIEERINVRAKGRESFKYETVQEKQCKLSIMLDGLKDLECEIAMISSEFEIEKHSMHYFYMIFDIERYINDCSYFVFSAAKVVKGVIQCIGYIDKNNKASCDEFYSGSYECLDDDQETLNYLNESCAEGIDADKDLIRKNELLALSLKELYQLLVSKK

SEQ ID NO: 1821 - DNA, 153 bp, Escherichia coli
atgggctggactgaagccgcagacctgattgttaaaggtatggaaggtgcaatcaacgcgaagaccgtaacctatgacttcgaacgtctgatggaaggcgctaaactgctgaaatgttcagagtttggtgacgcgatcatcaagaacatgtaa

SEQ ID NO: 1822 - protein, 50 aa, Escherichia coli
MGWTEAADLIVKGMEGAINAKTVTYDFERLMEGAKLLKCSEFGDAIIKNM

SEQ ID NO: 1823 - DNA, 405 bp, Escherichia coli
atggatcaggtcgttgtttttcaaaagatgtttgagcaagtgagaaaagagcaaaacttctcctggttttattcagaattaaaacatcaccgtattgcacattacatttattatctggctacggataacatcagaattattactcacgatgacacggttttgttattaagaggaaccaggaacctgttaaaagttagtacgaccaagaacccagctaaaataaaagaggccgcattgcttcatattcgcggaaaatctacatttcgggaatactgttcaacactggcaggcgctggcgttttccggtgggttactgatgttaatcataacaaacgcagttactacgccattgataatacgcttttatatattgaagatgtagaaaataataaaccattaatctag

SEQ ID NO: 1824 - protein, 134 aa, Escherichia coli
MDQVVVFQKMFEQVRKEQNFSWFYSELKHHRIAHYIYYLATDNIRIITHDDTVLLLRGTRNLLKVSTTKNPAKIKEAALLHIRGKSTFREYCSTLAGAGVFRWVTDVNHNKRSYYAIDNTLLYIEDVENNKPLI

SEQ ID NO: 1825 - DNA, 648 bp, Escherichia coli
ttgttaaaaccacaacgcagtgaaggcggacaccgactctttgatgaagaagacatacaacgcatcgaagagattaagcgttggataagtaatggcgttcctgtaggcaaagttaaagcattactggaaactaccagccaggatacgcaagatgactggaaccgcctgcaagaagagatgatgtcaattcttcgtatggctaatccagccaaactacgcgcgcgaattatttcactgggtcgagagtacccagtagatcaattgattaatcatgtttaccttcctgttcgccagcgtctcgtgcttgatcacaacacctcccgcattatgagcagtatgtttgacggcgcattaattgaatacgcagcggcctcacttttcgaaatgcgccgtaagcccggtaaagaggccattctgatggcgtggaatgttgaagagagagcacgattgtggctggaagcatggcgtttatcattgtcaggatggcacatttctgttcttgctgatcccattgaatcgccgcgcccggaactgttcccaacgcaaacattgattgtctggacaggcatggcaccaacgagaaggcaaaacgaacttttacaacactggggtgagcaaggttataaagtcatctttcatgccccctaa

SEQ ID NO: 1826 - protein, 215 aa, Escherichia coli
MLKPQRSEGGHRLFDEEDIQRIEEIKRWISNGVPVGKVKALLETTSQDTQDDWNRLQEEMMSILRMANPAKLRARIISLGREYPVDQLINHVYLPVRQRLVLDHNTSRIMSSMFDGALIEYAAASLFEMRRKPGKEAILMAWNVEERARLWLEAWRLSLSGWHISVLADPIESPRPELFPTQTLIVWTGMAPTRRQNELLQHWGEQGYKVIFHAP

SEQ ID NO: 1827 - DNA, 153 bp, Escherichia coli
ttgtacaaagtattattgggtcgtgtagaggcgacggagatttatgatcgcaaggaggaattgtggcttattacagcattggtgatgttgctgaacgttgcgggattaatcctgtcactctccgggcctggcaacgccgctacggtttgttaa

SEQ ID NO: 1828 - protein, 50 aa, Escherichia coli
MYKVLLGRVEATEIYDRKEELWLITALVMLLNVAGLILSLSGPGNAATVC

SEQ ID NO: 1829 - DNA, 1290 bp, Escherichia coli
ttggtattaaaagaaagacacaagaagatatgtctgttaccgtcttactctcgcctcgcccattaccctggattgttaatgcttaccacccttatttatcgtagccatatacgtggcgacgaacctgtcaaaaaaattgaagaaatggtttcgatagcaaatcgcaggaacatgcggtctgacgtaacagggatcttactgtttaatggttctcattttttccagcttctggaaggtccggaagaacaggttcaaatgatatatcgggccatatgccaggatccacggcactataatattgttgaactgttgtgcgattacgcgcctgctcgccgttttggcaaagcaggaatggaattatttgatttacgcctgcacgagcgagatgacgttttacaggccgtattcgacaaaggcacatcaaaatttcagctaacttatgatgacagagcgctacaattttttcgtacttttgtccttgcaactgaacaatcaacctatttcgagattcctgctgaagactcctggctttttatcgctgacggatctgataaagaacttgattcttgtaccctttcatcaaatataaacgaccactttgcctttcatcctattgtcgaccctttatcgcggcggataatcgcttttgaagccattgtgcaaaaaaatgaagacagcccgtcagctatagcggttgggcagcgtaaagacgaggaaatctacacagcggatctcaaaagtaaggcgcttgcatttgcgatggcacacgcacttaagctcggtgataaaatgatttcaatcaatctattacctatgaccctggttaacaaacctgacgcagtctcttttttacttgatgaaataaaggccaatgctctggtacctgaacaaatcatcgttgaatttactgaaagtgaagtcatatctcggtttgatgagtttgccgaagcggttaaatcgctaaaggcggccggtatcagtgtagcaattgatcattttggcgcaggttttgctggtttgttactcctgtcacgcttccagcctgacagaattaaaatcagtcaggaattgattaccaatgttcataaaagcggaccacggcaggcaattattcaggcgatcatgaaatgctgtacatcacttgaaattcaagtctctgctatgggcgtggcaacaccagaagagtggatgtggcttgaatctgcaggaattgagatgtttcagggagatctgttttccaaagctaaattgaatggtatcccttcagttgcgtggccggagaaaaaataa

SEQ ID NO: 1830 - protein, 429 aa, Escherichia coli
MVLKERHKKICLLPSYSRLAHYPGLLMLTTLIYRSHIRGDEPVKKIEEMVSIANRRNMRSDVTGILLFNGSHFFQLLEGPEEQVQMIYRAICQDPRHYNIVELLCDYAPARRFGKAGMELFDLRLHERDDVLQAVFDKGTSKFQLTYDDRALQFFRTFVLATEQSTYFEIPAEDSWLFIADGSDKELDSCTLSSNINDHFAFHPIVDPLSRRIIAFEAIVQKNEDSPSAIAVGQRKDEEIYTADLKSKALAFAMAHALKLGDKMISINLLPMTLVNKPDAVSFLLDEIKANALVPEQIIVEFTESEVISRFDEFAEAVKSLKAAGISVAIDHFGAGFAGLLLLSRFQPDRIKISQELITNVHKSGPRQAIIQAIMKCCTSLEIQVSAMGVATPEEWMWLESAGIEMFQGDLFSKAKLNGIPSVAWPEKK

SEQ ID NO: 1831 - DNA, 681 bp, Escherichia coli
gtgttagcccgctggaaacaacctcacggtggatatatatcacccgcggcatttattccacttgctgaaaaatgcggattaatcgttccgcttacgcaaagcctgatgaatcaggttgccagacagatgaacgctatcgcgagtaaactgccggaaggttttcatattgggattaattttagcgcctcgcatattatttcgccgacgtttgtcgacgagtgcttaaattaccgtgacagttttacccgccgcgatttaaaccttgttctggaagtcaccgagcgtgagccattaaatgttgatgaaagtctggttcagcggttgaacattctgcatgaaaatggttttgtcatcgcgctggatgatttcggtactggttactcagggctttcttatctgcatgacttgcatattgattatatcaaaattgatcatagtttcgttggccgcgtcaacgcagacccagcatcaacccgaattctggattgtgtattggatctggcgcgtaaactttcgatcagtatcgtcgctgaagatgtcgaaacgaaagaacaatttgactatctgaaccaaaataatatcacatttcagcagggttattatttctataaacctgttacatacatcgacctggtcaagattatcctttctaaaccgaaggtgaagattgtggttgagtga

SEQ ID NO: 1832 - protein, 226 aa, Escherichia coli
MLARWKQPHGGYISPAAFIPLAEKCGLIVPLTQSLMNQVARQMNAIASKLPEGFHIGINFSASHIISPTFVDECLNYRDSFTRRDLNLVLEVTEREPLNVDESLVQRLNILHENGFVIALDDFGTGYSGLSYLHDLHIDYIKIDHSFVGRVNADPASTRILDCVLDLARKLSISIVAEDVETKEQFDYLNQNNITFQQGYYFYKPVTYIDLVKIILSKPKVKIVVE

SEQ ID NO: 1833 - DNA, 255 bp, Escherichia coli
ttgtgtgaaagttttgactggattgccattagtagcatgaacaatagtaataatctggattatttcactctctatatcatcttttccattgcatttatgctgatcactctcctggtcatccttattgcaaaacccagcaccgggctgggagaagtgcttgtgacgataaatttgcttaatgccctggtttggctggcgatcaatctggttaatcgattaagggaaagactcgtcagccacagggatcagcactaa

SEQ ID NO: 1834 - protein, 84 aa, Escherichia coli
MCESFDWIAISSMNNSNNLDYFTLYIIFSIAFMLITLLVILIAKPSTGLGEVLVTINLLNALVWLAINLVNRLRERLVSHRDQH

SEQ ID NO: 1835 - DNA, 528 bp, Escherichia coli
atgcgtctgaacgatcgtgcagatgaaacgcgctatatcgatcctgtaactgaacaggagcgttcaagccgattttggctacgtcaaattggcgggcataatgcctggcgtgacagcaacggacagttgagaacgacctcggcacaggccatctggatgggcgtcgatcataatgtgcacacggaagccaatggctcacgtattgagaatgacgcaaataacaatatccagacccgacttggtttccacacctttattcgtactcaggagaaaaacagcggtccgcacggtgacgactttgaaccttttgttgaaatgaacgggatccataacagtaaagattttgctgtctcaataaacggtgtgaaagttgaacaagccggggcgcgtaatctgggggaaattaaacatggcgtaaatggcaatctgaatcctgcggccagcgtctggggtaatgtgggcgtgcagctgggtgataatggctacaatgacaacgcaatgatggtgggcctgaaatataagttctga

SEQ ID NO: 1836 - protein, 175 aa, Escherichia coli
MRLNDRADETRYIDPVTEQERSSRFWLRQIGGHNAWRDSNGQLRTTSAQAIWMGVDHNVHTEANGSRIENDANNNIQTRLGFHTFIRTQEKNSGPHGDDFEPFVEMNGIHNSKDFAVSINGVKVEQAGARNLGEIKHGVNGNLNPAASVWGNVGVQLGDNGYNDNAMMVGLKYKF

SEQ ID NO: 1837 - DNA, 330 bp, Escherichia coli
atgaaaaaatttgctttactggcgggtctgtttgttttcgcaccaatgacctgggcgcaggactacaatattaagaacggtttgccatcagaaacctatattacttgcgcagaagccaacgaaatggcaaaaactgacagcgcacaggttgcagaaattgttgcggtaatgggtaatgccagcgttgccagccgtgatttaaaaattgagcaatctccggaactgagcgccaaagtggtagaaaaactgaatcaggtttgcgctaaagatccgcaaatgctgttgatcacggcaattgatgacaccatgcgtgctatcggcaaaaaataa

SEQ ID NO: 1838 - protein, 109 aa, Escherichia coli
MKKFALLAGLFVFAPMTWAQDYNIKNGLPSETYITCAEANEMAKTDSAQVAEIVAVMGNASVASRDLKIEQSPELSAKVVEKLNQVCAKDPQMLLITAIDDTMRAIGKK

SEQ ID NO: 1839 - DNA, 345 bp, Escherichia coli
ttgaagaaaaaaatacttgccttcgggcttatctcagcattgttctgctccacgccagcgatggcggatatgaatcgcaccacgaaaggtgcattgctaggcgcaggcgttggtttacttactggcaatggtgttaatggcgtactgaaaggtgcagctgttggcgctggtgttggtgcagtaacagaaaaaggccgcgacggtaaaaatgcgcgtaaaggtgcaaaagtgggtgccgccgttggtgctgtcactggcgttctgaccggcaatggcctcgaaggggcgattaaaggtgccgtgattggcggtacgggtggtgcaattctgggtaaaatgaaataa

SEQ ID NO: 1840 - protein, 114 aa, Escherichia coli
MKKKILAFGLISALFCSTPAMADMNRTTKGALLGAGVGLLTGNGVNGVLKGAAVGAGVGAVTEKGRDGKNARKGAKVGAAVGAVTGVLTGNGLEGAIKGAVIGGTGGAILGKMK

SEQ ID NO: 1841 - DNA, 327 bp, Escherichia coli
atggaatcgaaatcagtcgatacccgcagtatatatcgtgaactgggcgcaacgctgagttacaacatgcgtctggggaacggtatggaaattgaaccctggctgaaggcggctgtgcgcaaagaatttgtcgatgataatcgagtgaaagtgaatagtgacggtaattttatcaatgatttgtcgggtagacgtggaatataccaggcaggtattaaagcctcattcagcagtacgttaagcgggcatctcggggtggggtatagccgtggtgccggtgtggagtccccgtggaatgcggtggtcggtgtgaactggtcgttctga

SEQ ID NO: 1842 - protein, 108 aa, Escherichia coli
MESKSVDTRSIYRELGATLSYNMRLGNGMEIEPWLKAAVRKEFVDDNRVKVNSDGNFINDLSGRRGIYQAGIKASFSSTLSGHLGVGYSRGAGVESPWNAVVGVNWSF

SEQ ID NO: 1843 - DNA, 267 bp, Escherichia coli
atggcattactcgatttctttctctcgcggaagaaaaacacagccaacattgcaaaagaacggttgcagattattgttgctgaacgccgtcgcagcgatgcagaaccgcattatctgccgcagttgcgtaaagatattcttgaggtcatttgtaaatatgtacaaattgatcctgagatggtaaccgtacagcttgagcaaaaagatggcgatatttctattcttgagctgaacgtgaccttaccggaagcagaagagctgaaataa

SEQ ID NO: 1844 - protein, 88 aa, Escherichia coli
MALLDFFLSRKKNTANIAKERLQIIVAERRRSDAEPHYLPQLRKDILEVICKYVQIDPEMVTVQLEQKDGDISILELNVTLPEAEELK

SEQ ID NO: 1845 - DNA, 480 bp, Escherichia coli
atggattttgaatttatcgtttgtgactccccggcagggattgaaaccggtgcgttaatggcactctattttgcagacgaagccattattaccaccaatccggaagtctcctcagtacgcgactctgaccgtattttaggcattctggcgtcgaaatcacgccgcgcagaaaatggcgaagagccgattaaagagcacctgctgttaacgcgctataacccaggccgcgtaagcagaggtgacatgctgagcatggaagatgtgctggagatcctgcgcatcaaactcgtcggcgtgatcccagaggatcaatcagtattgcgcgcctctaaccagggtgaaccggtcattctcgacattaacgccgatgcgggtaaagcctacgcagataccgtagaacgtctgttgggagaagaacgtcctttccgcttcattgaagaagagaagaaaggcttcctcaaacgcttgttcggaggataa

SEQ ID NO: 1846 - protein, 159 aa, Escherichia coli
MDFEFIVCDSPAGIETGALMALYFADEAIITTNPEVSSVRDSDRILGILASKSRRAENGEEPIKEHLLLTRYNPGRVSRGDMLSMEDVLEILRIKLVGVIPEDQSVLRASNQGEPVILDINADAGKAYADTVERLLGEERPFRFIEEEKKGFLKRLFGG

SEQ ID NO: 1847 - DNA, 189 bp, Escherichia coli
  n 4, 5, 6, 7, 8: n is any nucleotide
atgnnnnnacagacaacggataacggcaaacagaacacctatttctcctcactggataacatggttgcccagggcaatgttctgcccgttctgtacggtgaaatgcgcgtggggtcacgcgtggtttctcaggagatcagcacggcagacgaaggggatggtggtcaggttgtggtgattggtcgctga

SEQ ID NO: 1848 - protein, 62 aa, Escherichia coli
  Xaa 2, 3: Xaa is any amino acid
MXXQTTDNGKQNTYFSSLDNMVAQGNVLPVLYGEMRVGSRVVSQEISTADEGDGGQVVVIGR

SEQ ID NO: 1849 - DNA, 879 bp, Escherichia coli
  n 860, 861, 862, 863, 864: n is any nucleotide
atgggtaaaggcagcagtaaggggcataccccgcgcgaagcgaaggacaacctgaagtccacgcagttgctgagtgtgatcgatgccatcagcgaagggccggttgaaggtccggtggatggattaaaaagcgtgctgctgaacagtacgccggtgctggacagtgaggggaataccaatatctccggcgtcacggtggtgttccgggcaggtgagcaggagcagacaccgccggagggatttgaatcctccggctccgagacggtgctgggtacggaagtgaaatatgacacgccgatcacccgcaccattacgtcggcaaacatcgaccgtctgcgctttaccttcggtgtgcaggcactggtggaaaccacctcaaagggtgacaggaatccgtcggaagtccgcctgctggttcagatacagcgtaatggtggctgggtgacggaaaaagacatcaccattaagggcaaaaccacctcgcagtatctggcctcggtggtggtgggtaacctgccgccgcgcccgttcaatatccggatgcgcaggatgacgccggacagcaccacagaccagctgcagaacaaaacgctctggtcgtcatacaccgaaatcatcgatgtgaaacagtgctacccgaacacggcactggtcggcgtgcaggtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcannnnncattccattcattaa

SEQ ID NO: 1850 - protein, 292 aa, Escherichia coli
  Xaa 287, 288: Xaa is any amino acid
MGKGSSKGHTPREAKDNLKSTQLLSVIDAISEGPVEGPVDGLKSVLLNSTPVLDSEGNTNISGVTVVFRAGEQEQTPPEGFESSGSETVLGTEVKYDTPITRTITSANIDRLRFTFGVQALVETTSKGDRNPSEVRLLVQIQRNGGWVTEKDITIKGKTTSQYLASVVVGNLPPRPFNIRMRRMTPDSTTDQLQNKTLWSSYTEIIDVKQCYPNTALVGVQVDSEQFGSQQVSRNYHLRGRILQVPSNYNPQTRQYSGIWDGTFKPAYSNNMAWCLWDMLTHPRYGXXHSIH

SEQ ID NO: 1851 - DNA, 1905 bp, Escherichia coli
  n 1878, 1879, 1880, 1881, 1882: n is any nucleotide
atgggtaaaggcagcagtaaggggcataccccgcgcgaagcgaaggacaatctgaagtccacgcagttgctgagtgtgatcgatgccatcagcgaagggccggttgaaggtccggtggatgggttaaaaagcgtgctgctgaacagtacgccggtgctggacagtgaggggaataccaatatctccggtgtcacggtggtgttccgggcaggtgagcaggagcagacaccgccggagggatttgaatcctccggctccgagacggtgctgggtacggaagtgaaatatgacacgccgatcacccggaccatcacgtcggcaaacatcgaccgtctgcgctttaccttcggtgtgcaggcactggtggaaaccacctcaaagggggaccggaatccgtcggaagtccgcctgctggttcagatacagcgtaacggtggctgggtgacggaaaaagacatcaccattaagggcaaaaccacctcgcagtatctggcctcggtggtggtggataacctgccgccgcgcccgtttaatatccggatgcgcaggatgacgccggacagcaccacagaccagctgcagaacaaaacgctctggtcgtcatacaccgaaatcatcgatgtgaaacagtgctacccgaacacggcactggtcggcgtgcaggtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacgttcgtgcaggaccgaccgtcggataaggtgtggacctataaccgcagtaatgtggtgatgccggatgatggcgcgccgttccgctacagcttcagcgccctgaaggaccgccataatgccgttgaggtgaactggattgacccggataacggctgggagacggcgacagagcttgtggaggacacgcaggccattgcccgttacggtcgtaacgtcacgaagatggatgcctttggctgtaccagccgggggcaggcacaccgcgccgggctgtggctgattaaaacggaactgctggaaacgcagaccgtggacttcagcgtgggtgcagaagggcttcgccatgtaccgggcgatgtcattgaaatctgcgatgatgactatgcgggtatcagcaccggcgggcgcgtgctggcggtgaacagccagacccggacgctgacgctcgaccgtgaaatcacgctgccatcctccggcaccacgctgataagcctggttgacggacaggggaatccggtcagcgtggaggtccagtccgtcaccgacggcgtgaaggtgaaagtgagccgtgttcctgacggcgttgcagaatacagcgtgtgggggctgaagctgccgacgctgcgccagcgcctgttccgctgtgtgagtatccgtgagaacgatgacggcacgtatgccatcactgccgtgcagcatgtaccggaaaaagaggccatcgtggataacggggcgcactttgacggcgaccagagcggcacggtgaatggtgtcacgccgccagcggtgcagcacctgaccgcnnnnncattccattcattaattaattaa

SEQ ID NO: 1852 - protein, 634 aa, Escherichia coli
  Xaa 627, 628: Xaa is any amino acid
MGKGSSKGHTPREAKDNLKSTQLLSVIDAISEGPVEGPVDGLKSVLLNSTPVLDSEGNTNISGVTVVFRAGEQEQTPPEGFESSGSETVLGTEVKYDTPITRTITSANIDRLRFTFGVQALVETTSKGDRNPSEVRLLVQIQRNGGWVTEKDITIKGKTTSQYLASVVVDNLPPRPFNIRMRRMTPDSTTDQLQNKTLWSSYTEIIDVKQCYPNTALVGVQVDSEQFGSQQVSRNYHLRGRILQVPSNYNPQTRQYSGIWDGTFKPAYSNNMAWCLWDMLTHPRYGMGKRLGAADVDKWALYVIGQNCDQSVPDGFGGTEPRITCNAWLTTQRKAWDVLSDFCSAMRCMPVWNGQTLTFVQDRPSDKVWTYNRSNVVMPDDGAPFRYSFSALKDRHNAVEVNWIDPDNGWETATELVEDTQAIARYGRNVTKMDAFGCTSRGQAHRAGLWLIKTELLETQTVDFSVGAEGLRHVPGDVIEICDDDYAGISTGGRVLAVNSQTRTLTLDREITLPSSGTTLISLVDGQGNPVSVEVQSVTDGVKVKVSRVPDGVAEYSVWGLKLPTLRQRLFRCVSIRENDDGTYAITAVQHVPEKEAIVDNGAHFDGDQSGTVNGVTPPAVQHLTAXXFHSLIN

SEQ ID NO: 1853 - DNA, 2022 bp, Escherichia coli
atgagtaaaccgttcaaactgaattccgcttttaaaccttctggcgatcagccggaggcgattcgacgtctcgaagaggggctggaagatggcctggcgcaccagacgttacttggcgtgactggctccgggaaaaccttcaccattgccaatgtcattgctgaccttcagcgccctaccatggtacttgcgcccaacaaaacgctggcggcccagctgtatggcgaaatgaaagaattcttcccggaaaacgcggtggaatatttcgtctcctactacgactactatcagccggaggcctatgtaccgagttccgacacctttattgagaaagatgcctcggtaaacgaacatatcgaacagatgcgtttgtccgccaccaaagcgatgctggagcggcgtgatgtggttgtggtggcgtctgtttccgcgatttatggtctgggcgatcctgatttatatctcaagatgatgctccatctcacggtcggtatgattatcgatcagcgcgcgattctgcgccgactggcggagctgcaatacgctcgtaatgatcaggcattccagcgcggtactttccgcgttcgtggtgaggtgatagatatcttcccggcagaatcggatgacattgcacttcgcgtggaactgtttgacgaggaagtggaacgattgtcgttatttgacccgctgaccgggcagattgtttccactattccacgttttaccatctacccgaaaacgcactacgtcacgccgcgcgagcgcatcgtacaggcgatggaagagatcaaagaagaactggccgccagacgcaaagtgctgttggagaacaacaagttgcttgaagagcagcggctgacccagcgtacccagtttgatctggagatgatgaacgagctgggctactgttccgggattgagaactactcgcgcttcctctccggtcgtggaccgggtgagccaccgccgacgctgtttgattacctgcctgccgatgggctgttggtcgtcgatgaatctcacgtcaccattccacaaattggcggcatgtatcgcggtgaccgggcgcgtaaagagactctggtggagtacggcttccgcctgccatcagcgctggataaccgtccgctgaaatttgaagagttcgaagcattagcgccgcaaaccatctatgtttcggcgacgccgggtaattacgagctggaaaaatccggtggcgatgtggtggatcaggtggtgcgtccaacaggcttactcgacccgattatcgaagtgcggccagtggcaacacaggtggatgatcttctttcggagattcgtcagcgagcggcaattaacgaacgcgtactggttacaactctgaccaagcggatggcggaagatctcactgaatatctcgaagaacacggtgagcgcgtgcgttatcttcactcagatatcgacaccgtcgaacgtatggagattatccgcgacttgcgtctgggtgagttcgacgtattggtagggatcaacttactgcgcgaaggtctggatatgccggaagtttcgctggtggcgatcctcgacgctgacaaagaaggcttcctgcgttccgaacgttcgttgatccagaccattggtcgtgcggcacgtaacgttaacggtaaagcgattctctatggcgataagatcaccccatcaatggcgaaagcgattggcgaaaccgaacgtcgccgcgagaaacagcagaagtacaacgaagaacacggcattacgccgcaaggcttgaacaagaaagtggtcgatatcctggcgctggggcagaacattgccaaaaccaaagcgaagggcagaggaaaatcgcgcccgattgttgaaccggataatgtgccgatggatatgtcgcctaaagcgttacagcagaagatccatgaactggaagggttgatgatgcaacacgcgcagaatctggagttcgaagaagcggcgcaaattcgtgaccagttgcatcagttgcgtgagctgtttattgccgcgtcgtga

SEQ ID NO: 1854 - protein, 673 aa, Escherichia coli
MSKPFKLNSAFKPSGDQPEAIRRLEEGLEDGLAHQTLLGVTGSGKTFTIANVIADLQRPTMVLAPNKTLAAQLYGEMKEFFPENAVEYFVSYYDYYQPEAYVPSSDTFIEKDASVNEHIEQMRLSATKAMLERRDVVVVASVSAIYGLGDPDLYLKMMLHLTVGMIIDQRAILRRLAELQYARNDQAFQRGTFRVRGEVIDIFPAESDDIALRVELFDEEVERLSLFDPLTGQIVSTIPRFTIYPKTHYVTPRERIVQAMEEIKEELAARRKVLLENNKLLEEQRLTQRTQFDLEMMNELGYCSGIENYSRFLSGRGPGEPPPTLFDYLPADGLLVVDESHVTIPQIGGMYRGDRARKETLVEYGFRLPSALDNRPLKFEEFEALAPQTIYVSATPGNYELEKSGGDVVDQVVRPTGLLDPIIEVRPVATQVDDLLSEIRQRAAINERVLVTTLTKRMAEDLTEYLEEHGERVRYLHSDIDTVERMEIIRDLRLGEFDVLVGINLLREGLDMPEVSLVAILDADKEGFLRSERSLIQTIGRAARNVNGKAILYGDKITPSMAKAIGETERRREKQQKYNEEHGITPQGLNKKVVDILALGQNIAKTKAKGRGKSRPIVEPDNVPMDMSPKALQQKIHELEGLMMQHAQNLEFEEAAQIRDQLHQLRELFIAAS

SEQ ID NO: 1855 - DNA, 909 bp, Escherichia coli
atgcgcaatcgtacgctggctgatcttgatcgtgtcgttgctctcggcggagggcatggactgggacgcgttctctcatcactttcgtctttgggttctcgtttaacgggtatcgtcaccaccaccgataacggtggctcgacggggcgtattcgccgctcagaaggcggcattgcctggggcgatatgcgcaactgcctcaatcagctgataactgaacccagcgtcgcttccgcaatgtttgaatatcgtttcggcggtaatggcgaactttccgggcacaaccttggaaacctgatgttaaaggcactggatcaccttagcgtgcgacctcttgaagcgatcaatctgattcgaaatctgctgaaagtggacgcacatttgattccgatgtcggagcatcctgttgatctgatggcgattgacgatcaggggcatgaagtatacggcgaggtcaatatcgaccagttaactgcgccgattcaagagttattgttaacgccgaatgtacccgcaacgcgtgaggcggttcacgctatcagtgaagcggatctcatcattattgggcctggcagtttttacaccagcctgatgccaattctgctgctgaaggaaatcgcacaggcattacgccgcacgccagcgccgatggtctatatcggcaatctggggcgtgagttgagtttacctgcggctaatctgaagctggaaagcaagctggcaattatggagcagtatgttggtaaaaaggtaattgatgcggtcatcgtcgggccaaaagaggatgtctcggcggtgaaagagcggattgtgattcaggaagtgctggaggccagcgatattccgtatcgtcatgaccgccagttgttgcatagcgcgctggaaaaggcattacaggctttaggttaa

SEQ ID NO: 1856 - protein, 302 aa, Escherichia coli
MRNRTLADLDRVVALGGGHGLGRVLSSLSSLGSRLTGIVTTTDNGGSTGRIRRSEGGIAWGDMRNCLNQLITEPSVASAMFEYRFGGNGELSGHNLGNLMLKALDHLSVRPLEAINLIRNLLKVDAHLIPMSEHPVDLMAIDDQGHEVYGEVNIDQLTAPIQELLLTPNVPATREAVHAISEADLIIIGPGSFYTSLMPILLLKEIAQALRRTPAPMVYIGNLGRELSLPAANLKLESKLAIMEQYVGKKVIDAVIVGPKEDVSAVKERIVIQEVLEASDIPYRHDRQLLHSALEKALQALG

SEQ ID NO: 1857 - DNA, 1071 bp, Escherichia coli
ttggccgtgacaatgctcgtaaagattgccaccagggcgaaggaagaaatgacttcgcctcccgtatctggaaaggtgtacatggcttcacaactgactgatgcatttgcgcgtaagttttactacttgcgcctgtcgattactgatgtgtgtaactttcgttgcacctactgcctgccggatggttacaagccgagcggcgtcaccaataaaggctttctgaccgtcgatgaaattcgccgggttacgcgcgccttcgccagtctgggcaccgaaaaagtccgtctgacaggtggtgagccatctttacgccgcgactttaccgatatcatcgccgctgtgcgagaaaacgacgctattcgccagatagcggtcaccaccaatggttaccgtctggagcgcgatgtggcgaactggcgcgatgctggacttactggcatcaacgtcagcgtcgacagtctggacgctcgccagtttcatgccattaccgggcaggataaattcaaccaggtcatggcaggaatcgatgctgcatttgaggccggttttgagaaggtcaaagtcaataccgtgctgatgcgtgatgttaatcatcaccagctcgacacctttctgaactggatccagcatcgtcccatccagctgcgtttcatcgaactgatggaaacgggcgagggcatcgagctcttccgtaagcatcacatctctggtcaggttctgcgtaacgagctactgcgtcgcggctggatccaccaattacgtcaacgcagcgacggtcccgcgcaagtcttttgtcatccggattacgccggagagattggccttatcatgccgtatgaaaaagacttctgcgccacttgcaaccgcctgcgcgtttcctccattggtaaactccatctctgcctgtttggtgaaggcggcgttaacctgcgcgatctgctggaagacgatacccagcaacaggcgctggaagcgcgtatttcagcggcgctgcgggagaaaaaacagacccatttcctgcatcaaaataacaccggtattacgcaaaacttatcgtacattggtggctaa

SEQ ID NO: 1858 - protein, 356 aa, Escherichia coli
MAVTMLVKIATRAKEEMTSPPVSGKVYMASQLTDAFARKFYYLRLSITDVCNFRCTYCLPDGYKPSGVTNKGFLTVDEIRRVTRAFASLGTEKVRLTGGEPSLRRDFTDIIAAVRENDAIRQIAVTTNGYRLERDVANWRDAGLTGINVSVDSLDARQFHAITGQDKFNQVMAGIDAAFEAGFEKVKVNTVLMRDVNHHQLDTFLNWIQHRPIQLRFIELMETGEGIELFRKHHISGQVLRNELLRRGWIHQLRQRSDGPAQVFCHPDYAGEIGLIMPYEKDFCATCNRLRVSSIGKLHLCLFGEGGVNLRDLLEDDTQQQALEARISAALREKKQTHFLHQNNTGITQNLSYIGG

SEQ ID NO: 1859 - DNA, 513 bp, Escherichia coli
atgagtcaggtaagcactgaatttatcccgacccgtattgctattcttacggtttctaatcgtcgcggtgaagaagacgatacctccggtcactatctgcgcgactcggcgcaagaagcgggccatcacgttgtcgataaagccattgtgaaagaaaaccgctacgctattcgcgctcaggtatctgcgtggatcgccagcgacgatgtacaagtggtgttgattacgggtggtactggcctgacggaaggagatcaggctcccgaagcgctgctgccgttgttcgaccgtgaagttgaaggttttggtgaagtgttccggatgttgtcgttcgaagagattggcacttccacgttgcaatctcgtgcggtagcgggcgtcgctaacaaaacgctgattttcgccatgccgggttcgaccaaagcgtgccgtaccgcatgggaaaatatcattgcgccgcagctggatgcccgtacgcgtccgtgtaatttccatccacatttgaagaaataa

SEQ ID NO: 1860 - protein, 170 aa, Escherichia coli
MSQVSTEFIPTRIAILTVSNRRGEEDDTSGHYLRDSAQEAGHHVVDKAIVKENRYAIRAQVSAWIASDDVQVVLITGGTGLTEGDQAPEALLPLFDREVEGFGEVFRMLSFEEIGTSTLQSRAVAGVANKTLIFAMPGSTKACRTAWENIIAPQLDARTRPCNFHPHLKK

SEQ ID NO: 1861 - DNA, 486 bp, Escherichia coli
atgtcgcaactgacccatatcaacgccgctggcgaagcgcacatggtggatgtctccgccaaagcggaaaccgtgcgtgaagcgcgcgccgaagcctttgtcaccatgcgcagcgagacgctggcgatgattattgatggtcgccaccacaaaggcgacgtatttgccactgcgcgtatcgccggtattcaggcggcaaaacgcacctgggatctgatcccgctgtgtcacccgctgatgctcagcaaagttgaagtcaatttacaggccgagccggagcacaatcgggtacgtatagaaaccttatgccgcctgaccgggaaaaccggtgtcgaaatggaagcgttaaccgcggcctccgtggcggcgctgaccatttatgacatgtgcaaagcggtgcaaaaagatatggtgattggtccggtacgtttgctggcgaagagcggcggcaagtcgggtgactttaaggtggaagcggatgattaa

SEQ ID NO: 1862 - protein, 161 aa, Escherichia coli
MSQLTHINAAGEAHMVDVSAKAETVREARAEAFVTMRSETLAMIIDGRHHKGDVFATARIAGIQAAKRTWDLIPLCHPLMLSKVEVNLQAEPEHNRVRIETLCRLTGKTGVEMEALTAASVAALTIYDMCKAVQKDMVIGPVRLLAKSGGKSGDFKVEADD

SEQ ID NO: 1863 - DNA, 198 bp, Escherichia coli
atgcaaccgaagtggctgcggatttcccaaccgttgaaagcgttacgccaacatctggctgcgcagagcgatcgctgggcgctggcgctggaagatggcaaattgctggctgctgtcaaccagacgctggtgagttttgaccattcgctgactgacggcgacgaagtggctttcttcccgccggtaaccggaggttaa

SEQ ID NO: 1864 - protein, 65 aa, Escherichia coli
MQPKWLRISQPLKALRQHLAAQSDRWALALEDGKLLAAVNQTLVSFDHSLTDGDEVAFFPPVTGG

SEQ ID NO: 1865 - DNA, 453 bp, Escherichia coli
atggcagaaaccaaaattgttgtcggcccgcagccgttcagcgtaggagaagagtacccgtggctggctgagcgtgacgaagacggtgcggtagtcacctttaccggtaaggtgcgcaaccataacctgggcgacagcgtcaaagcattaaccctcgaacactatccgggaatgacagaaaaagcactggcagaaatcgttgatgaagcgcgtaaccgctggccgctggggcgcgtcacggtaattcaccgcattggtgaattatggccgggcgatgaaattgtttttgtcggtgttaccagtgcgcatcgcagcagtgcgtttgaagccgggcagtttattatggattatctcaaaacccgcgcaccgttctggaagcgcgaagccacgccggaaggcgaccgttgggtcgaagctcgggagagcgatcagcaggcggcaaaacgctggtag

SEQ ID NO: 1866 - protein, 150 aa, Escherichia coli
MAETKIVVGPQPFSVGEEYPWLAERDEDGAVVTFTGKVRNHNLGDSVKALTLEHYPGMTEKALAEIVDEARNRWPLGRVTVIHRIGELWPGDEIVFVGVTSAHRSSAFEAGQFIMDYLKTRAPFWKREATPEGDRWVEARESDQQAAKRW

SEQ ID NO: 1867 - DNA, 132 bp, Escherichia coli
gtgtcgtttttagtaagaaaaaaaatcccgacacatggccgggatattgatggtgaaaaagaattaacggcggttgccgaagatccgcagcaacatcaggaacaggttgatgaagtccagatacaaggttaa

SEQ ID NO: 1868 - protein, 43 aa, Escherichia coli
MSFLVRKKIPTHGRDIDGEKELTAVAEDPQQHQEQVDEVQIQG

SEQ ID NO: 1869 - DNA, 705 bp, Escherichia coli
atggacagattcccacgttctgattcaatcgtacaaccccgggctggcttgcaaacttatatggcgcaagtctatggctggatgaccgttggcttgttgctgacagcatttgttgcctggtatgcggctaattccgcggccgtgatggagctgttgtttactaaccgtgtctttttaatcggtctgatcatcgcgcaattagcattggttattgtgttatcagcgatgattcaaaagctgagcgcaggtgtaacgacgatgctctttatgctttattcggcgctgacgggtcttacgctttccagtattttcattgtctataccgctgcttctatcgccagtactttcgtcgttactgccgggatgttcggcgcaatgagtctgtacggttacaccacgaagcgtgatctaagcggctttggcaatatgctgtttatggcgttaatcggcattgtgctggcatcgctggttaacttctggctgaaaagcgaagcattgatgtgggcagtcacctacatcggcgtgattgtctttgtcggattgacggcgtatgacacccagaaactgaaaaatatgggtgagcagattgatactcgcgacacgtcgaacctgcgcaaatattccattcttggcgcgttaaccttgtatctggacttcatcaacctgttcctgatgttgctgcggatcttcggcaaccgccgttaa

SEQ ID NO: 1870 - protein, 234 aa, Escherichia coli
MDRFPRSDSIVQPRAGLQTYMAQVYGWMTVGLLLTAFVAWYAANSAAVMELLFTNRVFLIGLIIAQLALVIVLSAMIQKLSAGVTTMLFMLYSALTGLTLSSIFIVYTAASIASTFVVTAGMFGAMSLYGYTTKRDLSGFGNMLFMALIGIVLASLVNFWLKSEALMWAVTYIGVIVFVGLTAYDTQKLKNMGEQIDTRDTSNLRKYSILGALTLYLDFINLFLMLLRIFGNRR

SEQ ID NO: 1871 - DNA, 93 bp, Escherichia coli
atgccttatggacgagcggaagcgttttctgtatccataaatgcaaaagtattttgtatgcgtagttttaaatttattgatggtgaatattaa

SEQ ID NO: 1872 - protein, 30 aa, Escherichia coli
MPYGRAEAFSVSINAKVFCMRSFKFIDGEY

SEQ ID NO: 1873 - DNA, 741 bp, Escherichia coli
atgttttttctaaggacaactaaaagaatggaatcatactcgcaaaatagcaataaagtagattttcagcacgaagccaggatattaaacggcatatggctcattaccgctttgggtttggtggcaaccgcagggctggcctggggcgctaagtatctcgaaattacggcaacaaaatatgattcaccgcaaatgtatgttgctataggattattattactttctatgtatggcttaagtaaagatatcaacaagataaataccgccatcgcgggcgtaatatatttgtttttaatctctttggtggcgattgtcgttgcgagtttagcgcctgtatctgccattatcgtcgtgttcagcactgcgggatcgatgtttttaatcagtatgctggcaggtctattgtttaaatttgatcctggttctcaccgttttatcattatgatgacgttgacagggttggccctggtaatcatcgtgaatgccacattaatgagtgaacgacccatttgggtaataagttgcttaatgattgtcttatggtcaggcattatctcgcatggacgaaataagctccttgaactgacaggaaaaagccatagtgaagaattatggagtccggttcgttgtgcttttgtaggtgcattaacactctattactattttatcggcttctttgggattcttgccactatagctataacgcttgtctggcaaaggcatacgcggttttttcattag

SEQ ID NO: 1874 - protein, 246 aa, Escherichia coli
MFFLRTTKRMESYSQNSNKVDFQHEARILNGIWLITALGLVATAGLAWGAKYLEITATKYDSPQMYVAIGLLLLSMYGLSKDINKINTAIAGVIYLFLISLVAIVVASLAPVSAIIVVFSTAGSMFLISMLAGLLFKFDPGSHRFIIMMTLTGLALVIIVNATLMSERPIWVISCLMIVLWSGIISHGRNKLLELTGKSHSEELWSPVRCAFVGALTLYYYFIGFFGILATIAITLVWQRHTRFFH

SEQ ID NO: 1875 - DNA, 957 bp, Escherichia coli
atgagtaaatcacacccgcgctggcgcttagcaaagaaactcctcacctggctgttttttatcgcggtgattgtgttgctggtggtctacgccaaaaaagtggactgggaagaggtctggaaggtcatccgcgactacaatcgcgttgcgctgcttagtgcggtcgggctggtggtcgtcagttatctgatttacggttgctacgacctgctcgcccgtttctactgcggtcacaaactggcgaagcgccaggtgatgctggtgtcgtttatctgctacgccttcaacctgacactcagtacctgggtcggcggcattggtatgcgctatcgtttgtactcccgactggggttaccgggcagcactattacgcggattttttcgctcagtattaccaccaactggctaggctatattttgctagcgggggttatctttaccgcaggcgtggtggagttgccggatcactggtatgtcgatcaaactacgctgcgtattctcggtattggcttactgatgattatcgcggtttatttgtggttttgcgctttcgcgaagcaccgccatatgaccatcaaagggcaaaagctggtgctgccttcgtggaaattcgccctcgcccagatgctgatttccagcgttaactggatggtaatgggagcgattatctggctgttacttggtcaaagcgtaagctatttctttgtagtgggcgtgttgctggttagtagtattgctggcgtcatcgtgcatattccggcgggaattggtgtgctggaagcggtgtttatcgcgctactggctggggagcatacctccaaaggcacaattatcgccgccctgctcgcttaccgtgtgctgtattactttatcccactgctgctggcgctgatctgttacctgttgctggaaagccaggcgaagaagctacgggcgaaaaatgaagcggcgatgtga

SEQ ID NO: 1876 - protein, 318 aa, Escherichia coli
MSKSHPRWRLAKKLLTWLFFIAVIVLLVVYAKKVDWEEVWKVIRDYNRVALLSAVGLVVVSYLIYGCYDLLARFYCGHKLAKRQVMLVSFICYAFNLTLSTWVGGIGMRYRLYSRLGLPGSTITRIFSLSITTNWLGYILLAGVIFTAGVVELPDHWYVDQTTLRILGIGLLMIIAVYLWFCAFAKHRHMTIKGQKLVLPSWKFALAQMLISSVNWMVMGAIIWLLLGQSVSYFFVVGVLLVSSIAGVIVHIPAGIGVLEAVFIALLAGEHTSKGTIIAALLAYRVLYYFIPLLLALICYLLLESQAKKLRAKNEAAM

SEQ ID NO: 1877 - DNA, 1242 bp, Escherichia coli
atgaaatgtagctggcgcgaaggcaataagatccagttgctggaaaacggcgagcaatattatcccgcggtgtttaaggcgattggagaggcacaagaacgcatcattcttgaaacgtttatctggtttgaggatgacgtcggcaaacagctgcatgcggcgctattggcagcagcgcaacgcggggtaaaagcggaagtcttgctggatggctacggttcgccggatctcagcgatgagtttgtcaatgaactgacggcagctggcgtggtgttccgctactacgatccccgccctcgcctttttggtatgcgcaccaatgtgtttcgccggatgcatcgcaaaattgtggtgatcgacgcgcgtatcgcctttattggcgggctgaattactccgccgagcatatgtccagctacggcccggaggccaaacaggattacgcggttcgcctcgaagggccgattgtcgaagatattctccagtttgagctggaaaacctgccaggacagagcgcggcgcgacgctggtggcgacgtcatcataaagcggaagagaaccgccagccgggagaagcgcaggtattgctggtctggcgcgataacgaagaacatcgcgatgatatcgaacgtcactatctgaaaatgctcactcaggcgcggcgggaagtgattatcgccaacgcctacttcttccccggctatcgttttttacacgccttgcgtaaagcggcacggcgcggggtgcggatcaaactgatcattcagggcgaaccggatatgccgattgtcagagtcggcgcacatttgctgtataactatctggttaaaggcggcgttcaggtgtttgagtaccgccgccgcccgctccacggcaaagtggcattgatggacgatcactgggcgacagtagggtccagtaatctcgatccgctcagtttgtcactgaatctcgaagcaaatgtcatcatccacgatcgtaattttaaccagacgctgcgcgataatctgaacggcattatcgccgcagattgtcagcaggtcgatgagaccatgctgccgaaacgcacctggtggaacctgaccaaaagcgtgctggcgttccactttttacgccacttcccggcgctggtgggctggcttccggcgcacacaccacgtctggcgcaggttggtccccccgcacaaccgacaatggaaacgcaggatcgggtagaaactgaaaacacgggggtaaaaccctga

SEQ ID NO: 1878 - protein, 413 aa, Escherichia coli
MKCSWREGNKIQLLENGEQYYPAVFKAIGEAQERIILETFIWFEDDVGKQLHAALLAAAQRGVKAEVLLDGYGSPDLSDEFVNELTAAGVVFRYYDPRPRLFGMRTNVFRRMHRKIVVIDARIAFIGGLNYSAEHMSSYGPEAKQDYAVRLEGPIVEDILQFELENLPGQSAARRWWRRHHKAEENRQPGEAQVLLVWRDNEEHRDDIERHYLKMLTQARREVIIANAYFFPGYRFLHALRKAARRGVRIKLIIQGEPDMPIVRVGAHLLYNYLVKGGVQVFEYRRRPLHGKVALMDDHWATVGSSNLDPLSLSLNLEANVIIHDRNFNQTLRDNLNGIIAADCQQVDETMLPKRTWWNLTKSVLAFHFLRHFPALVGWLPAHTPRLAQVGPPAQPTMETQDRVETENTGVKP

SEQ ID NO: 1879 - DNA, 762 bp, Escherichia coli
atgcccgatcaaacacaacaattttcgttcaaggtgctcaccatcaatattcacaaaggctttaccgcgtttaaccgacgcttcattttgccggaacttcgcgacgccgtgcgtaccgtcagcgccgatattgtttgcctgcaggaagtgatgggcgcgcacgaagttcatccgctgcatgtggaaaactggcccgatacctcgcactacgagtttctcgccgacaccatgtggagcgatttcgcctacggtcgcaatgccgtatacccggaaggacatcacggtaatgcggttctttcacgttatcccattgaacattatgagaatcgtgatgtttcggtcgatggtgcggaaaagcgcggcgtgctctactgccgcattgtgccgccgatgaccgggaaagcgattcatgtgatgtgcgtacatctgggcctgcgtgaggcgcaccgtcaggcgcagcttgcgatgctcgccgaatgggtgaatgagctaccggacggcgaaccggtattggtagcgggtgatttcaacgactggcggcaaaaagctaatcatccgttaaaagtgcaggccgggctggatgagatttttacccgcgcccacggacgcccggcgcgcacgtttccggtgcaatttcctctactacgactggacaggatctacgtcaaaaatgccagcgccagcgcaccaaccgcgttgccgctgcggacatggcgacacctttctgatcatgcccctttaagtgcggagattcatttatga

SEQ ID NO: 1880 - protein, 253 aa, Escherichia coli
MPDQTQQFSFKVLTINIHKGFTAFNRRFILPELRDAVRTVSADIVCLQEVMGAHEVHPLHVENWPDTSHYEFLADTMWSDFAYGRNAVYPEGHHGNAVLSRYPIEHYENRDVSVDGAEKRGVLYCRIVPPMTGKAIHVMCVHLGLREAHRQAQLAMLAEWVNELPDGEPVLVAGDFNDWRQKANHPLKVQAGLDEIFTRAHGRPARTFPVQFPLLRLDRIYVKNASASAPTALPLRTWRHLSDHAPLSAEIHL

SEQ ID NO: 1881 - DNA, 1107 bp, Escherichia coli
atgtttcatcgcttatggacgttaatccgcaaagagttgcagtcgctgctgcgcgaaccgcaaacccgcgcaattctgattttacccgtgctaattcaggtgatcctgttcccgttcgccgccacgctggaagtgaccaacgccaccatcgccatctacgatgaagataacggcgagcactcggtagaacttactcaacgttttgcccgcgccagcgcctttacccatgtgctgctgctgaaaagcccgcaggagatccgcccgaccatcgacacacaaaaggcgttactactggtgcgtttcccggctgacttctcgcgcaaactggataccttccagaccgcgccgttgcagttgatcctcgacgggcgtaactccaacagtgcgcaaattgccgccaactacctgcaacagatcgtcaaaaattatcagcaggagctgctggaaggaaaaccgaaacccaacaacagcgagctggtggtacgcaactggtataacccgaatctcgactacaaatggtttgtggtgccgtcgctgatcgccatgatcaccactatcggcgtaatgatagtcacttcactttccgtcgcccgtgaacgtgaacaaggtacgctcgatcagttgctggtttcgcccctcaccacctggcagatattcatcggcaaagccgtaccggcattaattgtcgccaccttccaggccaccattgtgctggcgattggtatctgggcgtatcaaatccccttcgccggatcgctggcgctgttctacttcacgatggtgatttacggtttatcgctggtgggattcggtctgttgatttcatcactctgttcaacacaacagcaggcgtttatcggcgtgtttgtctttatgatgcccgccattctcctttccggttacgtttcgccggtggaaaacatgccagtgtggctgcaaaatctgacgtggattaaccctattcgccactttacggacattaccaagcagatttatttgaaggatgcgagtctggatattgtgtggaatagtttgtggccgctactggtgataacggccacgacagggtcagcggcgtacgcgatgtttagacgtaaggtgatgtaa

SEQ ID NO: 1882 - protein, 368 aa, Escherichia coli
MFHRLWTLIRKELQSLLREPQTRAILILPVLIQVILFPFAATLEVTNATIAIYDEDNGEHSVELTQRFARASAFTHVLLLKSPQEIRPTIDTQKALLLVRFPADFSRKLDTFQTAPLQLILDGRNSNSAQIAANYLQQIVKNYQQELLEGKPKPNNSELVVRNWYNPNLDYKWFVVPSLIAMITTIGVMIVTSLSVAREREQGTLDQLLVSPLTTWQIFIGKAVPALIVATFQATIVLAIGIWAYQIPFAGSLALFYFTMVIYGLSLVGFGLLISSLCSTQQQAFIGVFVFMMPAILLSGYVSPVENMPVWLQNLTWINPIRHFTDITKQIYLKDASLDIVWNSLWPLLVITATTGSAAYAMFRRKVM

SEQ ID NO: 1883 - DNA, 411 bp, Escherichia coli
atgaagtggcaacaacgtgttcgtgtcgcaactggcctaagttgctggcagattatgttgcatttactggtagtggcgctgctggtggtgggctggatgagtaaaactctggttcacgtcggcgtaggattatgcgcactgtattgtgtcacggtagtgatgatgctggtgtttcagcgccaccccgagcaacgctggcgtgaggtggcagacgtgctggaagagctgaccacgacctggtattttggcgcagcgctgattgttctgtggctgttgtcccgcgtactggaaaacaactttgtgctggcgattgcagggctggcaatccttgccggcccggcggtagtgtctttgctggcgaaagataagaagttacatcaccttacgtctaaacatcgcgtacgccgctga

SEQ ID NO: 1884 - protein, 136 aa, Escherichia coli
MKWQQRVRVATGLSCWQIMLHLLVVALLVVGWMSKTLVHVGVGLCALYCVTVVMMLVFQRHPEQRWREVADVLEELTTTWYFGAALIVLWLLSRVLENNFVLAIAGLAILAGPAVVSLLAKDKKLHHLTSKHRVRR

SEQ ID NO: 1885 - DNA, 1134 bp, Escherichia coli
atgagtaatccgatcctgtcctggcgtcgcgtgcgggcgctgtgcgtcaaagagacacggcagatcgttcgcgatccgagtagctggctgattgcggtagtgatcccactgctactgctgtttatttttggatacggcattaacctcgactccagcaagctgcgcgtcgggattttactggaacagcgtagcgaagcggcgctggatttcacccacaccatgaccggttcgccctacatcgacgccaccatcagcgataaccgtcaggaactgatcgccaaaatgcaggcggggaaaattcgcggtctggtggttattccggtggatttcgccgaacagatggagcgcgccaacgccaccgcaccgattcaggtgatcaccgacggcagtgagccgaataccgctaactttgtgcaggggtatgtcgaagggatctggcagatctggcaaatgcagcgcgcggaggataacgggcagacttttgaaccgcttattgatgtacaaacccgctactggtttaaccccgcggcgataagccagcactttattatccccggtgcggtgaccattatcatgacggtcatcggcgcgattctcacctcgctggtggtagcgcgagaatgggaacgcggcaccatggaggctttgctctctacggagattacccgcacggagctgctgctgtgtaagctgatcccttattactttctcgggatgctggcgatgttgctgtgtatgctggtgtcggtgtttattctcggcgtgccgtatcgcgggtcgctgctgattctgttttttatctccagcctgtttttactcagtaccctggggatggggctgctgatttccacgattacccgcaaccagttcaacgccgctcaggtggccctgaacgcggcttttctgccgtcgattatgctttccggctttatatttcagatagacagtatgcccgcggtgatccgcgcggtgacgtacattgttcccgcacgttatttcgtcagcaccctgcaaagcctgttcctcgccgggaatattccagtggtgctgatagtgaacgtgctgtttttgatcgcttcggcggtgatgtttatcggcctgacgtggctgaaaatcaaacgtcggctggattag

SEQ ID NO: 1886 - protein, 377 aa, Escherichia coli
MSNPILSWRRVRALCVKETRQIVRDPSSWLIAVVIPLLLLFIFGYGINLDSSKLRVGILLEQRSEAALDFTHTMTGSPYIDATISDNRQELIAKMQAGKIRGLVVIPVDFAEQMERANATAPIQVITDGSEPNTANFVQGYVEGIWQIWQMQRAEDNGQTFEPLIDVQTRYWFNPAAISQHFIIPGAVTIIMTVIGAILTSLVVAREWERGTMEALLSTEITRTELLLCKLIPYYFLGMLAMLLCMLVSVFILGVPYRGSLLILFFISSLFLLSTLGMGLLISTITRNQFNAAQVALNAAFLPSIMLSGFIFQIDSMPAVIRAVTYIVPARYFVSTLQSLFLAGNIPVVLIVNVLFLIASAVMFIGLTWLKIKRRLD

SEQ ID NO: 1887 - DNA, 1737 bp, Escherichia coli
atgaatgatgccgttatcacgctgaacggcctggaaaaacgctttccgggcatggacaagcccgccgtcgcaccgctcgactgcaccattcacgccggttatgtgacggggctggttgggccggacggtgcgggcaaaaccacgctgatgcggatgctggcgggattactgaaacccgacagcggcagtgccacggtgattggctttgatccgatcaaaaacgacgctgcgctgcacgccgtgctcggctatatgccgcagaaattcggcctgtatgaagatctgacggtgatggaaaatctcaatctgtacgcggatttgcgcagcgtcaccggcgaggcacggaagcagacttttgctcgcctgctggagtttacatctcttggcccgtttaccggacgcctggcgggcaagctctccggtgggatgaaacaaaaactcggcctggcctgtaccctggtaggcgaaccgaaagtgttgctgctcgatgaacccggcgtcggcgttgaccctatctcacggcgcgaactgtggcagatggtgcatgagctggcgggcgaagggatgttaatcctctggagtacctcgtatctcgacgaagccgagcagtgccgtgacgtgttactgatgaacgaaggcgagctgctgtatcagggagaaccgacggccctgactcaaactatggccggacgcagctttctgatgaccagcccgcacgagggcaaccgcaaactgttgcaacgggcattgaaactgccgcaggtcagcgacggcatgattcaggggaaatcggtacgtctgatcctcaaaaaagagaccacgccagacgatattcgccatgccgacgggatgccggaaatcgacatcaacgaaactacgccgcgttttgaagatgcgtttattgatttgctgggcggtgccggaacctcggaatcgccgctgggcgcaatattacatacggtagaaggcacacccggcgagacggtgatcgaagcgaaggaactaaccaagaaatttggtgattttgccgccaccgatcacgtcaactttgccgttaaacgcggggagatttttggtttgctcggaccaaacggcgcgggtaaatcgaccacctttaagatgatgtgcggtttgctggtaccgacctctggtcaggccctggtgctgggcatggatctgaaagagagttccggtaaagcgcgccagcatctcggctatatggcgcaaaaattttcgctctacggcaacctgacggtcgaacagaatttacgctttttctctggtgtgtatggcttacgcggtcgggcgcagaacgaaaaaatctcccgtatgagcgaggcgttcggcctgaaaagtatcgcctcccacgcgaccgatgaactgccattaggttttaaacagcggctggcgctggcctgttcgctgatgcatgaaccggacattctgtttctcgacgaaccgacgtccggcgttgatcccctcacccgccgtgaattttggctacatatcaacagtatggtagagaaaggcgtcacggtgatggtcaccacccactttatggatgaagcggaatattgcgaccgcatcggcttggtgtaccgcgggaaattaatcgccagcggcacaccggacgatttgaaagcgcagtcggccaacgatgaacaacccgatcccactatggagcaagcctttattcagttgatccacgactgggataaggagcatagcaatgagtaa

SEQ ID NO: 1888 - protein, 578 aa, Escherichia coli
MNDAVITLNGLEKRFPGMDKPAVAPLDCTIHAGYVTGLVGPDGAGKTTLMRMLAGLLKPDSGSATVIGFDPIKNDAALHAVLGYMPQKFGLYEDLTVMENLNLYADLRSVTGEARKQTFARLLEFTSLGPFTGRLAGKLSGGMKQKLGLACTLVGEPKVLLLDEPGVGVDPISRRELWQMVHELAGEGMLILWSTSYLDEAEQCRDVLLMNEGELLYQGEPTALTQTMAGRSFLMTSPHEGNRKLLQRALKLPQVSDGMIQGKSVRLILKKETTPDDIRHADGMPEIDINETTPRFEDAFIDLLGGAGTSESPLGAILHTVEGTPGETVIEAKELTKKFGDFAATDHVNFAVKRGEIFGLLGPNGAGKSTTFKMMCGLLVPTSGQALVLGMDLKESSGKARQHLGYMAQKFSLYGNLTVEQNLRFFSGVYGLRGRAQNEKISRMSEAFGLKSIASHATDELPLGFKQRLALACSLMHEPDILFLDEPTSGVDPLTRREFWLHINSMVEKGVTVMVTTHFMDEAEYCDRIGLVYRGKLIASGTPDDLKAQSANDEQPDPTMEQAFIQLIHDWDKEHSNE

SEQ ID NO: 1889 - DNA, 996 bp, Escherichia coli
atgaaaaaacctgtcgtgatcggactggcggtagtagtacttgccgccgtggttgccggaggctactggtggtatcaaagccgccaggataacggcctgacgctgtatggcaacgtggatattcgtacggtgaatcttagtttccgtgttggggggcgcgttgagtcgctggcggtggacgaaggtgatgcgatcaaagcgggccaggtgctgggcgaactggatcacaagccgtatgagattgccctgatgcaggcgaaagcgggcgtttcggtggctcaggcgcagtatgacctgatgcttgccgggtatcgcgatgaagaaatcgctcaggccgccgcagcggtgaaacaggcgcaagctgcctatgactatgcgcagaacttctataaccgccagcaaggactgtggaaaagccgcaccatttcggcaaatgacctggaaaatgcccgctcctcgcgcgaccaggcgcaggccacgctgaaatcagcgcaggataaattgcgtcagtaccgttccggtaaccgcgaacaggacatcgcccaggcgaaagccagcctcgaacaagcgcaggcgcaactggcgcaggcggagctgaatttgcaggactcaacgttgatagcaccgtctgatggcacgctgttaacgcgcgcggtagagcccggcacggtgcttaatgaaggtggcacggtatttaccgtctcgctgacgcgtccggtgtgggtacgcgcctatgttgatgaacgtaatcttgaccaggcccagccggggcgcaaagtgctgctttataccgatggtcgtccgaacaaaccgtatcacgggcagattggtttcgtttcgccgactgctgaatttaccccgaaaaccgtcgaaacaccggatctgcgtaccgacctcgtctatcgcctgcgtattgtggtgaccgacgccgatgatgcgttacgccagggaatgccggtaacggtgcaattcggtgacgaggcaggacatgaatga

SEQ ID NO: 1890 - protein, 331 aa, Escherichia coli
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPNKPYHGQIGFVSPTAEFTPKTVETPDLRTDLVYRLRIVVTDADDALRQGMPVTVQFGDEAGHE

SEQ ID NO: 1891 - DNA, 672 bp, Escherichia coli
atgaataatcctgccatgacaatcaagggtgaacaggcgaaaaaacagctgattgctgcggcactggcacagtttggtgaatatggaatgaacgccaccacccgcgagatagccgcccaggccgggcagaatatcgcagccatcacctactacttcggttcgaaagaagatttgtacctcgcctgcgcccagtggattgctgattttattggcgagcagttccgtccacacgccgaagaagccgaacgtttgttcgcacaaccacagccggatcgggcagccatccgtgaactgatccttcgcgcctgcagaaacatgattaagctgctcacccaggatgacaccgtcaacctcagcaaatttatctcccgtgagcagctctctcccacggcagcctaccacctggtgcacgaacaggtgattagtccgctacacagtcaccttacacgcctgattgccgcctggaccggctgcgacgctagcgatacccgcatgatccttcatacccatgcgttgattggtgagattctggcgtttcgtcttggcaaagaaactattctgttacgtaccggctggaccgcgttcgatgaagaaaagaccgaactgatcaaccagacggtgacctgtcatattgacctgattttgcaaggattatcgcaaaggagtttgtag

SEQ ID NO: 1892 - protein, 223 aa, Escherichia coli
MNNPAMTIKGEQAKKQLIAAALAQFGEYGMNATTREIAAQAGQNIAAITYYFGSKEDLYLACAQWIADFIGEQFRPHAEEAERLFAQPQPDRAAIRELILRACRNMIKLLTQDDTVNLSKFISREQLSPTAAYHLVHEQVISPLHSHLTRLIAAWTGCDASDTRMILHTHALIGEILAFRLGKETILLRTGWTAFDEEKTELINQTVTCHIDLILQGLSQRSL

SEQ ID NO: 1893 - DNA, 1362 bp, Escherichia coli
atgtctttcgattctttgggtttaagccctgatatcctgcgcgccgttgccgagcagggttaccgtgaacccacccctattcagcagcaggcgatccctgcggtgctggaaggccgcgacctgatggccagcgcccagaccggtaccggcaaaacagcgggctttacgctgccgctgttgcaacacctgatcactcgccagccgcacgccaaagggcgtcgtccggtacgcgcgctcattcttaccccgacccgtgaactggcggcgcagattggcgaaaacgtccgtgattacagcaaatatctgaacattcgttcgctggtggtgtttggcggtgtcagcattaacccacaaatgatgaagttgcgcggcggcgttgatgtgctggtggcaacgccgggacgtctgctggacctggaacatcaaaatgcagtgaagctggatcaggttgaaatcctcgtccttgatgaagctgaccgcatgctcgacatgggctttatccacgatatccgtcgcgtgttaacaaaactgccagcgaagcgccagaacctgttgttctccgcgaccttctctgacgatattaaagccctggcggaaaaactgttgcacaacccgctggaaatcgaagtggcacgccgcaatactgcgtctgatcaggtgacccagcacgttcactttgtcgataagaaacgcaaacgcgaattgctgtcgcatatgattgggaaagggaactggcagcaggtgctggtgtttacccgtaccaaacatggcgctaaccatctggctgaacagcttaataaagacggcatccgtagtgcggcgatccacggtaataaatcgcaaggtgcgcgtactcgtgcgctggccgattttaaatcgggcgatattcgtgtactggtggcaactgacatcgctgcgcgcggtctggatatcgaagagttgccgcacgtcgtcaactatgagttaccaaacgtaccggaagattatgttcaccgtatcgggcgtactggccgtgcggcggcaactggcgaagcattgtcgctggtgtgtgttgatgaacacaaactgctgcgtgatatcgaaaaactgctgaaaaaagagatcccgcgcattgcgattccggggtatgagccggacccgtcaatcaaagccgaaccgatccagaacggtcgccagcaacgtggcggcggtcgtggacagggcggtggtcgcggtcaacagcaaccacgccgtacggaaagtggtgcgaagtctggtaacgcgaagcccgcagaaaaaccgtctcgtcgtctcggcgatgccaaaccggcaggcgaacaacaacgtcgccgccgtccgcgtaaacctgccgctgcgcagtaa

SEQ ID NO: 1894 - protein, 453 aa, Escherichia coli
MSFDSLGLSPDILRAVAEQGYREPTPIQQQAIPAVLEGRDLMASAQTGTGKTAGFTLPLLQHLITRQPHAKGRRPVRALILTPTRELAAQIGENVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGGRGQGGGRGQQQPRRTESGAKSGNAKPAEKPSRRLGDAKPAGEQQRRRRPRKPAAAQ

SEQ ID NO: 1895 - DNA, 306 bp, Escherichia coli
atgagaaaacctgaaatactgtataaacagccaatattgtggcatttttcggttttcaggggtaatggtttttctgtttcgggaaagcggctcgcaataaccagcaggatgatgcgtaaagcgcttcgcgctaaattcgaacaacatgcagaactgcgtacactcttgcgggcaaccgcgtccgcaaaactggttgagcatacgcaaaatgatgcttactggggagatggcggtaatggtcagggcaagaatcgcctggggtaccttttaatggcgttgcgcggacaattggctgcggagaagtaa

SEQ ID NO: 1896 - protein, 101 aa, Escherichia coli
MRKPEILYKQPILWHFSVFRGNGFSVSGKRLAITSRMMRKALRAKFEQHAELRTLLRATASAKLVEHTQNDAYWGDGGNGQGKNRLGYLLMALRGQLAAEK

SEQ ID NO: 1897 - DNA, 2151 bp, Escherichia coli
atggcattaaccgccgcgcttaaagcgcaaattgccgcctggtataaggcgcttcaggaacagatccccgactttattccccgtgcgccgcagcggcagatgattgcggacgtcgccaaaacgctggccggagaagaagggcggcatctggcgattgaagcccctaccggcgttgggaaaacgctctcctatttgatccccggcatcgccattgcccgcgaagagcaaaaaacgctggtggtaagtaccgccaacgtggcattgcaggatcagatctacagcaaagatttaccgctgctgaaaaagatcattcccgatcttaaattcactgccgcttttgggcgtgggcgctacgtttgcccgcgtaatctgacagcgctcgccagcactgagcccacgcaacaggatctgctggcgtttcttgacgatgaactgacgccgaacaatcaggaagagcaaaaacgttgtgcgaagctgaagggcgatctcgacacttataaatgggatggtctgcgcgatcatactgatatcgctatagatgatgatctctggcgtcgtttgagtaccgacaaggccagctgcctcaaccgcaactgttattactatcgcgaatgcccgttttttgtcgctcgtcgggaaattcaggaagcggaagtggtggtggcaaaccatgcgctggtgatggcggcgatggaaagcgaagcggtattgcctgacccgaaaaatttactgctggtgctggacgaaggtcatcacctgccggatgtggcgcgggatgcgctggagatgagcgccgaaatcaccgcgccgtggtatcggctacagctggacttgttcacgaaactggtcgctacctgcatggagcagtttcgcccgaagaccatcccgccgctggcgatccctgaacgtttgaatgcgcattgtgaagagttgtatgagcttatcgcctcgttaaacaacattctcaatctctacatgcctgccgggcaggaggcagagcaccgttttgcgatgggcgaactgccagatgaagtgctggagatctgccagcggctggcaaaactcaccgagatgctgcgtggcctggcggagttatttcttaacgatttaagtgagaaaaccggcagccatgacattgtacgtctgcatcggttgattttgcagatgaaccgcgcattggggatgttcgaggcgcaaagcaaactctggcggctggcgtctctggcgcaatcttccggtgcgccggtgaccaaatgggcgacgcgggaagagcgcgaagggcagctacacctttggtttcactgcgtgggaatacgtgtcagcgatcagctggaaaggctgctgtggcgcagtattccgcacattattgttacctccgcaaccttgcgttcgctgaacagtttttcgcgtttgcaggagatgagtgggctgaaagagaaagcgggcgaccgttttgtggcactggattccccttttaaccactgtgaacagggcaaaattgttattccccggatgcgcgttgagccttccatcgacaacgaagagcagcacattgccgaaatggcggcctttttccgtgaacaggtggagagcaaaaaacatctcggtatgttggtgctgtttgccagcgggcgtgcgatgcagcgctttctcgactatgtgacggatttacgcctgatgttgctggtgcagggcgatcagccacgttatcgcttagttgaactgcaccgcaaacgcgttgccaacggtgagcgtagcgtgctggtgggcttacagtcctttgccgaaggtcttgatctgaaaggcgatctgctcagccaggtgcatatccacaagatcgcttttccgcccatcgacagcccggtggtgatcaccgaaggtgaatggctgaaaagcctcaaccgctatccgtttgaggtgcaaagcctgccgagcgcttcgtttaacctgattcagcaggttgggcgactgattcgaagccacggttgctggggggaagtggttatctacgacaaacgcttgctgacaaaaaattatggcaagcgactactggatgcattaccggtatttccgatagagcaaccggaagtccctgaaggtatagttaaaaagaaagaaaaaacgaaatccccacgccgtcggcggcgttaa

SEQ ID NO: 1898 - protein, 716 aa, Escherichia coli
MALTAALKAQIAAWYKALQEQIPDFIPRAPQRQMIADVAKTLAGEEGRHLAIEAPTGVGKTLSYLIPGIAIAREEQKTLVVSTANVALQDQIYSKDLPLLKKIIPDLKFTAAFGRGRYVCPRNLTALASTEPTQQDLLAFLDDELTPNNQEEQKRCAKLKGDLDTYKWDGLRDHTDIAIDDDLWRRLSTDKASCLNRNCYYYRECPFFVARREIQEAEVVVANHALVMAAMESEAVLPDPKNLLLVLDEGHHLPDVARDALEMSAEITAPWYRLQLDLFTKLVATCMEQFRPKTIPPLAIPERLNAHCEELYELIASLNNILNLYMPAGQEAEHRFAMGELPDEVLEICQRLAKLTEMLRGLAELFLNDLSEKTGSHDIVRLHRLILQMNRALGMFEAQSKLWRLASLAQSSGAPVTKWATREEREGQLHLWFHCVGIRVSDQLERLLWRSIPHIIVTSATLRSLNSFSRLQEMSGLKEKAGDRFVALDSPFNHCEQGKIVIPRMRVEPSIDNEEQHIAEMAAFFREQVESKKHLGMLVLFASGRAMQRFLDYVTDLRLMLLVQGDQPRYRLVELHRKRVANGERSVLVGLQSFAEGLDLKGDLLSQVHIHKIAFPPIDSPVVITEGEWLKSLNRYPFEVQSLPSASFNLIQQVGRLIRSHGCWGEVVIYDKRLLTKNYGKRLLDALPVFPIEQPEVPEGIVKKKEKTKSPRRRRR

SEQ ID NO: 1899 - DNA, 963 bp, Escherichia coli
atggactatcgcaaaatcattaaagagatcgggcgcgggaaaaaccacgcgcgcgatttagaccgggatactgcgcgcggtctgtatgcccatatgctcaatagtgaagtccctgaccttgagttgggcggcgtattgattgcgctacgtatcaaaggggaaggggaagcagagatgctcggcttttacgaagccatgcaaaatcacaccatcaagctgacgccgcctgcaggcaagccgatgccgattgtcatccccagttacaacggcgcgcgtaaacaggccaacctgacgccgttgttggcgattctcctgcacaaactcggttttcccgtggtggttcacggggttagcgaagatccaacccgcgtgctgacagaaaccattttcgaactgatgggtattacgccaacgttgcacggcgggcaggcgcaggcgaagctcgacgaacatcaaccggtgtttatgcctgtcggcgcgttttgcccgccgctggaaaaacaactggcgatgcgctggcggatgggcgtgcgtaacagtgcacataccctggcgaaactggcgacgccatttgccgaaggtgaggcactgcgtctttccagcgtttcgcatccggaatacattggacgcgtcgcgaagttctttagtgatatcggcgggcgggcgctactaatgcatggtactgaaggtgaagtgtatgctaatccgcagcgctgcccgcagatcaatctcattgaccgtgaagggatgcgggtactgtatgaaaaacaggacactgctggtagcgagttactgccacaagcaaaagatccggaaaccacggcgcagtggattgagcgttgccttgctggcagcgaaccgattcccgaatcgctgaaaatccagatggcttgctgcctgatggctacgggtgaagcggcaactatcagcgacggcctggcgcgcgttaatcaggcattttaa

SEQ ID NO: 1900 - protein, 320 aa, Escherichia coli
MDYRKIIKEIGRGKNHARDLDRDTARGLYAHMLNSEVPDLELGGVLIALRIKGEGEAEMLGFYEAMQNHTIKLTPPAGKPMPIVIPSYNGARKQANLTPLLAILLHKLGFPVVVHGVSEDPTRVLTETIFELMGITPTLHGGQAQAKLDEHQPVFMPVGAFCPPLEKQLAMRWRMGVRNSAHTLAKLATPFAEGEALRLSSVSHPEYIGRVAKFFSDIGGRALLMHGTEGEVYANPQRCPQINLIDREGMRVLYEKQDTAGSELLPQAKDPETTAQWIERCLAGSEPIPESLKIQMACCLMATGEAATISDGLARVNQAF

SEQ ID NO: 1901 - DNA, 1086 bp, Escherichia coli
atggtaagtggtcatcgctttgatgctcagacgctgcacagttttattcaggctgtatttcgtcagatgggtagtgaggaacaagaagcgaaattagtcgccgatcatttaatcgcggcaaacctggcagggcatgattcacatggtattggcatgatcccaagctatgtgcgctcctggagtcaggggcatctgcaaattaaccatcatgccaaagtcgttaaagaagcgggggcggcggtcacgctcgatggcgatcgcgcatttggtcaggtcgcggcacacgaagcgatggcgctggggattgagaaagcgcgtcagcacggcattgccgccgtggcgctacataactcgcatcatatcggccgtatcggttactgggcagaacagtgcgcggcggcggggtttgtctctatccactttgttagcgtggtcggtattccaatggtcgcgccgttccacggtcgcgacagccgctttggcaccaatccgttctgtgtggttttccctcgtaaagataatttcccgctgttgctcgattacgccaccagcgccattgcatttggcaaaacccgcgtcgcctggcataaaggcgtccccgtgccgccaggttgcctgattgacgttaacggcgtgccgacgaccaatccggcggtaatgcaggagtcgccgttgggttcgctgttgacctttgccgaacataaaggctacgcccttgcagcgatgtgtgaaattcttggcggggcgctttctggcggtaaaacgacgcatcaggaaacgttacaaaccagtcccgatgccattctcaactgcatgaccactatcattatcaacccggaactgttcggcgcgccggattgtagtgcacagaccgaagcctttgccgagtgggtgaaagcctcgccgcatgatgacgataagccgattttgctaccgggcgagtgggaagtgaacacgcgtcgcgaacggcaggagcaggggattccactggatgcgggaagctggcaggccatttgtgatgcagcgcggcagattggtatgccggaagagacgttgcaggctttctgtcagcagttagccagctaa

SEQ ID NO: 1902 - protein, 361 aa, Escherichia coli
MVSGHRFDAQTLHSFIQAVFRQMGSEEQEAKLVADHLIAANLAGHDSHGIGMIPSYVRSWSQGHLQINHHAKVVKEAGAAVTLDGDRAFGQVAAHEAMALGIEKARQHGIAAVALHNSHHIGRIGYWAEQCAAAGFVSIHFVSVVGIPMVAPFHGRDSRFGTNPFCVVFPRKDNFPLLLDYATSAIAFGKTRVAWHKGVPVPPGCLIDVNGVPTTNPAVMQESPLGSLLTFAEHKGYALAAMCEILGGALSGGKTTHQETLQTSPDAILNCMTTIIINPELFGAPDCSAQTEAFAEWVKASPHDDDKPILLPGEWEVNTRRERQEQGIPLDAGSWQAICDAARQIGMPEETLQAFCQQLAS

SEQ ID NO: 1903 - DNA, 261 bp, Escherichia coli
atgaaaactatcaatactgttgttgctgctatggctctttcaactctgtcatttggcgtgttcgcggcggaaccggtaacggcatcccaggcacagaacatgaataaaatcggcgtggtttctgccgatggcgcatccaccctcgatgccctggaagcgaaactggctgagaaagccgcggcggccggtgccagtggatacagcatcacttctgccaccaacaacaataaattaagcggtactgcggtaatttataagtaa

SEQ ID NO: 1904 - protein, 86 aa, Escherichia coli
MKTINTVVAAMALSTLSFGVFAAEPVTASQAQNMNKIGVVSADGASTLDALEAKLAEKAAAAGASGYSITSATNNNKLSGTAVIYK

SEQ ID NO: 1905 - DNA, 267 bp, Escherichia coli
atggcatccggttgggctaatgatgacgccgtcaacgaacagatcaacagtacaattgaagatgcgattgcccgcgctcggggtgaaattccgcgtggcgaaagcctgtatgaatgtgaagagtgcggtgcccctatcccgcaggcccgtcgggaagccattcctggcgtgcgcttatgcattcattgccaacaggagaaagatttacaaaaaccagcttatacaggatataatcgcagaggttcgaaagacagccagttacgttaa

SEQ ID NO: 1906 - protein, 88 aa, Escherichia coli
MASGWANDDAVNEQINSTIEDAIARARGEIPRGESLYECEECGAPIPQARREAIPGVRLCIHCQQEKDLQKPAYTGYNRRGSKDSQLR

SEQ ID NO: 1907 - DNA, 678 bp, Escherichia coli
atgatgtaccacattcccggcgtgttatcgccacaggacgtcgcccgttttcgcgaacaactggaacaagccgaatgggtggatgggcgcgtcaccaccggcgcacaaggtgcgcaagttaagaacaatcaacaagtagacacccgcagcgccctgtacgccgccctgcaaaatgaggtgctgaacgcggttaaccaacatgctttgttctttgccgcggccttgccgcgtaccctttccacgccgctgtttaatcgctatcagaacaatgaaacctatggttttcatgtggatggcgcagtacgcagccatccacaaaacggctggatgcgcactgacctttctgccacgctgtttttaagcgatccagaaagctacgacggcggcgaactggtcgttaatgacaccttcgggcaacatcgggtaaaactcccggcaggcgatctggtgttgtatccctccagcagcctgcattgcgtgacacccgtaacccgcggcgtgcgagtggcatcatttatgtggatccagtcgatgatccgtgatgataaaaagcgcgccatgctgtttgaactggacaacaatattcagtcgctgaaaagccgctacggcgaaagtgaagagatcctgtcactgctcaatctttatcataatctgctgcgggaatggtcggagatctga

SEQ ID NO: 1908 - protein, 225 aa, Escherichia coli
MMYHIPGVLSPQDVARFREQLEQAEWVDGRVTTGAQGAQVKNNQQVDTRSALYAALQNEVLNAVNQHALFFAAALPRTLSTPLFNRYQNNETYGFHVDGAVRSHPQNGWMRTDLSATLFLSDPESYDGGELVVNDTFGQHRVKLPAGDLVLYPSSSLHCVTPVTRGVRVASFMWIQSMIRDDKKRAMLFELDNNIQSLKSRYGESEEILSLLNLYHNLLREWSEI

SEQ ID NO: 1909 - DNA, 2283 bp, Escherichia coli
atggaaaacaatcgcaatttccctgccagacaatttcattcgctcacgttctttgccggtctttgtattggtattacgcctgtggcgcaggcactcgctgccgaagggcaagctaacgcggatgacacgctggttgtcgaagcatcaacgccttcgctttatgcgccacaacaatctgccgatccgaaattctcgcgtccggtagcggatactacccgcacgatgacggtgatttctgaacaagtgattaaagatcagggtgcaaccaaccttaccgacgcgctcaaaaacgtccccggcgtgggtgcgttttttgcgggtgagaacggtaactccaccactggcgacgccatttatatgcgcggtgccgatacctctaacagtatttatatcgatggcattcgcgatatcggcagcgtctcgcgcgacaccttcaataccgagcaggtcgaagtaattaaagggccgtccggcaccgactacgggcgcagcgcgccgacaggctcgatcaatatgatcagcaaacagccgcgcaatgattccggcattgacgcctccgccagtattggcagcgcctggttccgccgcggcacgctggacgtcaatcaggtcattggtgataccactgcggtgcgcctgaatgtaatgggcgaaaaaacgcacgatgccggacgcgacaaagtcaaaaatgagcgttacggcgtcgccccttctgtcgcttttggccttggtacagcgaatcgtttgtatcttaattatctgcatgtcacccaacacaacacgccagacggcggcattccgaccatcggtttaccgggttattctgccccatctgcgggaacagcggccctgaatcattccggaaaagttgatactcataacttttacggcacggattccgattacgacgattcgaccaccgacaccgctaccatgcgttttgagcacgacatcaacgataacaccaccattcgcaacactacgcgttggtcgcgcgtaaagcaggattacctgatgacggcgattatgggtggagcgtcgaatattacccagcccaccagcgatgtgaatagctggacgtggtcacgtacggcgaataccaaagatgtgagtaacaaaattctcaccaaccagaccaacctgacctcgacgttctataccggcgctatcggtcatgatgtcagtaccggcgtggaatttacccgcgaaacacagactaactatggcgttaatccggtgacgttaccggcggtaaatatttatcatcctgacagcagcattcatcccggtggcctgacgcgcaacggcgcaaacgccaatggtcagacggataccttcgcaatttatgccttcgatacgctgcaaatcacccgtgattttgagctgaacggtgggatccgtctggataattatcatactgaatatgacagtgccaccgcctgcggcggcagcgggcgcggtgccatcacctgccctgctggcgtggcaaaaggttctccggtcaccaccgtcgacaccgccaagtcgggcaatctggtgaactggaaagccggggcgctgtatcacctgacggaaaacggcaatatctatattaactatgccgtttcccagcagccgccgggcggcaacaacttcgcccttgcgcagtctggcagcggtaacagtgccaaccgcaccgattttaaaccgcaaaaagccaacaccagcgagattggcaccaaatggcaggttctggataaacgcctgctacttaccgccgcgctgttccgtactgatattgaaaatgaagttgagcaaaatgatgacgggacttattcgcaatatggtaagaaacgtgtcgaaggctacgagatatccgtggccgggaatatcactcccgcgtggcagatgattggcggctatacccagcaaaaagcaactatcaaaaacggcaaagatgttgcccaggatggttcctcatcgctgccgtataccccggaacacgccttcaccttatggagccagtatcaggcaaccgatgatatttctgttggtgcgggcgcacggtatatcggcagtatgcataaaggttcagacggcgcggtggggacgccagcatttaccgaaggttattgggtcgccgacgccaaactggggtatcgggttaatcgcaatctcgacttccagctaaacgtctacaacctgtttgataccgattacgtcgcctcaatcaataagagcggctaccgttatcacccgggcgagccaagaaccttcttgctcacagccaatatgcatttctga

SEQ ID NO: 1910 - protein, 760 aa, Escherichia coli
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNIYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 1911 - DNA, 105 bp, Escherichia coli
ttgcgattgttttccattttgcaggtgactttttcttatatggtgaaattttcactgtcacgagaaagcatctctgcggatgcgatgccactgttaatcccgtga

SEQ ID NO: 1912 - protein, 34 aa, Escherichia coli
MRLFSILQVTFSYMVKFSLSRESISADAMPLLIP

SEQ ID NO: 1913 - DNA, 405 bp, Escherichia coli
atgcatgtcattgatttgtcttattttgtaaaaacatatcgttcaaaaaataagcacatctctgtcaattttttgcgtcattttcatcgcgcaggcgacctacacttatctggcactacccgttgtatttatgaggatgtcattatgaaaaagtgcctcacactactgattgccaccgtcctgagcggaatctctctcacggcttatgccgcgcaaccgatgagtaacctggacagtggtcaactacggcccgccggtaccgtttcggcaactggcgcatcaaacctaagcgatctggaggataaactggcagaaaaagcgcgcgaacaaggcgcgaaaggttatgtcattaattccgcaggcggaaatgaccagatgttcggtactgcaatcatctacaaataa

SEQ ID NO: 1914 - protein, 134 aa, Escherichia coli
MHVIDLSYFVKTYRSKNKHISVNFLRHFHRAGDLHLSGTTRCIYEDVIMKKCLTLLIATVLSGISLTAYAAQPMSNLDSGQLRPAGTVSATGASNLSDLEDKLAEKAREQGAKGYVINSAGGNDQMFGTAIIYK

SEQ ID NO: 1915 - DNA, 927 bp, Escherichia coli
atgtccgcccagaaaccggggttgcatccgcgcaaccgtcatcacagccgctacgatctcgccacgctttgtcaggtcaatcctgaactcaggcaattcctcacgcttacacccgccggggagcaaagcgtagactttgccaatccgctggcggtgaaggcgctcaataaggcgttgctggcccatttttacgccgtagcgaactgggatatcccggacggttttctctgcccaccagtaccgggtcgggcggattatattcatcaccttgccgatttactggcagaagcaagcggaacaattccagctaatgccagcattctggatatcggcgttggtgcgaactgtatttatccgctgattggcgtacatgaatatggctggcgttttactggtagtgaaaccagcagccaggcgttaagcagtgcgcaggcgatcatcagtgctaatccggggcttaaccgcgccattcgtctgcgtcggcaaaaagagagtggggcgatttttaacggcatcatccataaaaacgagcaatacgatgcgaccttgtgtaacccgccattccacgattccgccgctgcggcacgggcaggtagtgaacgtaaacgccgtaacctggggctgaacaaagacgatgcactgaactttggtggtcagcaacaggagttgtggtgtgaaggcggtgaggtcgcttttatcaaaaagatgattgaagagagcaaaggcttcgcgaagcaggtgatgtggtttacctcgctggtatctcgtggtgaaaacttaccgccgttgtatcgtgctctgacggacgtaggtgcggtgaaggtggtaaaaaaagagatggcccaggggcaaaagcagagccgctttatagcctggacctttatgaacgacgagcagcgccgccgttttgtcaatcgccagcgttaa

SEQ ID NO: 1916 - protein, 308 aa, Escherichia coli
MSAQKPGLHPRNRHHSRYDLATLCQVNPELRQFLTLTPAGEQSVDFANPLAVKALNKALLAHFYAVANWDIPDGFLCPPVPGRADYIHHLADLLAEASGTIPANASILDIGVGANCIYPLIGVHEYGWRFTGSETSSQALSSAQAIISANPGLNRAIRLRRQKESGAIFNGIIHKNEQYDATLCNPPFHDSAAAARAGSERKRRNLGLNKDDALNFGGQQQELWCEGGEVAFIKKMIEESKGFAKQVMWFTSLVSRGENLPPLYRALTDVGAVKVVKKEMAQGQKQSRFIAWTFMNDEQRRRFVNRQR

SEQ ID NO: 1917 - DNA, 2226 bp, Escherichia coli
atgcggtggatcctgttcatcctcttctgcctgttgggcgcacctgcccacgcggtatccatacccggcgttacaaccacaacgacaacggactcaacgactgaaccggccccggaaccggatatcgaacaaaaaaaagcggcctatggcgcactggcggatgtgctggataatgacacctcgcgtaaagagttgatcgaccagttgcgcaccgtcgccgctacgcctcctgcggaacccgtaccgaagatcgtgccgccgacgttggttgaagagcaaaccgtgctgcaaaaagtcaccgaagtcagccgccattatggtgaagccctttccgcccgcttcgggcaactttatcgcaatatcaccggctccccgcataagccgtttaatccacaaaccttcagcaatgcgctgacccacttttcaatgttagcggtattagtgtttggtttttactggctgattcgtctgtgcgcactgccgctgtatcgcaaaatgggccagtgggcgcggcaaaaaaatcgtgagcgcagtaactggttgcagcttccggcgatgatcatcggggcgtttattatcgacctgctgttactggcactgacattatttgtcggccaggtattaagcgacaacctgaatgcgggcagtcgcaccatcgctttccaacaaagtttgtttctcaacgcctttgccctgattgaatttttcaaagccgtactacgcctgattttttgcccaaacgtggctgaactgcgcccgttcacgattcatgacgagaccgcccgttactggagtcgtcgcctgagctggttaagcagcctgattggctatggtctgattgtggctgtgccgattatctctaatcaggtgaatgtacagataggtgcgctggcgaacgtcatcattatgctgtgcatgaccgtctgggcgttgtacctgatttttcgtaataaaaaagagatcacccagcatttgctcaactttgcggagcattcgctggcctttttcagcctgtttatccgcgcctttgcgctggtgtggcactggctggcaagcgcctattttatcgtgctgtttttcttttcgttgttcgatccgggcaacagcctgaaatttatgatgggtgcaacggtgcgcagcctggcgattattggtatcgcagcatttgtttccggtatgttttcccgctggttggcgaaaaccatcaccctctcgccacatactcagcgaaattatccggagctgcaaaaacggctgaatggctggctttcggcggcactgaaaacagcgcgtattctgacagtctgcgtggcggtaatgctgctgttgagcgcatggggattgttcgatttctggaactggctgcaaaacggcgcggggcagaaaaccgtagatatcctgatccgtatcgcactcattcttttcttctcggcggttggctggacggtgctcgccagtttgatagaaaaccggctggcttcggatattcatggccgcccgctacccagcgcccgtacgcgaaccctgctgacgctgttccgtaacgcgctggcggtgattatcagtaccatcaccatcatgattgtgttgtcggaaatcggcgtcaatatcgcgccattgctggcaggtgccggggcattaggtctggctatctcgtttggttcgcaaacgctggtgaaagatattattaccggagtatttattcagtttgaaaacggcatgaacactggagatttggtgactatcgggccgttgaccggcactgtggaacggatgtcgattcgctccgtgggcgtgcgccaggataccggggcgtatcacatcattccgtggtcttcgataaccacctttgctaacttcgtccgcggtattggttcggtagtggcaaactacgatgttgatcgccatgaagatgctgataaagccaatcaggcactgaaagatgcggtagcggaattaatggaaaacgaagaaattcgcgggctgattattggtgaaccgaattttgccgggattgtcggcttaagcaataccgcgtttacactgcgtgtttcgttcaccacgctgccactcaaacagtggacggtacgctttgccctcgacagccaggtgaaaaaacatttcgacctggcgggcgttcgcgcgccagtgcagacttatcaggtgctgcctgctccgggcgcgaccccggctgaaccgttgccgccgggggaaccaacgctttaa

SEQ ID NO: 1918 - protein, 741 aa, Escherichia coli
MRWILFILFCLLGAPAHAVSIPGVTTTTTTDSTTEPAPEPDIEQKKAAYGALADVLDNDTSRKELIDQLRTVAATPPAEPVPKIVPPTLVEEQTVLQKVTEVSRHYGEALSARFGQLYRNITGSPHKPFNPQTFSNALTHFSMLAVLVFGFYWLIRLCALPLYRKMGQWARQKNRERSNWLQLPAMIIGAFIIDLLLLALTLFVGQVLSDNLNAGSRTIAFQQSLFLNAFALIEFFKAVLRLIFCPNVAELRPFTIHDETARYWSRRLSWLSSLIGYGLIVAVPIISNQVNVQIGALANVIIMLCMTVWALYLIFRNKKEITQHLLNFAEHSLAFFSLFIRAFALVWHWLASAYFIVLFFFSLFDPGNSLKFMMGATVRSLAIIGIAAFVSGMFSRWLAKTITLSPHTQRNYPELQKRLNGWLSAALKTARILTVCVAVMLLLSAWGLFDFWNWLQNGAGQKTVDILIRIALILFFSAVGWTVLASLIENRLASDIHGRPLPSARTRTLLTLFRNALAVIISTITIMIVLSEIGVNIAPLLAGAGALGLAISFGSQTLVKDIITGVFIQFENGMNTGDLVTIGPLTGTVERMSIRSVGVRQDTGAYHIIPWSSITTFANFVRGIGSVVANYDVDRHEDADKANQALKDAVAELMENEEIRGLIIGEPNFAGIVGLSNTAFTLRVSFTTLPLKQWTVRFALDSQVKKHFDLAGVRAPVQTYQVLPAPGATPAEPLPPGEPTL

SEQ ID NO: 1919 - DNA, 723 bp, Escherichia coli
gtgattgaatttaaaaacgtctccaagcattttggtccaacccaggtgctgcacaatatcgatttgaacattgctcagggcgaagtcgtggtgattatcgggccgtccggttccggtaaatcgaccctgctgcgctgcatcaacaaactggaagaaatcacctccggcgatctgattgtcgatggcctgaaggttaacgatccgaaagttgatgagcgcctgattcgccaggaagcgggtatggtgttccagcagttttacctcttcccgcatctgacggcgctggaaaacgtcatgtttggcccgctacgcgtgcgtggcgcgaataaagaagaggcggaaaaactggcgcgtgagctcctggcgaaagtcggtctggcagaacgtgcacatcactacccttccgaactttctggtggtcaacagcagcgtgtggcgattgcccgcgcgctggcggtgaagccgaaaatgatgctgtttgatgaaccgacttccgctcttgacccggaactgcgccatgaagtgctgaaggttatgcaggatctggctgaagaagggatgacgatggtgatcgtgacacacgaaatcggttttgccgagaaagtagcttcgcgcctgatctttatcgacaaaggccggattgcggaagatggcgatccgcaggtgttgatcaagaacccaccgagccagcgcttgcaggaatttttgcagcacgtctcttaa

SEQ ID NO: 1920 - protein, 240 aa, Escherichia coli
MIEFKNVSKHFGPTQVLHNIDLNIAQGEVVVIIGPSGSGKSTLLRCINKLEEITSGDLIVDGLKVNDPKVDERLIRQEAGMVFQQFYLFPHLTALENVMFGPLRVRGANKEEAEKLARELLAKVGLAERAHHYPSELSGGQQQRVAIARALAVKPKMMLFDEPTSALDPELRHEVLKVMQDLAEEGMTMVIVTHEIGFAEKVASRLIFIDKGRIAEDGDPQVLIKNPPSQRLQEFLQHVS

SEQ ID NO: 1921 - DNA, 660 bp, Escherichia coli
atgcagtttgactggagtgccatctggcctgccattccgcttctgattgaaggtgccaaaatgaccctgtggatttcggtcctcggtctggctggcggtctggtgatcggattgttggcaggttttgcacgcaccttcggtggttggatagccaaccacgtcgcgctggtctttattgaagtgatccgcggcacacctatcgtcgtccaggtgatgtttatctatttcgccctgccgatggcgtttaacgatttacgcatcgacccgtttactgcggcggtggtcaccatcatgatcaactccggcgcgtacattgcggaaatcacgcgtggtgcggtgctatctattcacaaaggttttcgtgaagcaggactggcgctcggtctttcacgttgggaaaccattcgctacgtcattttaccgctggcactgcgtcgtatgctgccgccgctgggtaaccagtggatcatcagcattaaagacacttcgctgtttattgttatcggcgtggcggaactgacccgtcaggggcaagaaattattgccggtaacttccgcgcccttgagatctggagcgccgtggcggtgttctatctgattattaccctggtgctgagctttattctgcgtcgtctggaaagaaggatgaaaatcctgtga

SEQ ID NO: 1922 - protein, 219 aa, Escherichia coli
MQFDWSAIWPAIPLLIEGAKMTLWISVLGLAGGLVIGLLAGFARTFGGWIANHVALVFIEVIRGTPIVVQVMFIYFALPMAFNDLRIDPFTAAVVTIMINSGAYIAEITRGAVLSIHKGFREAGLALGLSRWETIRYVILPLALRRMLPPLGNQWIISIKDTSLFIVIGVAELTRQGQEIIAGNFRALEIWSAVAVFYLIITLVLSFILRRLERRMKIL

SEQ ID NO: 1923 - DNA, 747 bp, Escherichia coli
atgaagtctgtattaaaagtttcactggctgcactgaccctggcttttgcggtttcttctcatgccgcggataaaaaattagttgtcgcgacggatactgccttcgttccgtttgaatttaaacagggcgataaatacgtgggctttgacgttgatctgtgggctgccatcgctaaagaactgaagctggattacgaactgaagccgatggatttcagtgggatcattccagcactgcaaaccaaaaacgtcgatctggcgctggcgggcattaccatcaccgacgagcgtaaaaaagcgatcgatttctctgacggctactacaaaagcggcctgttagtgatggtgaaagctaacaataacgatgtgaaaagcgtgaaagatctcgacgggaaagtggttgctgtgaagagcggcactggctccgttgattacgcgaaagcaaacatcaaaactaaagatctgcgtcagttcccgaatatcgataacgcctatatggaactgggcaccaaccgcgcagacgccgttctgcacgatacgccaaacattctgtacttcatcaaaaccgccggtaacggtcagttcaaagcggtaggtgactctctggaagcacagcaatacggtattgcgttcccgaaaggtagcgacgagctgcgtgacaaagtcaacggcgcgttgaaaaccctgcgcgagaacggaacttacaacgaaatctacaaaaaatggttcggtactgaaccgaaataa

SEQ ID NO: 1924 - protein, 248 aa, Escherichia coli
MKSVLKVSLAALTLAFAVSSHAADKKLVVATDTAFVPFEFKQGDKYVGFDVDLWAAIAKELKLDYELKPMDFSGIIPALQTKNVDLALAGITITDERKKAIDFSDGYYKSGLLVMVKANNNDVKSVKDLDGKVVAVKSGTGSVDYAKANIKTKDLRQFPNIDNAYMELGTNRADAVLHDTPNILYFIKTAGNGQFKAVGDSLEAQQYGIAFPKGSDELRDKVNGALKTLRENGTYNEIYKKWFGTEPK

SEQ ID NO: 1925 - DNA, 633 bp, Escherichia coli
ttggttttgtttttcacgcttgttaccactattagtgtgataggaacagccagaatagcggaacacatagctggtgctatacttagtctcgttaattactgggacataacatcaagaggatatgaaattatgagtaccgctaaattagttaaatcaaaagcgaccaatctgctttatacccgcaacgatgtctctgacagcgagaaaaaagcaacagtagagttgctgaatcgccaggttatccagtttattgatctttctttgattacgaaacaagcgcactggaacatgcgcggcgctaacttcattgccgtacatgaaatgctggatggcttccgcactgcactgatcgatcatctggataccatggcagaacgtgcagtgcagctgggcggtgtagctctggggaccactcaagttatcaacagcaaaactccgctgaaaagttacccgctggacatccacaacgttcaggatcacctgaaagagctggctgaccgttacgcaatcgtcgctaatgacgtacgcaaagcgattggcgaagcgaaagatgacgacaccgcagatatcctgaccgccgcgtctcgcgacctggataaattcctgtggtttatcgagtctaacatcgaataa

SEQ ID NO: 1926 - protein, 210 aa, Escherichia coli
MVLFFTLVTTISVIGTARIAEHIAGAILSLVNYWDITSRGYEIMSTAKLVKSKATNLLYTRNDVSDSEKKATVELLNRQVIQFIDLSLITKQAHWNMRGANFIAVHEMLDGFRTALIDHLDTMAERAVQLGGVALGTTQVINSKTPLKSYPLDIHNVQDHLKELADRYAIVANDVRKAIGEAKDDDTADILTAASRDLDKFLWFIESNIE

SEQ ID NO: 1927 - DNA, 888 bp, Escherichia coli
atgcctggttcattacgtaaaatgccggtctggttaccaatagtcatattgctcgttgccatggcgtctattcagggtggagcctcgttagctaagtcactttttcctctggtgggcgcaccgggggtcactgcgctgcgtctggcattaggcacgctgatcctcatcgcgttctttaagccatggcgactgcgctttgccaaagagcaacgattaccgctgttgttttacggcgtttcgctgggtggaatgaattatcttttttatctttctattcagacggtaccgctgggtatagcggtggcgctggagttcaccggaccactggcggtggcactgttctcttctcgtcgcccggtagatttcgtctgggttgtgctggcggttcttggtctatggttcctgctaccgctggggcaagacgtttcccatgtcgatttaaccggctgtgcactggcactgggggccggggcttgttgggctatttacattttaagtgggcaacgcgctggagcggaacatggtcctgcgacggtggcaattggttcgttgattgcagcgttaattttcgtgccaattggagcgcttcaggctggtgaagcactctggcactggtcggttattccattgggtctggctgtcgctattctctcgaccgctctgccttattcgctggaaatgattgccctcacccgtttgccaacacgcacatttggtacgctaatgagcatggaaccggcgctggctgccgtttccgggatgattttcctcggagaaacactgacacccatacagctgctggcgctcggcgctatcatcgccgcttcaatgggttctacgctgacagtacgcaaagagagcaaaataaaagaattagacataaattaa

SEQ ID NO: 1928 - protein, 295 aa, Escherichia coli
MPGSLRKMPVWLPIVILLVAMASIQGGASLAKSLFPLVGAPGVTALRLALGTLILIAFFKPWRLRFAKEQRLPLLFYGVSLGGMNYLFYLSIQTVPLGIAVALEFTGPLAVALFSSRRPVDFVWVVLAVLGLWFLLPLGQDVSHVDLTGCALALGAGACWAIYILSGQRAGAEHGPATVAIGSLIAALIFVPIGALQAGEALWHWSVIPLGLAVAILSTALPYSLEMIALTRLPTRTFGTLMSMEPALAAVSGMIFLGETLTPIQLLALGAIIAASMGSTLTVRKESKIKELDIN

SEQ ID NO: 1929 - DNA, 522 bp, Escherichia coli
gtggttatgaaaaaaattgcatgtctttcagcactggccgcagttctggctttcaccgcaggtacttccgtagctgcgacttctactgtaactggcggttacgcacagagcgacgctcagggccaaatgaacaaaatgggcggtttcaacctgaaataccgctatgaagaagacaacagcccgctgggtgtgatcggttctttcacttacaccgagaaaagccgtactgcaagctctggtgactacaacaaaaaccagtactacggcatcactgctggtccggcttaccgcattaacgactgggcaagcatctacggtgtagtgggtgtgggttatggtaaattccagaccactgaatacccgacctacaaacacgacaccagcgactacggtttctcctacggtgctggtctgcagttcaacccgatggaaaacgttgctctggacttctcttacgagcagagccgtattcgtagcgttgacgtaggcacctggattgccggtgttggttaccgcttctaa

SEQ ID NO: 1930 - protein, 173 aa, Escherichia coli
MVMKKIACLSALAAVLAFTAGTSVAATSTVTGGYAQSDAQGQMNKMGGFNLKYRYEEDNSPLGVIGSFTYTEKSRTASSGDYNKNQYYGITAGPAYRINDWASIYGVVGVGYGKFQTTEYPTYKHDTSDYGFSYGAGLQFNPMENVALDFSYEQSRIRSVDVGTWIAGVGYRF

SEQ ID NO: 1931 - DNA, 1584 bp, Escherichia coli
atgaatttaaccctcaaagaatcgcttgttacccgtagccgggtatttagcccgtggactgcgttctactttttacagtcgctattaattaacctcggcttaggttaccccttcagtttgctctacaccgctgcgtttacggctattttgcttttgctatggcgaacattgcctcgcgtacaaaaagttctggtcggtatcagttcgctggtggcggcttgttatttcccttttgctcaggcctacggcgcgcctaacttcaatacattgctggcattgcactccaccaatatggaagagtcgaccgaaatcctgacgatttttccgtggtacagctacctggtcggcatatttatttttgcgctcggcgtaatagcaatcaggcgaaaaaaagagagtgaaaaagcgcgctggaataccttcgacagcctgtgcctggtattcagtgtggcgacattttttgttgctcccgtgcaaaacctggcctggggcggcgtatttaaactgaaagatactggctatccggtatttcgttttgctaaggatgtcatcgtcaataataacgaggtgattgaagagcaagaacggatggcaaaactttccggaatgaaagatacctggacggtcactgccgttaagccgaagtatcagacctatgtggtggtgatcggagaaagcgcgcgtcgcgatgccctcggtgcctttggcggtcactgggacaataccccgtttgccagcagcgttaacggtttgatatttgctgactacattgccgccagtggctccacgcagaaatcgcttggcttaacgctcaatcgcgttgtcgatggcaaaccacagtttcaggataactttgtcaccctggcaaatcgcgcgggcttccagacctggtggttttccaaccagggccaaatcggcgaatacgataccgccatcgccagcatcgccaaacgagcagatgaagtgtacttcctgaaagaaggtaattttgaagcagataaaaacacgaaagacgaagcgttactggatatgaccgctcaagtgctggcgcaagagcactcgcaaccgcagctgattgttctacatctgatgggctcgcatccgcaggcctgcgaccggacacaaggaaaatacgaaacctttgtgcaatcgaaagaaacgtcgtgctatctctataccatgacgcaaacagacaatttactgcgcaagctgtacgatcagttacgcaacagcggcagcagcttctcgctggtttacttttccgaccacggtctggcctttaaagagcgcggcaaagacgtgcaataccttgcccatgatgataagtatcagcaaaatttccaggtgccttttatggtcatttccagcgacgataaagcgcatcgggtgattaaagcccgccgctcggccaatgacttcttaggctttttctcgcagtggacgggaattaaagcgaaggaaataaatatcaaatacccgtttatatctgagaagaaagccgggccgatatacatcaccaacttccagttacagaaggtggattacaaccatctcggaaccgatattttcgacccgaaaccttaa

SEQ ID NO: 1932 - protein, 527 aa, Escherichia coli
MNLTLKESLVTRSRVFSPWTAFYFLQSLLINLGLGYPFSLLYTAAFTAILLLLWRTLPRVQKVLVGISSLVAACYFPFAQAYGAPNFNTLLALHSTNMEESTEILTIFPWYSYLVGIFIFALGVIAIRRKKESEKARWNTFDSLCLVFSVATFFVAPVQNLAWGGVFKLKDTGYPVFRFAKDVIVNNNEVIEEQERMAKLSGMKDTWTVTAVKPKYQTYVVVIGESARRDALGAFGGHWDNTPFASSVNGLIFADYIAASGSTQKSLGLTLNRVVDGKPQFQDNFVTLANRAGFQTWWFSNQGQIGEYDTAIASIAKRADEVYFLKEGNFEADKNTKDEALLDMTAQVLAQEHSQPQLIVLHLMGSHPQACDRTQGKYETFVQSKETSCYLYTMTQTDNLLRKLYDQLRNSGSSFSLVYFSDHGLAFKERGKDVQYLAHDDKYQQNFQVPFMVISSDDKAHRVIKARRSANDFLGFFSQWTGIKAKEINIKYPFISEKKAGPIYITNFQLQKVDYNHLGTDIFDPKP

SEQ ID NO: 1933 - DNA, 468 bp, Escherichia coli
atgagtcgtcgcgcaggtacgccaacagcaaaaaaagtgacgcagttagtgaacgtggaagagcacgttgaagggttccgccaggtcagagaggcgcatcggcgcgagctgattgatgattacgttgagctgatttctgacttgatcagggaagtgggggaagctcgtcaggtggacatggctgctcgtctgggggtttcgcaaccgacggtggctaaaatgcttaagcgactggcaaccatggggctgattgaaatgatcccctggcgtggcgtgtttttaacggcagaaggagagaagctggcgcaggaaagccgcgagcgacatcagatagtcgaaaatttcttgttggtgttgggcgtcagtccggaaatcgcccgtcgcgacgcggaaggtatggagcaccatgttagtgaagagacgctggatgcctttcgtttgtttacccagaaacacggtgccaaatga

SEQ ID NO: 1934 - protein, 155 aa, Escherichia coli
MSRRAGTPTAKKVTQLVNVEEHVEGFRQVREAHRRELIDDYVELISDLIREVGEARQVDMAARLGVSQPTVAKMLKRLATMGLIEMIPWRGVFLTAEGEKLAQESRERHQIVENFLLVLGVSPEIARRDAEGMEHHVSEETLDAFRLFTQKHGAK

SEQ ID NO: 1935 - DNA, 1119 bp, Escherichia coli
atgagcctgccttttttacgcacgctgcaaggcgatcgtttttttcagttattaattcttgttggcatcggattaagttttttcgttccctttgcaccgaaatcctggcctgctgctatcgactggcacaccatcatcaccttaagcggcctgatgctgctgaccaaaggtgtcgagttaagcggttattttgatgtgctggggcgcaaaatggtgcgccgttttgctacggagcgtcggctggcgatgtttatggtactggcggcagcgctgctttctacctttctgaccaacgatgtcgcactgtttatagttgttccgctgactatcacgctaaaaagactgtgtgagattccggttaatcggctgattatttttgaggcgctggcagtcaacgctggttcgctactgacgccaattggcaacccgcaaaatattcttatctggggacgttctggtctttcgtttgccggatttattgcccaaatggcaccgctggctggcgcaatgatgctgacactcctgctgttgtgctggtgttgtttccctggaaaggcgctgcaataccatacgggggtgcaaacgccggagtggaaaccgcggctggtgtggagttgtctggggctgtatatcgtctttctgacggcgctggagttaaaacaagagctgtggggactggtgattgtggcggcgggctttgcgctgctggcgcgtcgtgtggtgctcagtgtggactggacgctgctgctggtgtttatggcgatgtttatcgacgtccatttactaacccaactgccagttttgcagggggtgttaagtaacgtgagtcatttatccgaacccggattatggttaacggcgatcggtttatcgcaggtgatcagtaacgtgccgagtaccattttgctgctcaattatgtgccaccgtctttattactggcatgggcggtaaacgtggggggctttggtttattacccggatcgctggcaaatttgattgcgttacggatggcgaacgatcgccgtatctggtggcgttttcatctttattcgataccgatgctgttgtgggcggcgctggtgggatatgttttgttggttatgatcccggcgggataa

SEQ ID NO: 1936 - protein, 372 aa, Escherichia coli
MSLPFLRTLQGDRFFQLLILVGIGLSFFVPFAPKSWPAAIDWHTIITLSGLMLLTKGVELSGYFDVLGRKMVRRFATERRLAMFMVLAAALLSTFLTNDVALFIVVPLTITLKRLCEIPVNRLIIFEALAVNAGSLLTPIGNPQNILIWGRSGLSFAGFIAQMAPLAGAMMLTLLLLCWCCFPGKALQYHTGVQTPEWKPRLVWSCLGLYIVFLTALELKQELWGLVIVAAGFALLARRVVLSVDWTLLLVFMAMFIDVHLLTQLPVLQGVLSNVSHLSEPGLWLTAIGLSQVISNVPSTILLLNYVPPSLLLAWAVNVGGFGLLPGSLANLIALRMANDRRIWWRFHLYSIPMLLWAALVGYVLLVMIPAG

SEQ ID NO: 1937 - DNA, 921 bp, Escherichia coli
atgaatatgaaattgaaaacattattcgcagcggccttcgctgttgtcggcttttgcagtaccgcctctgcggtaacttatcctctgccaaccgacgggagtcgcctggttggtcagaatcaggtgatcaccattcctgaaggtaacactcagccgctggagtattttgccgccgagtaccagatgggactttccaatatgatggaagcgaacccgggtgtggataccttcctgccgaaaggcggtactgtactgaatattccgcagcagctgatcctgccggataccgttcatgaaggcatcgtcattaacagtgcagagatgcgtctgtattactatccgaaagggaccaacaccgttatcgtgctgccgatcggcattggtcagttaggcaaagacacgcctatcaactggaccaccaaagttgagcgtaaaaaagcaggcccgacctggacgccgaccgctaaaatgcacgcagagtaccgcgctgcgggcgaaccgcttccggcggtcgttccggctggtccggataacccgatggggctgtatgcactctacatcggtcgcctgtacgctatccatggcaccaacgccaacttcggtatcggcctgcgtgtaagtcatggttgtgtgcgtctgcgtaacgaagacatcaaattcctgttcgagaaagtaccggtcggtacccgcgtacagtttattgatgagccggtaaaagcgaccaccgagccagacggcagccgttatattgaagtccataacccgctgtctaccactgaagcccagtttgaaggtcaggaaattgtgccaattaccctgacgaagagcgtgcagacagtgaccggtcagccagatgttgaccaggttgttctggatgaagcgatcaaaaatcgttccgggatgccggttcgtctgaattaa

SEQ ID NO: 1938 - protein, 306 aa, Escherichia coli
MNMKLKTLFAAAFAVVGFCSTASAVTYPLPTDGSRLVGQNQVITIPEGNTQPLEYFAAEYQMGLSNMMEANPGVDTFLPKGGTVLNIPQQLILPDTVHEGIVINSAEMRLYYYPKGTNTVIVLPIGIGQLGKDTPINWTTKVERKKAGPTWTPTAKMHAEYRAAGEPLPAVVPAGPDNPMGLYALYIGRLYAIHGTNANFGIGLRVSHGCVRLRNEDIKFLFEKVPVGTRVQFIDEPVKATTEPDGSRYIEVHNPLSTTEAQFEGQEIVPITLTKSVQTVTGQPDVDQVVLDEAIKNRSGMPVRLN

SEQ ID NO: 1939 - DNA, 1593 bp, Escherichia coli
gtgttagtttccagtaacgtcaccatgcagttcggcagtaagccgttgtttgaaaacatttccgtcaaatttggcggcggcaaccgttacggcctgattggcgcgaacggtagtggtaaatccacctttatgaagatcctcggcggcgacttagagccgacgttgggtaacgtttccctcgatcccaacgagcgcattggtaagctgcgtcaggatcagtttgcctttgaagagttcactgtgctggatacggtgatcatggggcataaagagttgtgggaagtgaagcaggagcgtgaccgcatctatgctttgccggaaatgagtgaagaagacggctataaagtggccgatctggaagtgaaatacggcgaaatggacggttactctgcggaagctcgcgctggtgaactgttgcttggcgtgggaattccagtggaacagcactacggcccgatgagtgaagttgctcctggctggaagctgcgtgtgctgctggcgcaggcgctgtttgctgatccggacattctcctgctcgacgaaccgaccaacaacctcgacatcgacaccattcgctggctggaacaggtgctgaacgagcgtgacagcaccatgatcatcatctcgcacgaccgtcacttccttaacatggtttgtacccacatggcggatctggattacggcgagctgcgcgtttatccgggcaactacgatgagtacatgacggcggcgactcaggcgcgtgaacgtctgctggctgataacgccaagaagaaagcgcagattgctgagttgcaatctttcgttagccgctttagcgccaacgcctcgaaatctcgccaggcaacttcgcgcgcgcgccagattgataaaatcaaactggaagaggtgaaagcctccagccgtcagaacccgttcatccgttttgaacaggataagaaactgttccgtaacgcgctggaagtggaaggtctgactaaagggtttgataacggtccactgtttaaaaatctcaacctgctgctggaagtgggtgaaaaactggctgtactgggtaccaacggcgtcggtaaatcaacgctgctgaaaacgctggtgggcgatctgcaaccggacagcggcaccgtaaaatggtctgagaacgcgcgcattggttactacgcccaggaccatgaatatgagttcgaaaatgatctgaccgtgttcgaatggatgagccagtggaagcaggaaggcgatgacgagcaggcggtacgcagcattctcggtcgtttactgttcagccaggacgacatcaaaaagccagcgaaagtgctttccggtggggagaaagggcggatgctgtttggtaagttaatgatgcagaagccgaacattctgatcatggacgaaccgaccaaccacctggatatggaatctattgagtcgctgaacatggcgctggaactgtatcagggcacgctgatctttgtttcacacgaccgtgagttcgtaagctccctggcgacccgtattctggaaatcaccccggaacgcgtgatcgactttagcggtaattacgaagattacctgcgtagtaaagggatcgagtaa

SEQ ID NO: 1940 - protein, 530 aa, Escherichia coli
MLVSSNVTMQFGSKPLFENISVKFGGGNRYGLIGANGSGKSTFMKILGGDLEPTLGNVSLDPNERIGKLRQDQFAFEEFTVLDTVIMGHKELWEVKQERDRIYALPEMSEEDGYKVADLEVKYGEMDGYSAEARAGELLLGVGIPVEQHYGPMSEVAPGWKLRVLLAQALFADPDILLLDEPTNNLDIDTIRWLEQVLNERDSTMIIISHDRHFLNMVCTHMADLDYGELRVYPGNYDEYMTAATQARERLLADNAKKKAQIAELQSFVSRFSANASKSRQATSRARQIDKIKLEEVKASSRQNPFIRFEQDKKLFRNALEVEGLTKGFDNGPLFKNLNLLLEVGEKLAVLGTNGVGKSTLLKTLVGDLQPDSGTVKWSENARIGYYAQDHEYEFENDLTVFEWMSQWKQEGDDEQAVRSILGRLLFSQDDIKKPAKVLSGGEKGRMLFGKLMMQKPNILIMDEPTNHLDMESIESLNMALELYQGTLIFVSHDREFVSSLATRILEITPERVIDFSGNYEDYLRSKGIE

SEQ ID NO: 1941 - DNA, 816 bp, Escherichia coli
atgagcgtaaaagttatcgtcacagacatggacggtacttttcttaacgacgccaaaacgtacaaccaaccacgttttatggcgcaatatcaggaactgaaaaagcgcggcattgagttcgttgtcgccagcggtaatcagtattaccagcttatttcgttctttcctgagctaaaggatgagatctcttttgtcgcggaaaacggcgcactggtttacgaacatggcaagcagttgttccacggcgaactgacccgacatgaatcgcggattgttattggcgagttgctaaaagataagcaactcaattttgtcgcctgcggtctgcaaagtgcatatgtcagcgaaaatgcccccgaagcattcgtcgcactgatggcaaaacactaccatcgcctgaaacctgtaaaagattatcaggagattgacgacgtactgttcaagttttcgctcaacctgccggatgaacaaatcccgttagtgatcgacaaactgcacatagcgctggatggcattatgaaacccgtcaccagtggttttggctttatcgacttgattattcccggtctacataaagcaaacggtatttcgcggttactgaaacgctgggatctgtcaccgcaaaatgtggtagcgattggcgacagcggtaacgatgcggagatgctgaaaatggcgcgttattcctttgcgatgagcaatgctgcggaaaacattaaacaaatcgcccgttacgctaccgatgataataatcatgaaggcgcgctgaatgtgattcaggcggtgctggaaaataaaccgccgtttaatctttga

SEQ ID NO: 1942 - protein, 271 aa, Escherichia coli
MSVKVIVTDMDGTFLNDAKTYNQPRFMAQYQELKKRGIEFVVASGNQYYQLISFFPELKDEISFVAENGALVYEHGKQLFHGELTRHESRIVIGELLKDKQLNFVACGLQSAYVSENAPEAFVALMAKHYHRLKPVKDYQEIDDVLFKFSLNLPDEQIPLVIDKLHIALDGIMKPVTSGFGFIDLIIPGLHKANGISRLLKRWDLSPQNVVAIGDSGNDAEMLKMARYSFAMSNAAENIKQIARYATDDNNHEGALNVIQAVLENKPPFNL

SEQ ID NO: 1943 - DNA, 2433 bp, Escherichia coli
atgacaacactaaaactggatacgctcagcgaccgcattaaagcgcacaaaaatgcgctggtgcatattgtgaaaccgccggtctgtaccgaacgagcacaacactataccgagatgtatcaacaacatctcgataagccaatcccggtacgtcgcgcgctggcactggcgcatcacctggcgaatcgcaccatctggatcaagcacgatgagttgatcattggcaaccaggcaagcgaagttcgcgccgcgccgatcttcccggaatataccgtctcctggatcgaaaaagagattgatgatctggcagatcgtccgggtgctggttttgcggtgagcgaggagaacaaacgtgttctgcatgaagtgtgcccgtggtggcgcggtcagaccgtacaggatcgctgctacggcatgtttaccgatgagcaaaaaggtctgctggcgaccggcatcattaaagcggagggcaatatgacctccggcgatgcgcacctggcggtgaatttcccgctactgctggaaaaagggcttgatggtctgcgtgagaaagtggcggaacgtcgctcgcgcatcaatctgacggtactggaagatttacatggcgagcaattcctgaaagcgattgatatcgtgctggtggcagtcagtgaacacattgaacgtttcgctgccctggcgcgtgaaatggccgcgaccgaaacccgcgaaagccgtcgcgatgaactgctgacgatagcagaaaactgcgatcttatcgcccaccagccgccgcagactttctggcaggcgctgcaactgtgttacttcatccagttgattttgcagatcgaatctaacggtcactcggtatcgtttggtcgtatggaccagtatctctacccatactatcgccgcgacgttgaactgaaccagacactggatcgcgaacacgccatcgagatgctgcatagctgctggttgaaattgctggaagtgaacaaaatccgctccggctcacactcaaaagcctctgcgggaagtccactgtatcagaacgtcaccattggcgggcaaaatctggttgatggtcaaccgatggacgcggtaaatccactctcttatgcgatcctcgaatcttgcggtcgcctgcgttccactcagcctaacctcagcgtgcgctaccacgcgggaatgagcaacgatttcctcgatgcctgtgttcaggtgatccgctgtggtttcgggatgccggcgttcaacaacgacgaaatcgtcatcccggaatttattaaactcggtattgaaccgcaggacgcttacgactatgcagcgattggttgtatcgaaaccgccgtcggtggcaaatggggctatcgctgtaccggcatgagctttatcaacttcgcccgcgtgatgctggcggcgctggaaggcggtcgtgatgccaccagcggcaaagtgttcctgccacaagaaaaagcgttgtcagcgggtaacttcaacaacttcgatgaagtaatggacgcatgggatacgcaaatccgttactacacgcgtaaatcaatcgaaatcgaatatgtcgtcgataccatgctggaagagaacgtacacgatattctctgctcggcgctggtcgatgactgtattgagcgagcgaaaagtatcaagcaaggcggcgcgaaatatgactgggtttctggcctgcaggtcggcattgctaacctcggcaacagcctggcggcagtgaagaaactggtatttgaacagggcgcgattggtcagcaacagctggctgccgcactggcggatgacttcgacggcctgactcacgagcagctgcgtcagcggctgattaacggtgcgccgaagtacggcaacgacgatgatactgtcgatacgctgctggctcgcgcttatcagacctatatcgacgaactgaagcagtaccataacccgcgctacggtcgtggtccgattggcggcaactattatgcgggcacatcgtctatctccgctaacgtaccgtttggcgcgcagactatggcaacgccggacggacgtaaagcacataccccgctggcagaaggcgctagtccggcctccggtactgaccatctcggccctactgcggtcattggctcggtgggtaaactgcctacggcagcaattctcggcggcgtgctgctcaaccagaaactgaatccggcaacgctggagaatgaatctgacaagcagaaactgatgatcctgctgcgtaccttctttgaagtgcataaaggctggcatattcagtacaacattgtttcccgcgaaacattgctggaggcgaagaaacatccggatcaataccgcgatctggtggtacgcgtagcgggttattccgccttcttcaccgcgctctctccagacgcacaggacgatatcatcgcccgtaccgaacacatgctgtaa

SEQ ID NO: 1944 - protein, 810 aa, Escherichia coli
MTTLKLDTLSDRIKAHKNALVHIVKPPVCTERAQHYTEMYQQHLDKPIPVRRALALAHHLANRTIWIKHDELIIGNQASEVRAAPIFPEYTVSWIEKEIDDLADRPGAGFAVSEENKRVLHEVCPWWRGQTVQDRCYGMFTDEQKGLLATGIIKAEGNMTSGDAHLAVNFPLLLEKGLDGLREKVAERRSRINLTVLEDLHGEQFLKAIDIVLVAVSEHIERFAALAREMAATETRESRRDELLTIAENCDLIAHQPPQTFWQALQLCYFIQLILQIESNGHSVSFGRMDQYLYPYYRRDVELNQTLDREHAIEMLHSCWLKLLEVNKIRSGSHSKASAGSPLYQNVTIGGQNLVDGQPMDAVNPLSYAILESCGRLRSTQPNLSVRYHAGMSNDFLDACVQVIRCGFGMPAFNNDEIVIPEFIKLGIEPQDAYDYAAIGCIETAVGGKWGYRCTGMSFINFARVMLAALEGGRDATSGKVFLPQEKALSAGNFNNFDEVMDAWDTQIRYYTRKSIEIEYVVDTMLEENVHDILCSALVDDCIERAKSIKQGGAKYDWVSGLQVGIANLGNSLAAVKKLVFEQGAIGQQQLAAALADDFDGLTHEQLRQRLINGAPKYGNDDDTVDTLLARAYQTYIDELKQYHNPRYGRGPIGGNYYAGTSSISANVPFGAQTMATPDGRKAHTPLAEGASPASGTDHLGPTAVIGSVGKLPTAAILGGVLLNQKLNPATLENESDKQKLMILLRTFFEVHKGWHIQYNIVSRETLLEAKKHPDQYRDLVVRVAGYSAFFTALSPDAQDDIIARTEHML

SEQ ID NO: 1945 - DNA, 900 bp, Escherichia coli
atgattttcaatattcaacgctactcgacccatgatggccccggtatccgcacggtcgtatttcttaaaggctgttcgctgggttgccgctggtgtcagaacccggaaagccgcgcccgcacgcaggatctgctgtatgacccacgactctgtctggaaggctgtgagctgtgcgctaagaccgcaccggaagtgattgagcgcgcgttgaatggtttgcttattcatcgggaaaagttaaccccggagcattttacggcgctaaccgactgctgcccaacacaggcgttaaccgtgtgtggtgaagtgaaaagcgttgaggagatcatggcaaccgttttgcgcgataaaccgttttacgatcgcagcggcggcggcttaacactttctggcggagaaccgtttatgcagccggaaatggcgatggggctactgcaagccagccacgaagccggtattcatactgcggtagaaacctgtctgcatgtgccgtggaaatatatcgccccttctctgtcctatatcgatctgtttcttgccgatttaaaacacgttgccgacgcgccgtttaaacagtggaccgacggtaacgccgccagggtgctggataacctgaaaaaactcgccgcagccggcaaaaaaatcattatccgcgtgccactgattcagggctttaatgccgacgaaacttctgtgaaagccattaccgattttgccgccgacgagctgcacgttagcgaaattcattttctgccctaccacacactgggcatcaacaaatatcacttacttaatctgccctatgacgccccggaaaaaccgcttgatgcgccagaactgctcgactttgcccagcagtatgcctgccagaaagggttaaccgcgaccttacgaggataa

SEQ ID NO: 1946 - protein, 299 aa, Escherichia coli
MIFNIQRYSTHDGPGIRTVVFLKGCSLGCRWCQNPESRARTQDLLYDPRLCLEGCELCAKTAPEVIERALNGLLIHREKLTPEHFTALTDCCPTQALTVCGEVKSVEEIMATVLRDKPFYDRSGGGLTLSGGEPFMQPEMAMGLLQASHEAGIHTAVETCLHVPWKYIAPSLSYIDLFLADLKHVADAPFKQWTDGNAARVLDNLKKLAAAGKKIIIRVPLIQGFNADETSVKAITDFAADELHVSEIHFLPYHTLGINKYHLLNLPYDAPEKPLDAPELLDFAQQYACQKGLTATLRG

SEQ ID NO: 1947 - DNA, 735 bp, Escherichia coli
gtgcgtcaactgttcagagagttttcccgtgatagtctacattcagacaaaaagtacattttgaggatggttatggaactgtatctggatacttcagacgttgttgcggtgaaggcgctgtcacgtatttttccgctggcgggtgtaaccactaacccaagcattatcgcagcgggtaaaaaaccgctggaggttgtgcttccgcaacttcacgaggcgatgggcggtcaggggcgtctgtttgcccaggtaatggctaccactgctgaagggatggtgaatgacgcacgtaaattgcgttctattattgcggatatcgtggtgaaagttccggtgaccgctgaggggctggcagctattaagatgttaaaagcggaagggattccgacgctgggaaccgcggtatatggcgcagcacaagggctactgtcggcgctggcaggtgcggaatatgttgcgccttacgttaatcgtattgatgctcagggcggtagcggtattcagactgtgaccgacttacaccagttattgaaaatgcatacgccgcaggcgaaagtgttagccgcgagtttcaaaaccccgcgtcaggcgctggactgcttactggcagggggtgaatcaattactctgccgctggatgtggcacaacagatgattagctatccggcagttgatgccgctgtggcgaagtttgagcaggactggcaaggagcgtttggcagaacgtcgatttaa

SEQ ID NO: 1948 - protein, 244 aa, Escherichia coli
MRQLFREFSRDSLHSDKKYILRMVMELYLDTSDVVAVKALSRIFPLAGVTTNPSIIAAGKKPLEVVLPQLHEAMGGQGRLFAQVMATTAEGMVNDARKLRSIIADIVVKVPVTAEGLAAIKMLKAEGIPTLGTAVYGAAQGLLSALAGAEYVAPYVNRIDAQGGSGIQTVTDLHQLLKMHTPQAKVLAASFKTPRQALDCLLAGGESITLPLDVAQQMISYPAVDAAVAKFEQDWQGAFGRTSI

SEQ ID NO: 1949 - DNA, 726 bp, Escherichia coli
atgctgcgctacaaccggcaaatcatcctgcgtggttttgattttgacggtcaggaagcgctgaaggattctcgcgtgttggtggtggggcttggtggcctcggctgtgcggcatcgcaatatctggcaagcgccggtgtcggcaacctgacgctgctcgacttcgacacggtttcgctctccaatctgcaacgccagacgctgcacagtgatgccacggtcgggcaaccaaaggtggaatccgcccgtgacgccctgacgcggatcaacccacatatcgcgattacgccagtcaatgcgctgcttgatgacgctgaacttgctgcgatgattgcaaaacacgatctggtgctcgactgtacggataacgttgcggtacgtaatcaactgaacgcaggctgttttgccgcgaaggtgccgctggtttccggcgcggcaattcgtatggaagggcaaatcacggtcttcacttatcaggacggcgaaccgtgctatcactgccttagccgtttgtttggcgagaacgcgttaacctgcgtagaagcaggcgtgatggcaccgttaatcggcgtaattggttcattgcaggcaatggaagcgattaaactgctggccggttatggcaaacctgccagcggaaaaatcgtgatgtacgatgcgatgacctgtcagtttcgcgaaatgaaactgatgcgtaatccggggtgtgaggtgtgcgggcagtaa

SEQ ID NO: 1950 - protein, 241 aa, Escherichia coli
MLRYNRQIILRGFDFDGQEALKDSRVLVVGLGGLGCAASQYLASAGVGNLTLLDFDTVSLSNLQRQTLHSDATVGQPKVESARDALTRINPHIAITPVNALLDDAELAAMIAKHDLVLDCTDNVAVRNQLNAGCFAAKVPLVSGAAIRMEGQITVFTYQDGEPCYHCLSRLFGENALTCVEAGVMAPLIGVIGSLQAMEAIKLLAGYGKPASGKIVMYDAMTCQFREMKLMRNPGCEVCGQ

SEQ ID NO: 1951 - DNA, 1236 bp, Escherichia coli
atggaatttaccaccggattgatgtcgctcgacaccgcgcttaatgagatgctttctcgcgttaccccactgaccgcccaggaaacgctgccactggttcagtgttttggtcgtattctggcgagtgatgtcgtttcgccactggatgtcccggggtttgataactccgctatggacggctacgcggtgcgtttagccgatattgcctccgggcaaccgctgcccgttgccggtaaatcctttgccggtcagccgtaccatggtgaatggcctgcgggtacctgcattcgtattatgaccggtgcgccggtgccggaaggctgcgaagcggtggtgatgcaggagcagactgaacaaacggacaatggcgtgcgttttactgctgaagcgcgtagcgggcaaaatattcgccgtcgcggtgaagatatctctgcaggtgcggttgttttcccggcggggactcgcctgactaccgctgaactgccagtgattgcttcgctagggattgccgaagttccggtgattcgtaaagtgcgtgtagcgcttttttctaccggtgatgaactccagttgcccggtcagccgttgggcgacggccaaatctacgataccaaccgtctcgccgtacacctgatgttagaacagttgggatgcgaggtaatcaacttagggattatccgcgacgatccccatgccctgcgcgccgcatttattgaagccgacagccaggcggatgtagtgatcagttccggcggtgtttcagtgggtgaagcggattacaccaaaacgattcttgaagagctgggggagatcgccttctggaaactggcgattaaaccgggtaaaccgttcgcgttcggtaaactttctaatagttggttctgcggcctgccgggcaacccggtttcagcgacgctgaccttctatcaactggtacagcctttgctggcaaaactaagcggcaataccgccagtggcctgcccgcgcgccagcgtgtacgcacagcgtcccgcctgaaaaaaacgccaggacgccttgatttccagcgcggcgtgctgcaacgcaacgccgatggcgaactggaagtgacgaccaccggacatcagggttcacatatatttagctcctttagcctcggcaactgctttatcgtgctggaacgcgagcgcggcaatgttgacgtgggcgaatgggtggaagtcgaaccgtttaacgcgttgttcggaggcctgtaa

SEQ ID NO: 1952 - protein, 411 aa, Escherichia coli
MEFTTGLMSLDTALNEMLSRVTPLTAQETLPLVQCFGRILASDVVSPLDVPGFDNSAMDGYAVRLADIASGQPLPVAGKSFAGQPYHGEWPAGTCIRIMTGAPVPEGCEAVVMQEQTEQTDNGVRFTAEARSGQNIRRRGEDISAGAVVFPAGTRLTTAELPVIASLGIAEVPVIRKVRVALFSTGDELQLPGQPLGDGQIYDTNRLAVHLMLEQLGCEVINLGIIRDDPHALRAAFIEADSQADVVISSGGVSVGEADYTKTILEELGEIAFWKLAIKPGKPFAFGKLSNSWFCGLPGNPVSATLTFYQLVQPLLAKLSGNTASGLPARQRVRTASRLKKTPGRLDFQRGVLQRNADGELEVTTTGHQGSHIFSSFSLGNCFIVLERERGNVDVGEWVEVEPFNALFGGL

SEQ ID NO: 1953 - DNA, 966 bp, Escherichia coli
atgggcaaagcagtcattgcaattcatggtggcgcaggtgcaattagccgcgcgcagatgagtctgcaacaggaattacgctacatcgaggcgttgtctgccattgttgaaaccgggcagaaaatgctggtagcgggcgaaagtgcgctggatgtggtgacggaagcggtgcgtctgctggaagagtgtccactgtttaacgccggaattggcgctgtctttacgcgtgatgaaacccatgaactggacgcctgtgtgatggatggtaacaccctgaaagccggtgcggtggcgggcgttagtcatctgcgtaatccggttcttgccgcccgactggtgatggagcaaagcccgcatgtgatgatgattggcgaaggggcagaaaattttgcgtttgctcatggcatggagtgcgtctcgccggagattttctccacgcctttgcgttatgaacaactactggcagcgcgcgaggaaggggcaacagtcctcgaccatagcggtgcgccactggatgaaaaacaaaaaatgggcaccgtaggggccgtggcgttggatttagacggcaatctggcggcagccacgtccacgggcggaatgaccaataaattacccggacgagttggcgatagtcccttagtgggggccggatgctatgccaataacgccagtgtggcggtttcctgtaccggtacgggcgaagtcttcatccgcgcgctggcggcatatgatatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtga

SEQ ID NO: 1954 - protein, 321 aa, Escherichia coli
MGKAVIAIHGGAGAISRAQMSLQQELRYIEALSAIVETGQKMLVAGESALDVVTEAVRLLEECPLFNAGIGAVFTRDETHELDACVMDGNTLKAGAVAGVSHLRNPVLAARLVMEQSPHVMMIGEGAENFAFAHGMECVSPEIFSTPLRYEQLLAAREEGATVLDHSGAPLDEKQKMGTVGAVALDLDGNLAAATSTGGMTNKLPGRVGDSPLVGAGCYANNASVAVSCTGTGEVFIRALAAYDIAALMDYGGLSLAEACERVVMEKLPALGGSGGLIAIDHEGNVALPFNTEGMYRAWGYAGDTPTTGIYREKGDTVATQ

SEQ ID NO: 1955 - DNA, 1839 bp, Escherichia coli
gtgctggcggttgaaaatctgaatattgcctttatgcaggagcagcacaaaatagctgcggtccgcaatctctcttttagcctgcaacgtggtgagacgctggcaattgttggcgaatccggctccggtaagtcagtgactgcgctggcattgatgcgcctgttggaacaggcgggcggtttagtgcagtgcgataaaatgctgttgcagcggcgcagtcgcgaagtaattgaacttagcgagcagagtgctgcacaaatgcgccatgtgcgcggggcggatatggcgatgatatttcaggagccgatgacatcgctgaacccggtatttactgtgggtgaacagattgctgaatctattcgtctgcatcagaacgccagtcgtgaagaagcgatggtcgaggcgaagcggatgctggatcaggtacgcattccggaggcacaaaccattctttcacgttatccgcatcaactctctggcgggatgcgccagcgagtgatgattgcgatggcgctgtcatgccgcccggcggtgctgattgccgatgagccaaccaccgcgttggatgtcactattcaggcgcagatcctgcaattaatcaaagtattgcaaaaagagatgtcgatgggcgttatctttatcactcacgatatgggcgtggtggcagagattgccgatcgggtactggtgatgtatcagggcgaggcggtggaaacgggtagcgtcgaacagatttttcatgcaccgcaacatccttatacccgtgcgctgttagctgctgttccgcaacttggtgcgatgaaagggttagattatccccgacgtttcccattgatatcgcttgaacatccagcgaaacaggagccacccatcgagcagaaaacggtggtggatggcgaacctgttttacgggtgcgtaatctggtctcccgtttccctttgcgcagcggtttgttgaatcgcgtaacgcgggaagtgcatgccgttgagaaagtcagttttgatctctggcctggtgaaacgctatcgctggtgggcgagtctggcagcggtaaatccaccaccgggcgggcgttgctgcgcctggtcgaatcgcagggcggcgaaattatctttaacggtcagcgaatcgataccttgtcacccggtaaacttcaggcattgcgccgcgatattcagtttatttttcaggacccttacgcttcgctggacccacgtcagaccatcggtgattcgattctcgaaccgctgcgcgtacacggtttattgccaggtaaagaagcggctgcacgcgttgcgtggttgctggagcgcgtgggcctgttaccggaacatgcctggcgttacccacatgagttttccggcggtcagcgccagcgcatctgcattgctcgcgcgttggcattgaatccaaaagtgatcattgccgacgaagccgtttcggcgctggatgtttctattcgcgggcagattatcaacttgttgctcgatctccagcgtgatttcggcattgcgtatctgtttatctcccacgatatggccgtggttgagcggattagtcatcgtgtggcggtgatgtatctcgggcaaattgttgaaattggtccacggcgcgcggtctttgaaaatccgcagcatccttatacgcgtaaattactggcggcagttccggtcgctgaaccgtcccgacaacgaccgcagcgtgtactgctgtcggacgatcttcccagcaatattcatctgcgtggcgaagaggttgcagccgtctcgttgcaatgcgtcgggccggggcattacgttgcacaaccacaatcagaatacgcattcatgcgtagataa

SEQ ID NO: 1956 - protein, 612 aa, Escherichia coli
MLAVENLNIAFMQEQHKIAAVRNLSFSLQRGETLAIVGESGSGKSVTALALMRLLEQAGGLVQCDKMLLQRRSREVIELSEQSAAQMRHVRGADMAMIFQEPMTSLNPVFTVGEQIAESIRLHQNASREEAMVEAKRMLDQVRIPEAQTILSRYPHQLSGGMRQRVMIAMALSCRPAVLIADEPTTALDVTIQAQILQLIKVLQKEMSMGVIFITHDMGVVAEIADRVLVMYQGEAVETGSVEQIFHAPQHPYTRALLAAVPQLGAMKGLDYPRRFPLISLEHPAKQEPPIEQKTVVDGEPVLRVRNLVSRFPLRSGLLNRVTREVHAVEKVSFDLWPGETLSLVGESGSGKSTTGRALLRLVESQGGEIIFNGQRIDTLSPGKLQALRRDIQFIFQDPYASLDPRQTIGDSILEPLRVHGLLPGKEAAARVAWLLERVGLLPEHAWRYPHEFSGGQRQRICIARALALNPKVIIADEAVSALDVSIRGQIINLLLDLQRDFGIAYLFISHDMAVVERISHRVAVMYLGQIVEIGPRRAVFENPQHPYTRKLLAAVPVAEPSRQRPQRVLLSDDLPSNIHLRGEEVAAVSLQCVGPGHYVAQPQSEYAFMRR

SEQ ID NO: 1957 - DNA, 1695 bp, Escherichia coli
gtgtactgctgtcggacgatcttcccagcaatattcatctgcgtggcgaagaggttgcagccgtctcgttgcaatgcgtcgggccggggcattacgttgcacaaccacaatcagaatacgcattcatgcgtagataacattcaggcggagaataaaatggcaagagctgtacaccggagtgggttagtggcgctgggcattgcgacagcgttgatggcatcttgtgcattcgctgccaaagaggtggtggtggcggtaggatcgaacttcaccacgctcgatccgtatgacgcaaatgacacgttatctcaggccgtagcgaaatcgttttaccaggggctgttcggtctggataaagagatgaaactgaaaaacgtgctggcggagagttacaccgtttccgatgacggccttacttacaccgtgaaattgcgggaaggcattaaattccaggatggcaccgatttcaacgcagcggcggtgaaagcgaatctggaccgggccagcgatccggcgaatcatcttaaacgctataacctgtataagaatattgccaaaacggaagcgatcgatccgacaacggtaaagattaccctcaaacagccattctcagcgtttattaatattcttgcccatccggcgaccgcgatgatttcaccggcagcgctggaaaaatatggcaaggagattggttttcatccggtgggaaccgggccgtatgaactggatacctggaatcagaccgattttgtgaaggtgaaaaaattcgcgggttactggcagccaggattgcccaaactggacagcataacctggcgtccggtggcggataacaacacccgcgcggcaatgctgcaaaccggtgaagcgcagtttgctttccccattccctacgagcaggccgcactgctggagaaaaacaaaaatatcgagttgatggccagtccgtcaattatgcagcgttatatcagtatgaacgtgacgcaaaagccgttcgataacccgaaggtccgtgaggcgctgaattacgccattaaccgcccggcgctggtgaaagtggccttcgcgggctatgcaacgccagctactggtgtggtaccgccgagtatcgcctacgcgcaaagttataaaccgtggccttacgatccagtgaaagcgcgcgaattacttaaagaggcgggatatcccaacggtttcagtaccacgctgtggtcgtcacataaccacagcaccgcgcagaaagtgctgcaatttacccagcagcagttagcgcaggttgggattaaagcccaggtgactgcgatggatgccgggcaacgggcggcagaagttgaaggtaaagggcaaaaagagagcggcgtgcggatgttctacactggctggtcggcttcaaccggcgaagccgactgggctctatcgccgctgtttgcctcgcagaactggccaccaacgctgtttaataccgcgttttacagcaataaacaggtggatgacttcctggctcaggcactgaaaactaatgatccggcggaaaagacccgcttgtataaggcggcgcaggatatcatctggcaagagtcgccgtggatcccgctggtggtagaaaaactggtgtcggcacacagtaaaaacctgaccggtttttggatcatgccagacaccggcttcagctttgaagatgcggatttgcaataa

SEQ ID NO: 1958 - protein, 564 aa, Escherichia coli
MYCCRTIFPAIFICVAKRLQPSRCNASGRGITLHNHNQNTHSCVDNIQAENKMARAVHRSGLVALGIATALMASCAFAAKEVVVAVGSNFTTLDPYDANDTLSQAVAKSFYQGLFGLDKEMKLKNVLAESYTVSDDGLTYTVKLREGIKFQDGTDFNAAAVKANLDRASDPANHLKRYNLYKNIAKTEAIDPTTVKITLKQPFSAFINILAHPATAMISPAALEKYGKEIGFHPVGTGPYELDTWNQTDFVKVKKFAGYWQPGLPKLDSITWRPVADNNTRAAMLQTGEAQFAFPIPYEQAALLEKNKNIELMASPSIMQRYISMNVTQKPFDNPKVREALNYAINRPALVKVAFAGYATPATGVVPPSIAYAQSYKPWPYDPVKARELLKEAGYPNGFSTTLWSSHNHSTAQKVLQFTQQQLAQVGIKAQVTAMDAGQRAAEVEGKGQKESGVRMFYTGWSASTGEADWALSPLFASQNWPPTLFNTAFYSNKQVDDFLAQALKTNDPAEKTRLYKAAQDIIWQESPWIPLVVEKLVSAHSKNLTGFWIMPDTGFSFEDADLQ

SEQ ID NO: 1959 - DNA, 921 bp, Escherichia coli
atgcttaattacgttatcaaacgcttactggggttgattccgacgctgtttatcgtctcggtgctggtgtttttatttgtccacatgctgcccggcgatccggcgcgattgattgccgggcccgaagctgatgcgcaggttatagaactggtgcgtcagcagctggggttggatcagccgctgtatcaccagttctggcactatatcagcaatgctgtgcagggggattttggcctgtcgatggtgtcgcgtcgtccggttgccgatgagattgccagccgctttatgccaacgctgtggctgaccataaccagtatggtctgggcggtgatatttggtatggcggcgggaattatcgccgccgtctggcgtaaccgttggccggatcgattgagtatgactattgcggtgtcggggatttcgtttccggcatttgctctggggatgcttttaattcaggtattctctgttgaactgggctggctgcctaccgtgggagcagacagttggcagcactacattttaccctccctgacgctcggcgcggcagtggccgccgtgatggcgcgctttacccgcgcgtcgtttgtcgacgttttaagcgaagattatatgcgtaccgcgagggcgaaaggggtgagcgaaacctgggttgtcctcaaacacgggctacgtaacgcgatgatcccggtagtgaccatgatgggtttacagtttggctttttgctcggtggttccatcgtggtggagaaagttttcaactggcccggacttggacgcttactcgttgactccgtagaaatgcgcgattacccggtgattcaggcggaaattctgcttttctcgctggaatttattcttatcaacttagtggtggatgtgctttacgccgccattaacccggctatcaggtacaagtaa

SEQ ID NO: 1960 - protein, 306 aa, Escherichia coli
MLNYVIKRLLGLIPTLFIVSVLVFLFVHMLPGDPARLIAGPEADAQVIELVRQQLGLDQPLYHQFWHYISNAVQGDFGLSMVSRRPVADEIASRFMPTLWLTITSMVWAVIFGMAAGIIAAVWRNRWPDRLSMTIAVSGISFPAFALGMLLIQVFSVELGWLPTVGADSWQHYILPSLTLGAAVAAVMARFTRASFVDVLSEDYMRTARAKGVSETWVVLKHGLRNAMIPVVTMMGLQFGFLLGGSIVVEKVFNWPGLGRLLVDSVEMRDYPVIQAEILLFSLEFILINLVVDVLYAAINPAIRYK

SEQ ID NO: 1961 - DNA, 912 bp, Escherichia coli
atgcgactatttaactggcgacgtcaggcggtgttaaacgccatgccactggtcaaacctgaccaggtacgtacaccgtggcatgaattctggcgacgatttcgccgtcagcatatggcgatgaccgccgcattgttcgttattttattgattgtggtggctatttttgcacgctggatcgctccctatgacgccgaaaattattttgattatgacaatctgaataacggaccttctttgcagcactggtttggcgtcgattcactggggcgtgacattttcagccgtgtcctggttggtgcgcaaatctcgctggcggcgggcgtgtttgccgtgtttatcggtgcggcgatcgggacgttgctgggcttgttggctggatattatgaaggctggtgggatcggctgagcatgcgcatttgcgatgtgctgtttgccttcccgggtattttactggcgatcgctgttgttgcggtgttgggaagcggcattgctaacgtgattatcgcagtcgccattttttccatccccgcgtttgcccgcctggtgcgcggcaacacgctggtgttgaaacagcaaacctttattgagtcagcacgcagtattggtgccagcgatatgaccattttattgcgtcatatcctgcctgggaccgtctcttctatcgtggtgtttttcaccatgcgcattggcacctcgattatctctgccgccagcctgtcatttctcggcctcggtgcgcagccgccgacaccagagtggggggcaatgctcaatgaggcacgagcggatatggttatcgcgccgcatgtcgctgtttttccggccctggctatttttctgaccgtactggcgttcaatttgttgggcgatggtttacgcgatgcgctggatccgaaaattaaaggatag

SEQ ID NO: 1962 - protein, 303 aa, Escherichia coli
MRLFNWRRQAVLNAMPLVKPDQVRTPWHEFWRRFRRQHMAMTAALFVILLIVVAIFARWIAPYDAENYFDYDNLNNGPSLQHWFGVDSLGRDIFSRVLVGAQISLAAGVFAVFIGAAIGTLLGLLAGYYEGWWDRLSMRICDVLFAFPGILLAIAVVAVLGSGIANVIIAVAIFSIPAFARLVRGNTLVLKQQTFIESARSIGASDMTILLRHILPGTVSSIVVFFTMRIGTSIISAASLSFLGLGAQPPTPEWGAMLNEARADMVIAPHVAVFPALAIFLTVLAFNLLGDGLRDALDPKIKG

SEQ ID NO: 1963 - DNA, 2349 bp, Escherichia coli
atgctgagtttatacgaaaagataaagataaggctgataattttatttttattggcagcactgtcatttattggtctttttttcatcattaactatcaactggtatcggaacgcgcggtaaaacgtgccgatagccgctttgaacttattcagaaaaacgttggctatttctttaaagatattgaacgttcggccctgacattaaaggactcactgtatttattaaaaaatacagaggagattcaacgtgccgtgattctgaaaatggaaatgatgccatttttagactcggtgggactggtacttgatgataataaatattatctcttttcgcggagggcgaatgataaaatcgttgtttatcatcaggaacaagtaaatggaccgcttgtcgacgagtcagggcgggttatttttgccgattttaacccatcgaaacgaccgtggtcgatggcttcagatgactctaacaacagctggaatccggcatacaattgctttgatcgtccgggtaaaaaatgtatctcttttacgctacacatcaacggcaaagatcatgatttgttagcggtagataaaattcatgtcgatttaaactggcgatatctgaacgagtatcttgatcacatcagcgctaatgatgaagttctatttttaaagcaaggtcatgagatcattgctaagaatcaactcgctcgtgaaaaattgattatttataatagcgaaggtaattataatattattgattctgtcgatacggaatatattgaaaaaacatcagcggtgccaaacaacgcattattcgaaatctatttttattatcctggtggtaatttattgaacgcatcagataaacttttttatctgccgtttgctttcattattatcgtattgctggtggtttatttaatgaccactcgagtgttccgtcggcaattttctgaaatgacagatttggtcaatacgctggcgtttttgcccgactctacggatcaaatcgaggctctgaagattcgtgaaggcgatgcgaaagagattatcagcatcaaaaattcgatcgcggaaatgaaagatgctgaaattgaacgggcaaataaattgctctcgctgatctcttacgatcaggaaagcggttttattaaaaatatggcgattattgagtccaacaataatcagtatctggctgtggggatcatcaaactgtgtggtctggaagctgtggaagcggtgtttggtgttgatgaacgcaataaaatcgtcaggaaattgtgtcagcgaattgccgagaaatatgcgcaatgctgcgatatcgtgacatttaatgccgatctctatttactcctgtgccgggaaaatgtacagacgtttacccgtaagatagcgacggtaaacgattttgacagcagttttggctaccgcaatctgcgcatccataagtctgctatttgtgaacctttgcagggggaaaacgcctggagttacgcagaaaagctgaaactggcgatttccagtatccgcaaccatatgttctcagagtttattttctgtgatgatgcgaaactcaacgaaatagaagagaatatctggattgcgcgtaatattcgccatgcaatggaaattggcgaactattcctggtctatcaaccgattgttgatattaacacccgcaccattttgggcgcggaggcgttgtgccgttgggtgtctgcggagcgggggattatttcaccgctgaagttcattaccattgctgaggatatcgggtttatcaatgagctgggctatcaaattattaaaaccgcgatgggtgaattcagacattttagtcagcgtgcgtcgctgaaggatgatttcttactgcatattaatgtttcgccctggcagttaaacgaaccacactttcatgagcgttttactaccatcatgaaagaaaatggcctgaaggcgaacagcctttgtgttgagatcaccgaaaccgtgatcgagcgaattaatgaacatttctatctcaatattgaacaactgcgtaaacaaggggtacgggtatcgattgatgactttggcaccggtttgtcaaacctgaaacgtttttatgaaattaatccagacagtataaaggtggattcgcaatttaccggcgatattttcggtactgcaggaaaaattgtgcgcattattttcgatctggcacgctataaccggatcccggtgattgcggaaggcgtagagagcgaagacgttgcgcgtgaattaatcaaattaggatgtgttcaggctcaggggtatctgtaccagaaacccatgccattctccgcctgggataaaagtggaaaattagtaaaagagtag

SEQ ID NO: 1964 - protein, 782 aa, Escherichia coli
MLSLYEKIKIRLIILFLLAALSFIGLFFIINYQLVSERAVKRADSRFELIQKNVGYFFKDIERSALTLKDSLYLLKNTEEIQRAVILKMEMMPFLDSVGLVLDDNKYYLFSRRANDKIVVYHQEQVNGPLVDESGRVIFADFNPSKRPWSMASDDSNNSWNPAYNCFDRPGKKCISFTLHINGKDHDLLAVDKIHVDLNWRYLNEYLDHISANDEVLFLKQGHEIIAKNQLAREKLIIYNSEGNYNIIDSVDTEYIEKTSAVPNNALFEIYFYYPGGNLLNASDKLFYLPFAFIIIVLLVVYLMTTRVFRRQFSEMTDLVNTLAFLPDSTDQIEALKIREGDAKEIISIKNSIAEMKDAEIERANKLLSLISYDQESGFIKNMAIIESNNNQYLAVGIIKLCGLEAVEAVFGVDERNKIVRKLCQRIAEKYAQCCDIVTFNADLYLLLCRENVQTFTRKIATVNDFDSSFGYRNLRIHKSAICEPLQGENAWSYAEKLKLAISSIRNHMFSEFIFCDDAKLNEIEENIWIARNIRHAMEIGELFLVYQPIVDINTRTILGAEALCRWVSAERGIISPLKFITIAEDIGFINELGYQIIKTAMGEFRHFSQRASLKDDFLLHINVSPWQLNEPHFHERFTTIMKENGLKANSLCVEITETVIERINEHFYLNIEQLRKQGVRVSIDDFGTGLSNLKRFYEINPDSIKVDSQFTGDIFGTAGKIVRIIFDLARYNRIPVIAEGVESEDVARELIKLGCVQAQGYLYQKPMPFSAWDKSGKLVKE

SEQ ID NO: 1965 - DNA, 1329 bp, Escherichia coli
atgtccagaatcaataaattcgtacttacagtcagtctgctgatttttatcatgatttcagcagttgcctgcgggatctacactcaaatggtaaaggaacgggtgtatggcctgaaacagtccgttattgatactgcttttgcggtggcaaatattgctgaatatcggcgtagtgtggcaattgatctcatcaacacgctaaatcctacggaggaacagctgttggttggcttacgcacagcttacgccgactcggtttcaccctcttatttgtacgatgtcggtccttatctgatttccagtgacgaatgtattcaggtaaaggagttcgagaaaaattattgtgcagatattatgcaggttgttaagtatcgacatgtcaaaaatacagggtttatctcttttgatggtaaaaccttcgtctattacctctatccggtaactcacaatcgtagtctgatatttttgcttggtctggaacgtttttctttactgtcaaaatcgctggcgatggatagcgagaacctgatgttctccctgttcaagaacggtaaatcggtgaccggtgatgaatataacgctaaaaacgccatcttcaccgtttcggaagcaatggagcacttctcctatttgccgaccgggttgtacgtatttgcttataaaaaagacgtttattttcaggtatgtacattgattattttctttgccgcattggtggcagtgatatcgggtgccagttgcctctatctggtacgcagagtgattaatcgtggtattgtggagaaagaagccattattaataaccattttgaacgcgtactggatggcgggcttttcttttcggctgccgatgtcaaaaaactctacagtatgtataactcggcattcctggacgatctgaccaaagcgatgggcagaaaatcctttgacgaagatttaaaagcgctgccggaaaaaggcggttatttgtgcctgtttgacgtcgataaattcaaaaacattaacgacaccttcggtcatttgctgggcgatgaagtgttgatgaaagtggtgaaaatccttaaatcacagatcccggtagataaaggtaaagtttaccgcttcggaggtgacgaatttgcggtgatttatactggcggcacgctggaagagttgctatcgattctaaaagaaatcgttcatttccaggtgggaagcattaatttaagcaccagtatcggtgtagcgcattcaaatgaatgtactaccgttgaacgtttgaaaatgctggcggatgagcggctgtataagagtaagaaaaacggcagggcgcagattagctggcagtaa

SEQ ID NO: 1966 - protein, 442 aa, Escherichia coli
MSRINKFVLTVSLLIFIMISAVACGIYTQMVKERVYGLKQSVIDTAFAVANIAEYRRSVAIDLINTLNPTEEQLLVGLRTAYADSVSPSYLYDVGPYLISSDECIQVKEFEKNYCADIMQVVKYRHVKNTGFISFDGKTFVYYLYPVTHNRSLIFLLGLERFSLLSKSLAMDSENLMFSLFKNGKSVTGDEYNAKNAIFTVSEAMEHFSYLPTGLYVFAYKKDVYFQVCTLIIFFAALVAVISGASCLYLVRRVINRGIVEKEAIINNHFERVLDGGLFFSAADVKKLYSMYNSAFLDDLTKAMGRKSFDEDLKALPEKGGYLCLFDVDKFKNINDTFGHLLGDEVLMKVVKILKSQIPVDKGKVYRFGGDEFAVIYTGGTLEELLSILKEIVHFQVGSINLSTSIGVAHSNECTTVERLKMLADERLYKSKKNGRAQISWQ

SEQ ID NO: 1967 - DNA, 1326 bp, Escherichia coli
atgagcaaagtaactccccagccgaaaatcggctttgtttcccttggctgtccgaaaaaccttgtcgattcagagcgtattctcaccgaactacgcactgaaggttatgacgtggtaccgagctatgatgatgcggacatggtgatcgtcaacacctgcggctttattgacagcgcggtacaagaatcactggaagccattggtgaagcgttgaatgaaaacggcaaggtaattgtgaccggttgtctgggggcaaaagaagatcagatccgcgaagtccacccgaaagtgctggaaatcaccgggcctcatagctatgagcaggttctggagcacgttcatcactacgtgccaaaaccgaaacacaacccattcctgagcctggtgccagaacaaggtgtgaaactgacgccgcgtcattatgcctatctgaaaatttctgaaggctgtaatcaccgctgcaccttctgcattattccgtctatgcgcggcgatctggtgagccgtccgattggcgaagtgttaagtgaagcgaaacgtctggttgatgcgggcgttaaagaaattctggtgatctcgcaggatacttccgcgtatggcgtcgatgttaaacatcgtactggcttccacaacggcgagccggtaaaaaccagcatggtcagcctgtgcgaacagttatcgaaactggggatctggacacgtctgcactacgtttacccttatccgcatgtggacgacgtcatcccactgatggcagagggcaaaatcctgccgtatctggacattccgttgcagcacgccagcccgcgcattctcaaactgatgaaacgtccgggttctgtagatcgccaactggcgcgcatcaaacagtggcgcaaaatctgcccggaactgaccctacgctcaacctttattgttggcttccctggcgagacggaagaagatttccagatgctactcgacttcctgaaagaagcacgtctggatcgcgttggctgctttaaatacagcccggttgaaggtgcagacgccaatgccctgcctgaccaggttccggaagaagtgaaagaagaacgctggaaccgtttcatgcagttgcagcagcaaatttccgccgagcgcctgcaagagaaagtgggccgtgaaattctggtgattatcgacgaagtggacgaagaaggcgcgattggtcgcagcatggcagatgcaccggaaatcgacggcgcggtttatctcaatggtgaaaccaacgttaagccgggtgatatcctgcgagtgaaagtcgagcacgccgatgagtacgatttgtggggtagccgggtttaa

SEQ ID NO: 1968 - protein, 441 aa, Escherichia coli
MSKVTPQPKIGFVSLGCPKNLVDSERILTELRTEGYDVVPSYDDADMVIVNTCGFIDSAVQESLEAIGEALNENGKVIVTGCLGAKEDQIREVHPKVLEITGPHSYEQVLEHVHHYVPKPKHNPFLSLVPEQGVKLTPRHYAYLKISEGCNHRCTFCIIPSMRGDLVSRPIGEVLSEAKRLVDAGVKEILVISQDTSAYGVDVKHRTGFHNGEPVKTSMVSLCEQLSKLGIWTRLHYVYPYPHVDDVIPLMAEGKILPYLDIPLQHASPRILKLMKRPGSVDRQLARIKQWRKICPELTLRSTFIVGFPGETEEDFQMLLDFLKEARLDRVGCFKYSPVEGADANALPDQVPEEVKEERWNRFMQLQQQISAERLQEKVGREILVIIDEVDEEGAIGRSMADAPEIDGAVYLNGETNVKPGDILRVKVEHADEYDLWGSRV

SEQ ID NO: 1969 - DNA, 384 bp, Escherichia coli
atgttcgttgacagacagcgaatcgatctgctgaaccggttgatcgacgcacgcgttgacctcgccgcatacgtgcaactgaggaaggcaaaaggatacatgtccgtcagcgaaagcaatcatctacgagataacttttttaaactgaatcgcgaactgcacgataaatcgctgcggttgaatcttcatctggatcaggaagaatggagtgctcttcatcatgctgaagaagcattagcgacagccgcagtatgtttgatgagtgggcaccatgattgcccgactgttattaccgtcaacgccgataagcttgaaaattgtctgatgagcttaacgctgagtatccagagcctgcagaagcacgccatgcttgagaaggcctga

SEQ ID NO: 1970 - protein, 127 aa, Escherichia coli
MFVDRQRIDLLNRLIDARVDLAAYVQLRKAKGYMSVSESNHLRDNFFKLNRELHDKSLRLNLHLDQEEWSALHHAEEALATAAVCLMSGHHDCPTVITVNADKLENCLMSLTLSIQSLQKHAMLEKA

SEQ ID NO: 1971 - DNA, 1116 bp, Escherichia coli
atgcatcgacaatcctttttccttgtgccccttatttgtctttcttccgctctctgggcagctcctgcaacggtaaatgtcgaagtactgcaagacaaactcgaccatccctgggcgctggcctttttacccgataatcacggtatgttaatcactctgcgcggcggcgagttgcgtcactggcaagcaggaaaaggattatctgcgccgctttccggagtgccggacgtttgggcgcacgggcagggcggcctgctggacgtggttttagcgcccgattttgctcagtcgcgccgcatctggttaagttattccgaagttggcgatgatggcaaagccggaactgctgtgggttatggccgcttaagtgatgatctctcaaaagtgaccgacttccgcaccgtctttcgtcagatgccaaaactgtctaccggcaaccattttggcgggcggatggtatttgacggtaaaggttatctttttattgctctgggcgaaaacaatcagcgcccgacggcgcaggatctggataaattacagggcaaactggtgcgactgaccgacctgggagaaatcccggatgataatccttttataaaggaatctggtgtgcgcgccgagatctggtcttatggcattcgtaatccgcaaggaatggcgatgaatccgtggagtaatgcactatggctgaatgaacatggcccgcgcggtggcgatgaaattaatatcccgcaaaaaggcaaaaactacggctggccgctggcaacctggggaatcaactattcaggctttaagataccggaggcgaaaggggagatcgtcgccgggaccgagcaacctgttttttactggaaagattcgcccgccgtgagcggcatggccttctataacagcgataaattcccccagtggcagcaaaaattatttattggcgcgctgaaagataaagatgtcatcgtgatgagcgtcaacggcgacaaagtgacagaagatggccgtattttaacggacaaagggcagcgaattcgtgatgttcgcactggacccgacggttatttatacgttctcaccgacgagtccagtggggaattacttaaagttagcccacgcaattag

SEQ ID NO: 1972 - protein, 371 aa, Escherichia coli
MHRQSFFLVPLICLSSALWAAPATVNVEVLQDKLDHPWALAFLPDNHGMLITLRGGELRHWQAGKGLSAPLSGVPDVWAHGQGGLLDVVLAPDFAQSRRIWLSYSEVGDDGKAGTAVGYGRLSDDLSKVTDFRTVFRQMPKLSTGNHFGGRMVFDGKGYLFIALGENNQRPTAQDLDKLQGKLVRLTDLGEIPDDNPFIKESGVRAEIWSYGIRNPQGMAMNPWSNALWLNEHGPRGGDEINIPQKGKNYGWPLATWGINYSGFKIPEAKGEIVAGTEQPVFYWKDSPAVSGMAFYNSDKFPQWQQKLFIGALKDKDVIVMSVNGDKVTEDGRILTDKGQRIRDVRTGPDGYLYVLTDESSGELLKVSPRN

SEQ ID NO: 1973 - DNA, 627 bp, Escherichia coli
atgattacgctgtggggtcggaataattcaaccaacgtaaaaaaagtattgctgacgctcgaagaactggaactaccttatgagcaaattctcgcgggccgtgagtttgggataaatcacgatgctgattttctggcgatgaaccctaacgggctggtgccgttgttgcgtgacgacgaaagtgatctcattctttgggaatcaaacgccattgtccgctatctggcggcacagtacgggcaaaaacgcctgtggatcgactcaccggcacgtcgtgcggaagcagaaaaatggatggactgggcaaaccagacgctcagtaatgctcatcgcgggatcctgatgggattagtcagaacaccaccggaagagcgcgatcaggccgccattgatgccagttgcaaagagtgcgacgccctgtttgccctgctagatgcggaactggcaaaagtaaaatggttctcaggcgacgagtttggtgtgggcgatatcgctatcgcaccgttcatctacaatttgtttaacgttggcctgacctggacaccgcgtccaaatctgcaacgctggtatcagcaactcactgaacgccccgcagtgcgcaaagtggtgatgattcccgttagctaa

SEQ ID NO: 1974 - protein, 208 aa, Escherichia coli
MITLWGRNNSTNVKKVLLTLEELELPYEQILAGREFGINHDADFLAMNPNGLVPLLRDDESDLILWESNAIVRYLAAQYGQKRLWIDSPARRAEAEKWMDWANQTLSNAHRGILMGLVRTPPEERDQAAIDASCKECDALFALLDAELAKVKWFSGDEFGVGDIAIAPFIYNLFNVGLTWTPRPNLQRWYQQLTERPAVRKVVMIPVS

SEQ ID NO: 1975 - DNA, 1203 bp, Escherichia coli
atgacgcaatactcctctctccttcgtggtcttgcagcgggttctgcatttttattcctttttgccccaacggcattcgcggcggaacaaaccgttgaagcgccgagcgtggatgcgcgtgcatggattttaatggattacgccagcggtaaagtgctggcagaaggcaatgcggatgagaaactggatcccgcgagcctgactaaaatcatgaccagctatgtggttgggcaggcgcttaaggccgataagattaaactcaccgatatggtgacggtcggtaaagatgcctgggcgacgggaaatccggcactgcgtggttcatcggtaatgttcctcaaaccgggcgatcaggtttcggtggcagacttgaacaaaggtgtgattatccagtccggtaatgacgcctgtattgcgctggctgattacgttgccgggagccaggagtcatttattggtttgatgaatggttatgccaaaaaactgggtctgaccaacactaccttccagacggtgcacggcctggatgcgccggggcagttcagtaccgcgcgcgatatggcattgctgggtaaagcattgatccacgatgtgccggaagagtacgccattcataaagagaaagagttcaccttcaacaaaattcgtcagcctaaccgtaatcgtctgctgtggagcagcaatctgaatgttgatggcatgaagacaggaaccacggcaggcgcgggatataatctggttgcttcggctacccagggcgatatgcgtttaatctccgtagtgctgggggcgaaaactgaccgtatccgttttaatgagtctgagaaattattgacctggggtttccgcttctttgaaaccgtgacgccaattaaacctgatgccacatttgtgactcagcgcgtctggtttggtgataagagcgaagtgaatctcggggcaggcgaagcgggctcagtgaccataccgcgtgggcagctgaaaaacctgaaggcgagttatacgttaatggaaccgcagcttaccgcaccgctgaaaaaaggtcaggttgtcggcaccattgatttccagcttaacggtaaatccattgagcagcgtccgctgatcgtgatggaaaatgtggaagagggcggattctttggtcggatgtgggatttcgtgatgatgaaattccatcagtggttcggcagctggttctcttaa

SEQ ID NO: 1976 - protein, 400 aa, Escherichia coli
MTQYSSLLRGLAAGSAFLFLFAPTAFAAEQTVEAPSVDARAWILMDYASGKVLAEGNADEKLDPASLTKIMTSYVVGQALKADKIKLTDMVTVGKDAWATGNPALRGSSVMFLKPGDQVSVADLNKGVIIQSGNDACIALADYVAGSQESFIGLMNGYAKKLGLTNTTFQTVHGLDAPGQFSTARDMALLGKALIHDVPEEYAIHKEKEFTFNKIRQPNRNRLLWSSNLNVDGMKTGTTAGAGYNLVASATQGDMRLISVVLGAKTDRIRFNESEKLLTWGFRFFETVTPIKPDATFVTQRVWFGDKSEVNLGAGEAGSVTIPRGQLKNLKASYTLMEPQLTAPLKKGQVVGTIDFQLNGKSIEQRPLIVMENVEEGGFFGRMWDFVMMKFHQWFGSWFS

SEQ ID NO: 1977 - DNA, 759 bp, Escherichia coli
atggaaacacgtcgcgaagagcgtatcgggcagctgctgcaagaattaaaacgcagtgataagttacatcttaaagacgccgccgccctgcttggggtttcggagatgacgattcgtcgcgatctgaacaaccacagtgcgcccgtcgttttgctcggcggctatattgttctggaaccacgcagcgccagccattacctgttaagcgatcaaaaatcccgcctggtggaagaaaaacgccgggcggcaaaactggctgcgacgctggtagaacccgatcagaccctcttttttgactgtggcaccaccacgccgtggattattgaagcaattgataatgaaatcccttttaccgccgtttgttattcgctaaatacctttctggcgctgaaagagaaaccccattgccgcgcgtttctttgcggtggtgaatttcacgccagcaacgccattttcaaacccatcgattttcagcaaacgctgaataatttttgcccggatatcgctttttattccgctgcgggcgtgcatgtcagtaaaggcgctacctgctttaatcttgaagagttgccggtaaaacactgggccatgtcgatggcgcaaaagcatgtgctggttgtcgaccacagtaaatttggcaaggtgcgtccggcgcgcatgggtgacctgaaacgctttgatattgttgtgagcgattgttgcccggaagatgagtatgtgaagtacgcgcagacgcagcgtattaagttgatgtattaa

SEQ ID NO: 1978 - protein, 252 aa, Escherichia coli
METRREERIGQLLQELKRSDKLHLKDAAALLGVSEMTIRRDLNNHSAPVVLLGGYIVLEPRSASHYLLSDQKSRLVEEKRRAAKLAATLVEPDQTLFFDCGTTTPWIIEAIDNEIPFTAVCYSLNTFLALKEKPHCRAFLCGGEFHASNAIFKPIDFQQTLNNFCPDIAFYSAAGVHVSKGATCFNLEELPVKHWAMSMAQKHVLVVDHSKFGKVRPARMGDLKRFDIVVSDCCPEDEYVKYAQTQRIKLMY

SEQ ID NO: 1979 - DNA, 612 bp, Escherichia coli
ttgcgtcgggaagttatgctggaaaatttgaatctctctctattctctcttattaacgcaacgccagactctgcgccgtggatgatctcgttggcgatttttattgctaaagatttgattaccgtggtgccgttgctggccgcagtactttggttgtgggggcttacagcacaacggcaactggtgataaaaatcgctatcgcgctggcggtcagcctgtttgtgtcctggacgatgggacatctttttccgcacgaccgaccctttgtcgaaaatatcggctataacttcctgcatcatgcggcggatgactcattcccgagcgatcacggtacggtgattttcacctttgcactggcatttttatgctggcatcgcctgtggtccggctcacttttaatggtgctggccgtcgtcattgcctggtcgcgcgtttatcttggcgtccactggccgctggatatgctcggtggattgctggcaggtatgattggctgccttagcgcccagattatctggcaagcgatggggcataaactctatcaacgtctgcaatcgtggtatcgcttctgttttgcattaccgatccgcaaaggctgggtgcgtgactga

SEQ ID NO: 1980 - protein, 203 aa, Escherichia coli
MRREVMLENLNLSLFSLINATPDSAPWMISLAIFIAKDLITVVPLLAAVLWLWGLTAQRQLVIKIAIALAVSLFVSWTMGHLFPHDRPFVENIGYNFLHHAADDSFPSDHGTVIFTFALAFLCWHRLWSGSLLMVLAVVIAWSRVYLGVHWPLDMLGGLLAGMIGCLSAQIIWQAMGHKLYQRLQSWYRFCFALPIRKGWVRD

SEQ ID NO: 1981 - DNA, 108 bp, Escherichia coli
gtgcttaaccgtggtttcagctacaaaattcgctttctcgttagctgcgcttttattaaactttgcgcgattattattggcgaagaaattgcatgcaaaataaattag

SEQ ID NO: 1982 - protein, 35 aa, Escherichia coli
MLNRGFSYKIRFLVSCAFIKLCAIIIGEEIACKIN

SEQ ID NO: 1983 - DNA, 1233 bp, Escherichia coli
atgcaaaataaattagcttccggtgccaggcttggacgtcaggcgttacttttccctctctgtctggtgctttacgaattttcaacctatatcggcaacgatatgattcaacccggtatgttggccgtggtggaacaatatcaggcgggcattgattgggttcctacttcgatgactgcgtatctggcgggcgggatgtttttacaatggctcctggggccgttgtcggatcgtattggccgccgtccggtgatgttggcgggagtggtgtggtttatcgtcacctgtctggcaatattactggcgcaaaacattgaacaattcaccctgttgcgcttcttgcagggcataagcctctgtttcattggcgctgtgggatacgccgcaattcaggaatccttcgaagaggccgtttgtatcaagatcaccgcgctaatggcgaacgtggcgctgattgctccactacttggtccgctggtgggcgcggcgtggatccatgtgctgccctgggaagggatgtttgtcttgtttgccgcattggcagcgatctcctttttcggtctgcaacgagctatgcctgaaaccgccacgcgtataggcgagaaactgtcgctgaaagaactcggtcgtgactataagttggtgctgaagaacggccgctttgtggcgggggcgctggcgctgggattcgttagcctgccgttgttggcgtggatcgcccagtcgccgattatcattattaccggtgagcagttgagcagctatgaatatggcttgctgcaagtgcctattttcggggcgttaattgcgggtaacttgctgttagcgcgtctgacctcgcgccgcaccgtacgttcgctgattattatgggcggctggccgattatgattggtctgttggtcgctgctgcggcaacggttatctcatcgcacgcgtatttatggatgaccgccgggttaagtatttatgctttcggtattggtctggcgaatgcgggactggtgcgattaaccctgtttgccagcgatatgagtaaaggtacggtttctgcggcgatggggatgctgcaaatgctgatctttaccgtcggtattgaaatcagcaaacatgcctggctgaacgggggcaacggactgtttaatctcttcaaccttgtcaacggcattttgtggctgtcgctgatggttatctttttaaaagataaacagatgggaaattcgcacgaagggtaa

SEQ ID NO: 1984 - protein, 410 aa, Escherichia coli
MQNKLASGARLGRQALLFPLCLVLYEFSTYIGNDMIQPGMLAVVEQYQAGIDWVPTSMTAYLAGGMFLQWLLGPLSDRIGRRPVMLAGVVWFIVTCLAILLAQNIEQFTLLRFLQGISLCFIGAVGYAAIQESFEEAVCIKITALMANVALIAPLLGPLVGAAWIHVLPWEGMFVLFAALAAISFFGLQRAMPETATRIGEKLSLKELGRDYKLVLKNGRFVAGALALGFVSLPLLAWIAQSPIIIITGEQLSSYEYGLLQVPIFGALIAGNLLLARLTSRRTVRSLIIMGGWPIMIGLLVAAAATVISSHAYLWMTAGLSIYAFGIGLANAGLVRLTLFASDMSKGTVSAAMGMLQMLIFTVGIEISKHAWLNGGNGLFNLFNLVNGILWLSLMVIFLKDKQMGNSHEG

SEQ ID NO: 1985 - DNA, 312 bp, Escherichia coli
ttgcataattcgcggaaattaacccgctgcattatttcaggcgaaatgattatgaaaaattgtctactgttgggcgcgcttttaatgggctttactggtgtggcgatggcgcaaagtgtcaccgtcgatgtgccgagtggatacaaagtggttgtggttcctgattcagtcagcgtcgcgactgtgccgcaaaccgtctatgtggctcctgcgccagctccggcttaccgcccgcatccttatgttcgccatcttgccagcgtaggtgaagggatggttatcgaacaccagattgacgaccatcaccattaa

SEQ ID NO: 1986 - protein, 103 aa, Escherichia coli
MHNSRKLTRCIISGEMIMKNCLLLGALLMGFTGVAMAQSVTVDVPSGYKVVVVPDSVSVATVPQTVYVAPAPAPAYRPHPYVRHLASVGEGMVIEHQIDDHHH

SEQ ID NO: 1987 - DNA, 816 bp, Escherichia coli
atgagcattaaattaattgcggtagacatggatggtactttcttaagcgatcaaaaaacctataaccgtgagcggtttatggctcagtatcagcaaatgaaagcacaaggcattcgctttgtggtcgccagcgggaatcaatattatcagttgatctctttctttcctgaaattgctaatgaaattgcctttgtggctgaaaacggcggctgggtagtgagcgaaggcaaagatgtttttaatggcgagctgtcgaaggatgcgtttactactgtcgtagaacatttgctgacgcgcccggaagtggaaattattgcctgcggaaaaaatagcgcctataccctcaaaaaatatgacgatgccatgaaaacggtggcggaaatgtattatcaccgtctggaatacgtcgataactttgacaacttagaagatatcttctttaaatttggccttaatctctctgacgaactgatcccacaagtgcaaaaagcattacatgaggccatcggcgatatcatggtaccggtccataccggcaacggcagcatcgatctgattatccccggtgtacataaagccaatggccttcgccaactgcagaaattatggggaatagacgacagcgaagtggtggtctttggcgatggcggtaacgatattgagatgctgcgtcaggcaggctttagttttgcaatggaaaatgccggcagcgcggtcgtcgcagcggcaaaataccgggcaggctccaataaccgtgaaggcgtactggatgtgatcgataaagtgcttaaacacgaagcgccatttaaccaataa

SEQ ID NO: 1988 - protein, 271 aa, Escherichia coli
MSIKLIAVDMDGTFLSDQKTYNRERFMAQYQQMKAQGIRFVVASGNQYYQLISFFPEIANEIAFVAENGGWVVSEGKDVFNGELSKDAFTTVVEHLLTRPEVEIIACGKNSAYTLKKYDDAMKTVAEMYYHRLEYVDNFDNLEDIFFKFGLNLSDELIPQVQKALHEAIGDIMVPVHTGNGSIDLIIPGVHKANGLRQLQKLWGIDDSEVVVFGDGGNDIEMLRQAGFSFAMENAGSAVVAAAKYRAGSNNREGVLDVIDKVLKHEAPFNQ

SEQ ID NO: 1989 - DNA, 1272 bp, Escherichia coli
ttgtgtacaaatgtacacagtcttgctaatgttgtcttccctcttcttattttgacgtggtctatgaccgtaaattcttcacgtaatgcattgaaacgccgaacctgggcgctgtttatgttcttctttttgccaggcctgttaatggcgtcctgggcaacccgtacgcctgctatccgcgatattctctctgtctcgatcgctgaaatgggcggtgttctctttggtctgtcgatcggttcgatgagcggtattctctgctcggcgtggttagtgaaacgctttgggacgcgtaatgtcatccttgtgacgatgtcctgcgcattgattgggatgatgatattaagtctggcactctggctgacatcgcccttgctctttgccgttggtctcggcgtctttggggctagttttggttctgcggaagtggcgataaacgttgaaggtgccgccgttgagagagaaatgaataagacggttttaccgatgatgcacggtttttatagcctgggcacgctggcaggcgcaggtgtcgggatggcactgacggcctttggcgttccggcaacggtgcatattttattggcggcgctggtaggcatcgcacctatttatatcgccattcaggcaatccctgacggtacgggcaaaaatgctgccgatggcacccagcatggtgaaaaaggcgtacctttttatcgggatatccagttgctgttgattggtgttgtggtgctggcgatggcctttgccgaaggttctgccaacgactggttacccttattaatggttgatggtcacggttttagccctacttccggctcgctgatttatgccggttttaccctggggatgaccgttggacgctttaccggcggttggttcattgaccgttacagtcgcgttgccgtggttcgggccagtgcactaatgggggcgttgggtattgggctgattatttttgtcgatagcgcctgggtcgctggggtgtctgttgtactttggggactgggtgcctcgttgggcttcccgctgactatttctgccgccagcgataccggccccgatgcaccaacccgcgtcagcgtggtagctacgaccggttatctggctttcctcgtcgggccgccgctgctgggctatctcggcgaacattatggattacgtagtgcaatgctggttgtactggcgctggttattctcgcggctattgtcgcgaaagccgtcgccaaacccgataccaaaacgcagacggcgatggagaatagttga

SEQ ID NO: 1990 - protein, 423 aa, Escherichia coli
MCTNVHSLANVVFPLLILTWSMTVNSSRNALKRRTWALFMFFFLPGLLMASWATRTPAIRDILSVSIAEMGGVLFGLSIGSMSGILCSAWLVKRFGTRNVILVTMSCALIGMMILSLALWLTSPLLFAVGLGVFGASFGSAEVAINVEGAAVEREMNKTVLPMMHGFYSLGTLAGAGVGMALTAFGVPATVHILLAALVGIAPIYIAIQAIPDGTGKNAADGTQHGEKGVPFYRDIQLLLIGVVVLAMAFAEGSANDWLPLLMVDGHGFSPTSGSLIYAGFTLGMTVGRFTGGWFIDRYSRVAVVRASALMGALGIGLIIFVDSAWVAGVSVVLWGLGASLGFPLTISAASDTGPDAPTRVSVVATTGYLAFLVGPPLLGYLGEHYGLRSAMLVVLALVILAAIVAKAVAKPDTKTQTAMENS

SEQ ID NO: 1991 - DNA, 537 bp, Escherichia coli
atgcgtcgcgctaacgatccgcaacggcgagaaaaaattatccaggccacgctggaggcggtgaaactttacggaatacatgctgttacacaccgcaaaattgctacccttgccggggtgccgttgggatcgatgacctactatttttcaggaattgatgagttgttgctggaggcgttcagccgttttactgagatcatgtcccggcaatatcaggcattttttagcgatgttagtgatgctccaggcgcatgccaggctatcaccgatatgatctacagctcacaggtcgcaacgccggataatatggagctgatgtaccagctctacgcgctggctagccgaaaaccgctcttaaaaacggtaatgcaaaactggatgcagcgcagtcaacaaacgctcgaacaatggtttgaacccggaaccgcccgcgcgcttgatgcgtttattgagggaatgacgctgcattttgtcaccgaccgtaagccgctatcacgcgaggagattttgaggatggttgagaggattgctgggtag

SEQ ID NO: 1992 - protein, 178 aa, Escherichia coli
MRRANDPQRREKIIQATLEAVKLYGIHAVTHRKIATLAGVPLGSMTYYFSGIDELLLEAFSRFTEIMSRQYQAFFSDVSDAPGACQAITDMIYSSQVATPDNMELMYQLYALASRKPLLKTVMQNWMQRSQQTLEQWFEPGTARALDAFIEGMTLHFVTDRKPLSREEILRMVERIAG

SEQ ID NO: 1993 - DNA, 1686 bp, Escherichia coli
gtgaatataaacgtcgccgaattgttaaatgggaattacattctgttattatttgtggtcctcgcgcttgggctatgtctcgggaaattacgacttggttcgatccaactgggtaattccattggcgttttagtcgtatcgctgttattaggccaacaacatttcagcattaacaccgacgcgcttaatcttggctttatgctgtttattttctgcgtcggggtcgaagccggaccgaactttttttccattttttttcgcgatgggaaaaattacctaatgttagcactggtgatggttggcagtgcgctggtgatcgccttagggttaggtaagctgtttggctgggatattggcctgacggccggtatgttagctggctctatgacgtcgacaccggttctggtcggtgctggcgatacactgcgtcattccggcatggaaagcaggcagctctcactggcactggataatctgagcctcgggtatgccttaacctatttaatcggtctggtgagtttgattgttggtgcgcgttacttgccgaaattgcagcatcaggacttacagaccagcgcccagcaaatcgcccgcgaacgtggcctggacactgatgccaaccgtaaggtttatttaccggtgatccgcgcctaccgcgtcggcccggagctggtggcctggaccgacggcaaaaatctgcgtgaactgggtatttatcgacaaactggctgctacattgaacgtattcgacgtaacgggattctggcgaatccagacggtgatgctgtgctacaaatgggcgatgaaatagcgttggtaggctatcccgacgcccacgcacgactcgatcccagcttccgtaacggcaaagaagttttcgatcgtgaccttctcgacatgcgtatcgtcactgaagaagtggtcgttaaaaaccataacgccgtgggcaaacgtctcgcacaactgaagttgaccgatcacggttgcttccttaaccgcgtcattcgtagccagattgagatgccgatagatgacaacgtcgtgcttaacaaaggtgacgttttacaagtcagcggcgatgcccgtcgcgtaaaaaccatcgccgatcgcatcggctttatctcgattcacagccaggtcactgacttgctggcattctgcgccttctttgttattgggctgatgatcgggatgatcaccttccagttcagcacattcagtttcggcatggggaacgctgccgggttgttattcgccggaattatgctgggatttatgcgcgctaaccacccgaccttcggttacattccgcagggtgcattaagcatggtgaaagagttcggcttaatggtgtttatggcaggcgttggtctgagcgccggtagcggtattaataacggcctgggcgcgattggcggtcagatgttgattgccggattgattgtcagtcttgtgccagtggttatctgtttcttgttcggtgcttatgtattgcgaatgaaccgcgcactgttgttcggcgcaatgatgggcgcacgcacctgcgcgccggcaatggagatcatcagtgatacagctcgcagtaacatcccggcgctgggctatgcgggcacctatgcaatcgccaacgtcctgctgacgctggcagggacaatcatcgtcatggtatggccaggattaggataa

SEQ ID NO: 1994 - protein, 561 aa, Escherichia coli
MNINVAELLNGNYILLLFVVLALGLCLGKLRLGSIQLGNSIGVLVVSLLLGQQHFSINTDALNLGFMLFIFCVGVEAGPNFFSIFFRDGKNYLMLALVMVGSALVIALGLGKLFGWDIGLTAGMLAGSMTSTPVLVGAGDTLRHSGMESRQLSLALDNLSLGYALTYLIGLVSLIVGARYLPKLQHQDLQTSAQQIARERGLDTDANRKVYLPVIRAYRVGPELVAWTDGKNLRELGIYRQTGCYIERIRRNGILANPDGDAVLQMGDEIALVGYPDAHARLDPSFRNGKEVFDRDLLDMRIVTEEVVVKNHNAVGKRLAQLKLTDHGCFLNRVIRSQIEMPIDDNVVLNKGDVLQVSGDARRVKTIADRIGFISIHSQVTDLLAFCAFFVIGLMIGMITFQFSTFSFGMGNAAGLLFAGIMLGFMRANHPTFGYIPQGALSMVKEFGLMVFMAGVGLSAGSGINNGLGAIGGQMLIAGLIVSLVPVVICFLFGAYVLRMNRALLFGAMMGARTCAPAMEIISDTARSNIPALGYAGTYAIANVLLTLAGTIIVMVWPGLG

SEQ ID NO: 1995 - DNA, 378 bp, Escherichia coli
gtgaaacataaacaacgttgggcgggggcaatctgctgttttgtcctcttcattgtggtgtgtctttttctggcgacgcacatgaaaggcgcttttcgggctgccgggcatcctgaaatcggtttgctatttttcattcttcctggtgcagttgccagcttcttttcacatcgtagagaagtcctgaaacctctgtttggcgcaatgctggcggcaccctgttcgatgctcattatgcggctgtttttttcaccgacgcgctcattctggcaagagctggcatggttattaagtgcggtgttctggtgtgcgctgggggcattgtgtttcttatttatcagtagtttgtttaaaccacagcacagaaaaaatcaataa

SEQ ID NO: 1996 - protein, 125 aa, Escherichia coli
MKHKQRWAGAICCFVLFIVVCLFLATHMKGAFRAAGHPEIGLLFFILPGAVASFFSHRREVLKPLFGAMLAAPCSMLIMRLFFSPTRSFWQELAWLLSAVFWCALGALCFLFISSLFKPQHRKNQ

SEQ ID NO: 1997 - DNA, 258 bp, Escherichia coli
atgcaaaccgttatttttggtcgtccgggttgcccttactgtgtgcgtgcaaaagatctggctgagaaattgagcaatgaacgcgatgatttccagtatcagtatgtagatattcgtgcggaagggatcactaaagaagatctacaacaaaaggcaggtaaacccgtagaaaccgtgccgcagatttttgtcgatcagcaacatatcggcggctataccgattttgctgcatgggcgaaagagaatctggacgcctga

SEQ ID NO: 1998 - protein, 85 aa, Escherichia coli
MQTVIFGRPGCPYCVRAKDLAEKLSNERDDFQYQYVDIRAEGITKEDLQQKAGKPVETVPQIFVDQQHIGGYTDFAAWAKENLDA

SEQ ID NO: 1999 - DNA, 288 bp, Escherichia coli
atgcgcgcgatcggtaaattgcctaaaagcgtgttgatactggaatttatcggaatgatgttgctggcggtggcgctgctgtcggtaagcgactccctgtcgctacctgagccattttctcggccagaagtgcagattctgatgatttttctcggtgttttgctcatgcttcccgctgcggtggtggttattcttcaggtggcaaaacgtcttgccccacagctgatgaaccatccaccgcaatattcacgttcagaaagagaaaaagataatgacgccaaccattga

SEQ ID NO: 2000 - protein, 95 aa, Escherichia coli
MRAIGKLPKSVLILEFIGMMLLAVALLSVSDSLSLPEPFSRPEVQILMIFLGVLLMLPAAVVVILQVAKRLAPQLMNHPPQYSRSEREKDNDANH

SEQ ID NO: 2001 - DNA, 723 bp, Escherichia coli
atgacgccaaccattgaacttatttgtggccatcgctccattcgccatttcactgatgaacccatttccgaagcgcagcgtgaggcgattattaacagcgcccgtgcgacgtccagttccagttttttgcagtgcagtagcattattcgcattaccgacaaagcgttacgtgaagaactggtgacgctgaccggcgggcaaaaacacgtagcgcaagcggcggagttttgggtgttctgtgccgactttaaccgccatttacagatctgtccggatgctcagctcggcctggcggaacaactgttgctcggtgtcgttgatacggcaatgatggcacagaatgcattaaccgcagcggaatcgctgggattgggcggggtatatatcggcggcctgcgcaataatattgaagcggtgacggaactgctgaaattaccgcagcatgttctgccgctgtttgggctgtgccttggctggcctgcggataatccggatcttaagccgcgtttaccggcctccattttggtgcatgaaaacagctatcaaccgctggataaagacgcactggcgcagtatgacgagcaactggcggaatattacctcacccgtggcagcaataatcgccgggatacctggagcgatcatatccgccgaacaatcattaaagaaagccgcccatttattctggattatttgcacaaacagggttgggcgacgcgctaa

SEQ ID NO: 2002 - protein, 240 aa, Escherichia coli
MTPTIELICGHRSIRHFTDEPISEAQREAIINSARATSSSSFLQCSSIIRITDKALREELVTLTGGQKHVAQAAEFWVFCADFNRHLQICPDAQLGLAEQLLLGVVDTAMMAQNALTAAESLGLGGVYIGGLRNNIEAVTELLKLPQHVLPLFGLCLGWPADNPDLKPRLPASILVHENSYQPLDKDALAQYDEQLAEYYLTRGSNNRRDTWSDHIRRTIIKESRPFILDYLHKQGWATR

SEQ ID NO: 2003 - DNA, 903 bp, Escherichia coli
gtgaaaattgccatattgtcccgggatggaacgctctattcgtgtaagcggctgcgtgaagccgctatacagcgcggtcacctggttgaaattcttgatccgctttcttgctacatgaacataaatcctgcggcgtcttctattcactacaaaggccgcaagttaccccattttgacgcagtgatcccgcgtattggcaccgccattaccttttatgggacggcggcactgcgccagttcgagatgctggggagctatccgctcaatgagtcggtcgccattgcccgggcgcgtgacaaattgcgttccatgcaactgctggcgcgtcagggcatcgacctgcctgtcacgggcattgcgcattcgccggatgataccagcgatttaatcgacatggtcggtggtgcgccgctggtggtcaagctggttgaaggcacgcagggaattggtgtcgtgctggcggagacgcgtcaggcggccgaaagcgtgattgacgctttccgcggtctgaacgcgcatattctggtgcaggaatatatcaaagaggcgcaagggtgcgatatccgctgtctggttgttggcgatgaagtagtcgctgcgattgaacggcgagcgaaagagggcgattttcgttccaatttgcatcgtggcggcgcggcaagcgtcgccagtatcacaccacaggagcgtgaaatcgcgataaaagccgcgcgaacgatggcgctggacgttgctggtgtggatattctgcgtgctaatcgcgggccgttggtgatggaagtgaatgcgtcgccagggctggaaggaatagaaaaaaccaccggtatcgacatcgcgggtaaaatgatccgctggatcgaacgccacgctacgacagaatattgcctgaaaacgggtggttag

SEQ ID NO: 2004 - protein, 300 aa, Escherichia coli
MKIAILSRDGTLYSCKRLREAAIQRGHLVEILDPLSCYMNINPAASSIHYKGRKLPHFDAVIPRIGTAITFYGTAALRQFEMLGSYPLNESVAIARARDKLRSMQLLARQGIDLPVTGIAHSPDDTSDLIDMVGGAPLVVKLVEGTQGIGVVLAETRQAAESVIDAFRGLNAHILVQEYIKEAQGCDIRCLVVGDEVVAAIERRAKEGDFRSNLHRGGAASVASITPQEREIAIKAARTMALDVAGVDILRANRGPLVMEVNASPGLEGIEKTTGIDIAGKMIRWIERHATTEYCLKTGG

SEQ ID NO: 2005 - DNA, 525 bp, Escherichia coli
ttgcgtaagctgtgccggtctttttatcggaagaggttgtacaaaattatgacatcgctggtcgttcctggtctggatacgttgcgtcaatggctcgatgacctggggatgagtttttttgaatgtgataactgtcaggctctgcatctgccccatatgcagaatttcgacggtgtctttgatgctaaaatcgatctgatcgataacacgatcctgttttctgccatggcggaagtccgaccttcagccgtattgccgctggcggcggatttatcagccatcaatgccagttcgctgaccgtgaaagcatttcttgatatgcaggatgataatctgccaaagctggtggtttgccagtctttatccgttatgcagggcgtaacctatgagcagtttgcatggttcgtgcgtcagagcgaagagcagatttcgatggtcattcttgaagctaatgcccatcaactgctgttaccgactgacgatgaagggcaaaataacgttaccgaaaactatttcctccactga

SEQ ID NO: 2006 - protein, 174 aa, Escherichia coli
MRKLCRSFYRKRLYKIMTSLVVPGLDTLRQWLDDLGMSFFECDNCQALHLPHMQNFDGVFDAKIDLIDNTILFSAMAEVRPSAVLPLAADLSAINASSLTVKAFLDMQDDNLPKLVVCQSLSVMQGVTYEQFAWFVRQSEEQISMVILEANAHQLLLPTDDEGQNNVTENYFLH

SEQ ID NO: 2007 - DNA, 1188 bp, Escherichia coli
atgcacgtttattgcatatctttcagtgtgacaacttttgttcgtttgttaacgaattttcagaaggaaagagatatgaccgccttaaataaaaaatggctatcgggtctggttgcgggggctctgatggccgtctctgtcagcacgctcgcggctgaacaaaaaacactccacatttataactggtctgattatatcgccccggacacggtggccaactttgaaaaagaaaccggtattaaagtcgtctacgatgttttcgattctaacgaagtactggaaggcaaattaatggcggggagcaccggctttgatctggtggtgccgtcagcaagctttcttgagcgccagctgacagcgggagttttccagccgctggataaaagcaaattgccggagtggaagaatctcgatccggagctgctgaagttggtcgccaaacacgatcccgacaataaatttgctatgccctatatgtgggcgacgaccgggattggctataacgtcgataaagttaaagcggtgctgggcgaaaacgcgcccgtcgatagctgggacttgatcctcaaacctgaaaatctggaaaaactgaaaagctgcggtgtctctttcctcgatgcgccagaagaagtgtttgctaccgtgctgaattatctcggcaaagatcctaacagcactaaagcggatgattacaccggaccggctaccgatctgctgttaaagctgcgcccgaacattcgttatttccattcatcccaatacatcaatgatctggcgaatggtgacatctgtgtcgctattggctgggcgggcgatgtctggcaggcgtcaaaccgcgcgaaggaagcgaagaatggcgtgaatgtctcgttctcgattccaaaagaaggggcgatggcgttctttgatgtattcgccatgcctgcggatgccaaaaacaaagacgaagcctatcagttcctgaattacctgctgcgtcctgatgtggtggcacatatctctgaccatgtgttctatgctaacgccaataaagcagccacgccgctggtgagtgcggaagtccgtgataacccgggtatttatccgcctgcggatgttcgtgcgaagctgttcactctgaaagtgcaggacccgaaaatcgaccgtgtgcgcacccgcgcgtggaccaaagtgaagagcggaaaataa

SEQ ID NO: 2008 - protein, 395 aa, Escherichia coli
MHVYCISFSVTTFVRLLTNFQKERDMTALNKKWLSGLVAGALMAVSVSTLAAEQKTLHIYNWSDYIAPDTVANFEKETGIKVVYDVFDSNEVLEGKLMAGSTGFDLVVPSASFLERQLTAGVFQPLDKSKLPEWKNLDPELLKLVAKHDPDNKFAMPYMWATTGIGYNVDKVKAVLGENAPVDSWDLILKPENLEKLKSCGVSFLDAPEEVFATVLNYLGKDPNSTKADDYTGPATDLLLKLRPNIRYFHSSQYINDLANGDICVAIGWAGDVWQASNRAKEAKNGVNVSFSIPKEGAMAFFDVFAMPADAKNKDEAYQFLNYLLRPDVVAHISDHVFYANANKAATPLVSAEVRDNPGIYPPADVRAKLFTLKVQDPKIDRVRTRAWTKVKSGK

SEQ ID NO: 2009 - DNA, 1134 bp, Escherichia coli
gtgaatgacgctatccctcgcccgcaggcgaaaacccgtaaggcgctgacgccgctattagaaatccgtaacctgaccaaatcctacgatggtcaacatgcggtggatgatgtcagcctgaccatctacaaaggtgaaatcttcgcgctgctgggcgcatccggctgtggcaagtccacgctgctgcgtatgctggcaggttttgaacaaccttctgccgggcagattatgctcgatggcgtcgatttgtcacaggtgccgccttacctgcgccccatcaatatgatgtttcagtcttacgcgctgtttccgcatatgaccgtggaacagaacatcgcttttggcctgaaacaggacaaactaccgaaagcggaaattgccagccgggtcaatgagatgcttgggctggtgcatatgcaggagttcgccaaacgcaaaccgcatcagctttccggtggtcagcgtcagcgtgtggccctggccagaagccttgccaagcgcccgaaactattactgctcgatgagccgatgggcgcgctggataaaaagctgcgtgaccggatgcagcttgaagtggtggatattctggagcgtgtcggtgtgacttgtgtgatggtcacccacgatcaggaagaggcgatgaccatggcggggcgtatcgccattatgaatcgtgggaaatttgtccagattggcgaaccggaagagatctacgagcatccgaccacccgctatagcgctgaatttatcggttcggttaatgtctttgaaggtgtactcaaagagcgtcaggaagatggtctggtgctttattcgccgggactggtgcacccactgaaagtcgatgcagatgcttcagtggttgataacgtgccggtacacgtagcgctgcgtccggaaaaaatcatgctttgcgaagagccgcccgccaatggttgtaacttcgcggtgggggaggtgatacacattgcctatctcggcgatctttcggtgtatcacgttcgtctgaaaagtgggcagatgatcagcgcccagctacaaaacgcccatcgtcatcgtaaagggttaccgacctggggcgacgaagtacgtttgtgctgggaagtggacagctgtgtggtgctgacggtttaa

SEQ ID NO: 2010 - protein, 377 aa, Escherichia coli
MNDAIPRPQAKTRKALTPLLEIRNLTKSYDGQHAVDDVSLTIYKGEIFALLGASGCGKSTLLRMLAGFEQPSAGQIMLDGVDLSQVPPYLRPINMMFQSYALFPHMTVEQNIAFGLKQDKLPKAEIASRVNEMLGLVHMQEFAKRKPHQLSGGQRQRVALARSLAKRPKLLLLDEPMGALDKKLRDRMQLEVVDILERVGVTCVMVTHDQEEAMTMAGRIAIMNRGKFVQIGEPEEIYEHPTTRYSAEFIGSVNVFEGVLKERQEDGLVLYSPGLVHPLKVDADASVVDNVPVHVALRPEKIMLCEEPPANGCNFAVGEVIHIAYLGDLSVYHVRLKSGQMISAQLQNAHRHRKGLPTWGDEVRLCWEVDSCVVLTV

SEQ ID NO: 2011 - DNA, 954 bp, Escherichia coli
atgagtacacttgaacctgctgcccagtcgaaaccgccgggcggatttaagctgtggttgtcgcagctgcaaatgaagcatgggcgcaaactggtcattgcgttgccatatatctggttgatcttgctgtttctgctgccatttctgatcgtctttaaaataagcctggcggagatggcgcgcgctattccaccttataccgaattgatggagtgggctgacgggcaactttctatcactcttaatctcggtaattttctgcaactgaccgacgatccgctctattttgatgcttatctccagtcgttacaggtggcggcgatttcgactatttgctgtttactgatcggctatccgctggcgtgggcggtggcgcacagtaagccttcgacccgtaatatcttattactactggtgatcctgccgtcgtggacctcgtttctgattcgtgtctacgcctggatgggaatattaaaaaacaacggtgtgctgaataattttctgctgtggctgggggttatcgatcaaccgctgaccattctgcataccaactttgcggtttatattggcattgtttacgcctacgtgccgtttatggtgctgccgatttacaccgcgttgattcgtattgattattcgctggtagaagcggcactggatctcggtgcacgaccgctgaaaacgttctttaccgtgatcatgccactcaccaaaggggggattattgccggatcgatgctggtgtttatccctgctgtgggcgagtttgtgatcccggaactgctcggtggcccggacagcatcatgatcgggcgcgtgctgtggcaggagttctttaacaaccgcgactggccggtagcctcggcggtagcgatcatcatgttgctgctgctaattgtgccgataatgtggtttcacaaacaccagcaaaaaagcgtgggagaacacggatga

SEQ ID NO: 2012 - protein, 317 aa, Escherichia coli
MSTLEPAAQSKPPGGFKLWLSQLQMKHGRKLVIALPYIWLILLFLLPFLIVFKISLAEMARAIPPYTELMEWADGQLSITLNLGNFLQLTDDPLYFDAYLQSLQVAAISTICCLLIGYPLAWAVAHSKPSTRNILLLLVILPSWTSFLIRVYAWMGILKNNGVLNNFLLWLGVIDQPLTILHTNFAVYIGIVYAYVPFMVLPIYTALIRIDYSLVEAALDLGARPLKTFFTVIMPLTKGGIIAGSMLVFIPAVGEFVIPELLGGPDSIMIGRVLWQEFFNNRDWPVASAVAIIMLLLLIVPIMWFHKHQQKSVGEHG

SEQ ID NO: 2013 - DNA, 846 bp, Escherichia coli
atgaataatttaccggttgttcgttcgccctggcggattgtgattttgctgctgggcttcacctttctctacgcgccaatgctgatgctggttatctattcattcaacagctcgaaactggtgacggtgtgggccggctggtcaacgcgctggtatggcgaattattgcgcgatgacgcgatgatgagtgcggttggtttaagtctgacaattgcagcctgtgcggcaacggcagcggcgatcctcgggacgattgcggcggtggtgttggtgcgttttggcaggtttcgcggatcaaatggttttgcctttatgatcaccgcgccgctggtgatgccagatgtcatcacgggtttgtcgctgttgttgttattcgtcgcgcttgctcatgctattggctggcctgcggaccgcggtatgctcaccatctggctggcgcatgtcactttctgtacggcttatgtggcagtcgttatttcgtcgcgtctgcgggaactggatcgctcgatagaagaagccgcgatggatctcggtgcgacgccgctgaaagtgttttttgtcattacgctaccgatgatcatgcccgcgatcatttctggctggttactggcttttactttgtcgcttgatgatctggtgatcgccagctttgtttccgggccgggagccaccactttaccgatgctggtcttttccagcgtgcggatgggggtgaatccggaaatcaacgccctggcaacattgatcctcggcgcggtcggaattgtcggatttatcgcctggtatctgatggcgcgcgcagaaaaacagcggatacgcgacatccagcgtgcaagacgtggctga

SEQ ID NO: 2014 - protein, 281 aa, Escherichia coli
MNNLPVVRSPWRIVILLLGFTFLYAPMLMLVIYSFNSSKLVTVWAGWSTRWYGELLRDDAMMSAVGLSLTIAACAATAAAILGTIAAVVLVRFGRFRGSNGFAFMITAPLVMPDVITGLSLLLLFVALAHAIGWPADRGMLTIWLAHVTFCTAYVAVVISSRLRELDRSIEEAAMDLGATPLKVFFVITLPMIMPAIISGWLLAFTLSLDDLVIASFVSGPGATTLPMLVFSSVRMGVNPEINALATLILGAVGIVGFIAWYLMARAEKQRIRDIQRARRG

SEQ ID NO: 2015 - DNA, 489 bp, Escherichia coli
atggaagacgaaacgttgggattttttaagaaaacatcttcatctcatgctcgcctgaatgtgcctgcgctggtgcaggtggcggcgctcgccattattatgatccgtggcctcgacgtgctgatgattttcaatacgctgggcgtgcgcggtattggcgagttcattcatcgcagcgtacaaacctggagtttaacgctggtctttttgagcagtctggtgctggttttcattgagatctggtgtgcgttttcactggtgaaagggcgtcgctgggcgcgctggctgtatctgttgacacaaatcacagccgcaagttacttgtgggcggcctcgctggggtatggttatccggagctgttcagcattcccggtgaatcaaaacgtgaaatcttccatagcctgatgctgcagaagctgccggatatgctcatcctgatgctgctgttcgttccctcgaccagtcggcggttcttccagttgcaataa

SEQ ID NO: 2016 - protein, 162 aa, Escherichia coli
MEDETLGFFKKTSSSHARLNVPALVQVAALAIIMIRGLDVLMIFNTLGVRGIGEFIHRSVQTWSLTLVFLSSLVLVFIEIWCAFSLVKGRRWARWLYLLTQITAASYLWAASLGYGYPELFSIPGESKREIFHSLMLQKLPDMLILMLLFVPSTSRRFFQLQ

SEQ ID NO: 2017 - DNA, 1128 bp, Escherichia coli
atgcagtgcgcactttacgacgcgggtcgctgtcgttcctgtcagtggataacgcagccgattccagagcaactctccgctaaaaccgtcgatcttaaaaatctgctcgccgattttccggttgaggaatggtgtgcgccggtgtcaggcccggaacaagggtttcgtaataaagccaaaatggtggtgagtggtagcgttgaaaaaccactgctcggtatgctgcatcgggatggtacaccggaagacctttgtgactgcccgctttatccagcctcatttgcgcccgtttttgcggcgctaaaaccgtttatcgcccgtgcgggtttaacgccttacaacgtggcgcgtaaacgtggtgaactgaaatacattctgctgactgaaagccagagcgatggcggcatgatgctgcgttttgtactgcgttctgataccaaactggcgcaactgcgtaaggcgctgccgtggttacaggaacaattaccgcagctgaaagttattaccgtcaatattcagccggtacatatggcgattatggaaggggagacggagatctacctgaccgaacaacaggcactggcagagcgttttaatgacgtaccgctgtggatccgtccgcaaagtttcttccagactaatccggcggtcgccagccagctgtacgccaccgcgcgcgactgggtacgacagctgccggttaaacatatgtgggatctgttctgcggtgtgggtggctttggtttacactgcgcgacgcctgacatgcagttaaccgggatcgaaattgcaccagaggccattgcctgtgcgaagcagtcagccgctgaactgggcttaacgcgtttgcaatttcaggcgctggactctacgcagtttgccaccgctcagggggaagtgccggagctggtgctggttaacccgccgcgccgcggcatcggtaaaccgctgtgtgattatctctcaacgatggcaccgcgttttattatctactccagctgtaacgcccaaactatggcgaaagatatccgcgaactgcctggttatcgcatcgaacgggtacagctttttgatatgttcccgcacaccgcgcactatgaagtgctgacgctgctggtgaagcaataa

SEQ ID NO: 2018 - protein, 375 aa, Escherichia coli
MQCALYDAGRCRSCQWITQPIPEQLSAKTVDLKNLLADFPVEEWCAPVSGPEQGFRNKAKMVVSGSVEKPLLGMLHRDGTPEDLCDCPLYPASFAPVFAALKPFIARAGLTPYNVARKRGELKYILLTESQSDGGMMLRFVLRSDTKLAQLRKALPWLQEQLPQLKVITVNIQPVHMAIMEGETEIYLTEQQALAERFNDVPLWIRPQSFFQTNPAVASQLYATARDWVRQLPVKHMWDLFCGVGGFGLHCATPDMQLTGIEIAPEAIACAKQSAAELGLTRLQFQALDSTQFATAQGEVPELVLVNPPRRGIGKPLCDYLSTMAPRFIIYSSCNAQTMAKDIRELPGYRIERVQLFDMFPHTAHYEVLTLLVKQ

SEQ ID NO: 2019 - DNA, 732 bp, Escherichia coli
atgaaaaagttagttcttgccgctttacttgcttcttttactttcggtgcttctgccgcagagaaaatcaattttggcgtttcagccacctatccaccctttgaatctataggtgctaataatgagattgtcggctttgatatcgacctggcaaaagccttgtgcaaacaaatgcaggcagaatgtacttttactaatcacgcgttcgacagcctgatcccgtcactgaaattcagaaaatatgacgccgtaatctccggaatggatatcacgccggagcgtagcaaacaggtatcgtttaccacgccctactacgaaaactcagccgtcgtgattgccaaaaaagatacctacaaaacgtttgccgatctgaaaggcaaacgtattgggatggaaaacggcaccacgcaccagaaatatattcaggatcagcacccggaagtaaaaactgtctcctatgacagttatcagaatgcctttatcgatctgaaaaatggccgtattgatggcgtatttggtgacaccgcagtggtaaacgaatggctgaaaaccaatccgcaactgggcgttgctactgaaaaagtgaccgatccgcaatacttcggcaccggcctgggtatcgctgtacgtccggataacaaagctctgctggaaaaactgaataacgcgctggcagcaattaaagctgacggtacatatcagaaaatcaatgaccagtggttcccacagtaa

SEQ ID NO: 2020 - protein, 243 aa, Escherichia coli
MKKLVLAALLASFTFGASAAEKINFGVSATYPPFESIGANNEIVGFDIDLAKALCKQMQAECTFTNHAFDSLIPSLKFRKYDAVISGMDITPERSKQVSFTTPYYENSAVVIAKKDTYKTFADLKGKRIGMENGTTHQKYIQDQHPEVKTVSYDSYQNAFIDLKNGRIDGVFGDTAVVNEWLKTNPQLGVATEKVTDPQYFGTGLGIAVRPDNKALLEKLNNALAAIKADGTYQKINDQWFPQ

SEQ ID NO: 2021 - DNA, 669 bp, Escherichia coli
atgtttgagtatttacccgaactgatgaaagggctgcacaccagcctgacgctaaccgttgcctcgctgattgtggcactgattctggcattgatttttaccatcatcctgacgctgaaaacgccggtgctggtgtggctggtgcggggctatatcacgctgtttaccggtacgccgctgctggtgcagatcttcctgatttattacggaccgggccagttcccaacgttgcaggagtatccggcactgtggcatttgttgtcagaaccgtggttatgtgcgctgattgcgttgtcgctgaacagtgcggcgtacaccacgcagctgttttacggtgcgattcgcgcgatcccggaaggtcaatggcagtcctgtagcgccctgggaatgagcaaaaaagatacgctggcgatcctgctgccgtacgcgtttaaacgctcgctctcttcttattccaacgaagtggtgctggtgttcaaaagtacctctctggcttacaccattacgctgatggaagtgatgggatacagccagttgttgtacggacgcacctacgatgtaatggtatttggcgcggcggggattatttacctggtcgtcaacggcctgctgacgctgatgatgcgtctgatcgagcgtaaagcactggcattcgaacggcggaattaa

SEQ ID NO: 2022 - protein, 222 aa, Escherichia coli
MFEYLPELMKGLHTSLTLTVASLIVALILALIFTIILTLKTPVLVWLVRGYITLFTGTPLLVQIFLIYYGPGQFPTLQEYPALWHLLSEPWLCALIALSLNSAAYTTQLFYGAIRAIPEGQWQSCSALGMSKKDTLAILLPYAFKRSLSSYSNEVVLVFKSTSLAYTITLMEVMGYSQLLYGRTYDVMVFGAAGIIYLVVNGLLTLMMRLIERKALAFERRN

SEQ ID NO: 2023 - DNA, 717 bp, Escherichia coli
atgaatgaattttttcctttagcaagcgccgccgggatgaccgtcggccttgccgtttgtgcattgattgtcgggctggcgctggcgatgttctttgcggtatgggagtctgcgaaatggcgtcctgtcgcgtgggcaggttcagcgctggtaaccattctgcgtggcctgccagaaattctggtggtgctgtttatctattttggctcctcgcagctgctgctgacgctttcggatggcttcactatcaatcttgggttcgtgcagatcccggtgcagatggacattgagaacttcgacgttagcccgttcctttgtggtgtcatcgcactgtcactgctgtatgccgcctatgcctcgcaaacgctgcgtggtgcattaaaagcggtgccggtgggtcagtgggaatccggtcaggcgctggggctgtcgaaatcggctatctttttccgtctggtgatgccgcagatgtggcgtcatgcgctgccaggtctcggtaaccagtggctggtgctgctgaaagataccgcgctggtcagtttgattagtgtgaatgatttaatgctacaaaccaaaagcatcgctacccgtacacaggaaccgtttacctggtacattgtggcggcggtgatttacctggtgatcaccctgctcagtcagtacattctcaaacgcattgacctgcgcgcgacacgttttgagcggaggcccagctaa

SEQ ID NO: 2024 - protein, 238 aa, Escherichia coli
MNEFFPLASAAGMTVGLAVCALIVGLALAMFFAVWESAKWRPVAWAGSALVTILRGLPEILVVLFIYFGSSQLLLTLSDGFTINLGFVQIPVQMDIENFDVSPFLCGVIALSLLYAAYASQTLRGALKAVPVGQWESGQALGLSKSAIFFRLVMPQMWRHALPGLGNQWLVLLKDTALVSLISVNDLMLQTKSIATRTQEPFTWYIVAAVIYLVITLLSQYILKRIDLRATRFERRPS

SEQ ID NO: 2025 - DNA, 732 bp, Escherichia coli
atgaaaaaagttctgattgccgcgttaattgcaggttttagtctttccgccacagcagccgaaaccattcgttttgccaccgaagcctcctatcctccgtttgaatcgattgatgcaaacaaccagatcgttggttttgatgtcgacctggcgcaggcattgtgtaaagagattgatgcaacctgcactttctctaaccaggcgtttgacagcctgatcccaagcctgaaattccgtcgcgtagaagcagtgatggcgggcatggatatcactccggagcgtgaaaagcaggtgctgtttaccaccccgtactatgacaactctgccctgtttgtgggtcagcaaggcaaatacaccagtgttgatcagctgaaaggcaaaaaagtcggcgttcagaacgggacgacacaccagaagttcattatggataagcatccggaaatcactaccgtgccatatgacagttaccagaacgcaaaactggatctgcaaaacggtcgtatcgacagcgtatttggtgacaccgcagtggtaaccgaatggctgaaagataacccgaaactggcggcagtgggcgataaagtgaccgataaagattacttcggtactggcctcggcatcgcagtacgccagggcaacactgaactgcagcagaaactcaacactgcgctggaaaaagtgaagaaagatggcacttacgaaaccatctacaacaaatggttccagaagtaa

SEQ ID NO: 2026 - protein, 243 aa, Escherichia coli
MKKVLIAALIAGFSLSATAAETIRFATEASYPPFESIDANNQIVGFDVDLAQALCKEIDATCTFSNQAFDSLIPSLKFRRVEAVMAGMDITPEREKQVLFTTPYYDNSALFVGQQGKYTSVDQLKGKKVGVQNGTTHQKFIMDKHPEITTVPYDSYQNAKLDLQNGRIDSVFGDTAVVTEWLKDNPKLAAVGDKVTDKDYFGTGLGIAVRQGNTELQQKLNTALEKVKKDGTYETIYNKWFQK

SEQ ID NO: 2027 - DNA, 801 bp, Escherichia coli
ttgcataattattctgtcaaaggtattatcttcgacctcaatagctatcagactgccagtatacgagtgtcaatgagtattcaattaaacggcattaattgcttctacggcgcgcatcaggcgctgttcgatatcacgctggattgcccacagggcgaaacgctggtgttacttggccccagcggcgcgggtaaaagctcgctgctgcgtgtactcaatctgcttgagatgccgcgctccggtacgctcaacattgcaggcaaccatttcgatttcaccaaaaccccctctgacaaagcgattcgcgatttgcgtcgtaacgttggcatggtgtttcagcaatacaacctgtggccgcatctgaccgtgcagcaaaacctgattgaagcgccctgtcgtgtactggggttgagtaaagatcaggcgctggcccgtgcagaaaaactgctggaacgtctgcgtctcaaaccttatagcgatcgttacccgctgcatctttctggaggtcagcagcagcgtgttgctattgcccgtgcgttgatgatggaaccgcaggtactgctgttcgatgaaccgaccgccgcactggaccccgaaattacggcacaaatcgtcagcatcattcgtgagctggcagaaacgaatattacccaggtgatcgtcacccacgaagttgaagtggcgcgtaaaaccgccagccgagtggtgtatatggaaaacggtcatatcgtagaacaaggcgacgcgagctgctttaccgagccgcaaaccgaagcatttaaaaactatctctctcactaa

SEQ ID NO: 2028 - protein, 266 aa, Escherichia coli
MHNYSVKGIIFDLNSYQTASIRVSMSIQLNGINCFYGAHQALFDITLDCPQGETLVLLGPSGAGKSSLLRVLNLLEMPRSGTLNIAGNHFDFTKTPSDKAIRDLRRNVGMVFQQYNLWPHLTVQQNLIEAPCRVLGLSKDQALARAEKLLERLRLKPYSDRYPLHLSGGQQQRVAIARALMMEPQVLLFDEPTAALDPEITAQIVSIIRELAETNITQVIVTHEVEVARKTASRVVYMENGHIVEQGDASCFTEPQTEAFKNYLSH

SEQ ID NO: 2029 - DNA, 516 bp, Escherichia coli
atgcgctatagcaaattgaccatgcttatcccttgcgcactgctactcagtgcctgtaccaccgtcacgccagcttataaagataacggcccccgcaccggttcctgtgtccagggggggcctgatagcgtggctcaacagttctatgactaccgcattcaacatcgcggcaatgacattaccgctctacgcccctatttgagtgacaaactggcaaccctacttagcgatgccagccgcgataatagtcatcgtgaattgttaagcagcgatccgttctccagtcgaaccaccttgccagacagcgcccacgttgccagtgcatctactatccctaatcgtgatgcccgtaacattccattgcgcgtggatctcaagcagggtgaccagggctggcaggatgaagtgttaatgattcaggaaggccagtgttgggtcatcgacgatgtgcgctacttaggcggtagcgttcatgccacagcgggtacgctccgtcagtccatcgagaatcgctaa

SEQ ID NO: 2030 - protein, 171 aa, Escherichia coli
MRYSKLTMLIPCALLLSACTTVTPAYKDNGPRTGSCVQGGPDSVAQQFYDYRIQHRGNDITALRPYLSDKLATLLSDASRDNSHRELLSSDPFSSRTTLPDSAHVASASTIPNRDARNIPLRVDLKQGDQGWQDEVLMIQEGQCWVIDDVRYLGGSVHATAGTLRQSIENR

SEQ ID NO: 2031 - DNA, 324 bp, Escherichia coli
atgcaattttctacaaccccaactctggaaggccagaccatcgttgaatattgcggtgtggtgactggcgaagcgattttaggcgcgaatattttccgtgatttctttgccggtatccgcgatatcgttggcggacgctccggtgcctacgaaaaagaactgcgtaaagcgcgggagattgcctttgaggagctcggctcccaggcgcgagcgctgggggctgatgccgtcgtcggtattgatatcgactacgaaacggtcgggcaaaacggcagtatgctgatggttagcgtcagcggtacggcggtgaaaacgcgtcgatga

SEQ ID NO: 2032 - protein, 107 aa, Escherichia coli
MQFSTTPTLEGQTIVEYCGVVTGEAILGANIFRDFFAGIRDIVGGRSGAYEKELRKAREIAFEELGSQARALGADAVVGIDIDYETVGQNGSMLMVSVSGTAVKTRR

SEQ ID NO: 2033 - DNA, 831 bp, Escherichia coli
atgagaagagtcttctggctggtcgctgccgctctgttactggcagggtgcacaggcgaaaaaggcattgtcgagaaagagggatatcagcttgatacccgacgccaggcgcaggcggcgtatccgcgcattaaagtgctggtgatccactacaccgcagatgattttgatagctcgctggcgacactgaccgataagcaggtcagctcgcattatctggtccctgcggtgccaccgcgatacaacggtaaaccgcgcatctggcaactggtgccggaacaagaactggcctggcatgcggggattagcgcctggcgcggggcaacgcgccttaacgacacctctattggcattgagctggaaaaccgtggctggcaaaaatcggcgggagtgaaatattttgccccgtttgaaccggcacagattcaggcgcttattccgctggcgaaagatattattgcccgttattacatcaagccggaaaacgtagtagcacatgcggatattgcgccgcagcgcaaagacgatccggggccattatttccctggaagcaactggcgcagcaggggattggtgcctggccggatgcgcagcgggtgaacttttaccttgccgggcgcgcgccgcacacaccggtagagaccgcgtcattgctggagcttttggcgcgttatggttatgacgtaaagcctgatatgactccgcgcgagcagcggcgcgtgattatggcgttccagatgcatttccgcccgacgttatacaacggcgaagcggatgcagaaactcaggcgattgccgaagcgttgctggagaaatacgggcaggattag

SEQ ID NO: 2034 - protein, 276 aa, Escherichia coli
MRRVFWLVAAALLLAGCTGEKGIVEKEGYQLDTRRQAQAAYPRIKVLVIHYTADDFDSSLATLTDKQVSSHYLVPAVPPRYNGKPRIWQLVPEQELAWHAGISAWRGATRLNDTSIGIELENRGWQKSAGVKYFAPFEPAQIQALIPLAKDIIARYYIKPENVVAHADIAPQRKDDPGPLFPWKQLAQQGIGAWPDAQRVNFYLAGRAPHTPVETASLLELLARYGYDVKPDMTPREQRRVIMAFQMHFRPTLYNGEADAETQAIAEALLEKYGQD

SEQ ID NO: 2035 - DNA, 1077 bp, Escherichia coli
ttgcatcatgggggaaatcacggaagaatgcgcacgttattttctcaacaacagtggattgatatgaaggtactggttaccggcgccaccagcggcttaggtcgaaacgcggtagagtttttatgccagaaaggcatcagcgtgcgagcgaccggtcgcaacgaggcaatgggtaaattgctggaaaaaatgggcgcagagtttgttccggcggatctgaccgagctggtttcatcacaagctaaagtgatgctcgcgggcattgatacgctgtggcactgctccagctttacctcgccctgggggacacaacaggctttcgatctggctaacgttcgcgccactcgccgcctgggtgaatgggctgtcgcctggggtgtgcgtaactttattcatatctcttccccctccctgtacttcgattatcaccaccatcgcgatattaaagaagattttcgccctcaccgcttcgccaacgagtttgcccgcagcaaagcagccagcgaagaggtgatcaatatgctttcgcaggcgaatccacaaacgcgctttactattctgcgcccacaaagtctgttcggaccgcacgataaagtctttatcccccgtctggcgcatatgatgcaccactacggcagcattctgttaccgcacggcggcagtgcgctggtcgatatgacctactatgaaaatgccgtgcacgccatgtggctggcaagccaggaagcctgcgataagctaccttccgggcgtgtgtacaacatcaccaacggcgagcatcgcacactgcgcagcatcgtgcagaagctgatcgacgagttgaatattgactgtcgtattcgttccgtcccttacccgatgctggatatgatcgcccgcagcatggagcgtttaggccgcaagtcagcaaaagagccgccgctgacccactacggcgtctccaagttgaattttgactttacgctggatattacgcgtgcgcaggaagagttaggttatcaaccagtcctcaccctggatgaaggtatcgagaaaactgccgcctggctacgcgaccacggaaaactgccgcgctaa

SEQ ID NO: 2036 - protein, 358 aa, Escherichia coli
MHHGGNHGRMRTLFSQQQWIDMKVLVTGATSGLGRNAVEFLCQKGISVRATGRNEAMGKLLEKMGAEFVPADLTELVSSQAKVMLAGIDTLWHCSSFTSPWGTQQAFDLANVRATRRLGEWAVAWGVRNFIHISSPSLYFDYHHHRDIKEDFRPHRFANEFARSKAASEEVINMLSQANPQTRFTILRPQSLFGPHDKVFIPRLAHMMHHYGSILLPHGGSALVDMTYYENAVHAMWLASQEACDKLPSGRVYNITNGEHRTLRSIVQKLIDELNIDCRIRSVPYPMLDMIARSMERLGRKSAKEPPLTHYGVSKLNFDFTLDITRAQEELGYQPVLTLDEGIEKTAAWLRDHGKLPR

SEQ ID NO: 2037 - DNA, 1431 bp, Escherichia coli
gtgccgcaacgcattttagttctcggtgccagtggctacattggtcagcatctggtgcgcacactcagccagcaagggcatcagctcctggcggcggcacgtcatgtcgacaggcttgcaaagctgcaactggcaaatgtcagttgccataaagtcgatctcagctggccggataaccttccggccctgttgcaggatattgatacggtctattttctggtgcacagcatgggcgaaggcggcgattttatcgctcaggagcgccaggtggctctcaacgtccgcgatgcgctacgtgaagtcccagttaagcaattaatctttctcagttcgttgcaggccccgccacatgagcagtcggaccatctgcgcgcccgtcaggctacggcggacattcttcgtgaagcgggtgtcccggtgaccgaattgcgtgccggaataatcgttggtgcaggttcagcggcgttcgaggtcatgcgcgatatggtctacaacctgccagtgttaacgccgccacgctgggtccgttcacgcaccacgcccatcgcgctggaaaacttgctgcactatctggtggcgctgttagatcatccagccagcgaacatcgcatcttcgaagccgccggaccagaagtgctcagttatcagcaacagtttgaacattttatggcggtgagcggtaagcgccgctggttgctccccatcccctttcccacccgctggatttcggtgtggtttcttaatgtgattacttccgtaccacccaccaccgccagggcgttgattcaggggctgaaacacgatctgctggcagatgacaccgcgttacgtgcactcattccacaaccgctgattgctttcgatgacgcggtacgtagcacgttgaaagaggaagaaaaactggtcaactccagcgactggggatatgacgcgcaggcttttgctcgctggcgaccagaatacggttattttgccaaacaggcggggtttaccgttaaaacgtctgccagacttcaggcgctatggcgggtggtcaatcaaatcggcggtaaagagcgttatttctttggcaatattttgtggcagactcgagcgctgatggaccttgcgatcggtcataaactggcaaaaggccgcccggagcgcgaatatttgcaaactggcgatgcggtggatagctggaaagtcattgtcgttgaaccggaaaaacaacttacgctgttatttggcatgaaagcgccggggctgggacgactgtgttttaccctggaagataaaggtgactatcgtactatcgatgttcgcgcattctggcatccgcacggtatgccagggttgttttactggttattgatgatccccgcgcatctgtttatttttcgcggaatggcaaaacgaatcgccagactggcagaacaaagcacagattaa

SEQ ID NO: 2038 - protein, 476 aa, Escherichia coli
MPQRILVLGASGYIGQHLVRTLSQQGHQLLAAARHVDRLAKLQLANVSCHKVDLSWPDNLPALLQDIDTVYFLVHSMGEGGDFIAQERQVALNVRDALREVPVKQLIFLSSLQAPPHEQSDHLRARQATADILREAGVPVTELRAGIIVGAGSAAFEVMRDMVYNLPVLTPPRWVRSRTTPIALENLLHYLVALLDHPASEHRIFEAAGPEVLSYQQQFEHFMAVSGKRRWLLPIPFPTRWISVWFLNVITSVPPTTARALIQGLKHDLLADDTALRALIPQPLIAFDDAVRSTLKEEEKLVNSSDWGYDAQAFARWRPEYGYFAKQAGFTVKTSARLQALWRVVNQIGGKERYFFGNILWQTRALMDLAIGHKLAKGRPEREYLQTGDAVDSWKVIVVEPEKQLTLLFGMKAPGLGRLCFTLEDKGDYRTIDVRAFWHPHGMPGLFYWLLMIPAHLFIFRGMAKRIARLAEQSTD

SEQ ID NO: 2039 - DNA, 1002 bp, Escherichia coli
atgattgatttacgcagtgataccgttacccgaccgagccgcgccatgctcgaagcgatgatggccgccccggttggggacgacgtttacggagacgaccctaccgttaatgctctgcaggactatgcagcagagctttccggtaaagaagccgccatttttctgccgaccggcactcaggccaacctggtcgctctgctcagtcactgcgaacgcggcgaagagtatatcgtcggtcaggccgcgcataactatctgtttgaagccggtggcgcagcagtgctgggcagtattcagccgcaacccatcgacgcagctgccgacggcacgctaccgctggataaagtggcgatgaaaatcaaacccgacgatatccatttcgcccgcaccaaattactcagtctggaaaacacccacaacggcaaagtgctgccgcgtgaatacttaaaagaggcatgggaatttacccgcaagcgcaatctggcgctgcatgttgacggtgcgcgcatctttaatgccgtggtggcttacggctgcgaactgaaagagatcacgcaatattgtgactcgttcaccatttgcctgtcgaaaggtcttgggacgccagtcggttcattactcgtcggtaatcgtgattacattaaacgtgccattcgctggcggaaaatgacaggtggcgggatgcgccagtccggcattctggctgccgccgggatgtatgcgctgaaaaataacgtcgcacgtttgcaggaagaccacgacaatgccacctggatggcggagcagttgcgtgaagcaggcacggatgtgatgcgtcaggacaccaatatgctgtttgttcgcgtcggggaagaaaatgctgccgcgttaggcgaatacatgaaagcgagaaacgtgctgattaacgcctcgccgattgtccgcctggtgacccatcttgacgtctcgcgtgcacaactggcggaagtcgccgcccactggcgcgcattcctggcgcgttaa

SEQ ID NO: 2040 - protein, 333 aa, Escherichia coli
MIDLRSDTVTRPSRAMLEAMMAAPVGDDVYGDDPTVNALQDYAAELSGKEAAIFLPTGTQANLVALLSHCERGEEYIVGQAAHNYLFEAGGAAVLGSIQPQPIDAAADGTLPLDKVAMKIKPDDIHFARTKLLSLENTHNGKVLPREYLKEAWEFTRKRNLALHVDGARIFNAVVAYGCELKEITQYCDSFTICLSKGLGTPVGSLLVGNRDYIKRAIRWRKMTGGGMRQSGILAAAGMYALKNNVARLQEDHDNATWMAEQLREAGTDVMRQDTNMLFVRVGEENAAALGEYMKARNVLINASPIVRLVTHLDVSRAQLAEVAAHWRAFLAR

SEQ ID NO: 2041 - DNA, 1719 bp, Escherichia coli
atgaaacaaacggttgcagcttatatcgccaaaacactcgaatcggcaggcgtgaaacgcatctggggagtcacgggcgactctctgaacggtcttagtgacagtcttaatcgcatgggcaccatcgagtggatgtccacccggcatgaagaagtggcggcgtttgccgctggcgctgaagcacaacttagcggagaactggcggtctgtgccggatcgtgcggtcccggcaacctgcacttaatcaacggcctgttcgattgccaccgcaatcacgttccggtactggcgattgccgctcatattccctccagcgaaattggcagcggctatttccaggaaacccacccacaagagttattccgcgaatgtagtcactattgcgagctggtttccagcccagagcagatcccacaagtgctggcaattgctatgcgcaaagcggtgcttaaccgtggcgtttccgttgttgtgttaccgggcgacgtggcgttaaaacctgcgccagaaggggcaactacccactggtatcatgcgccacagccggtagtaacaccggaagaagaagagttacgcaaactggcgcaactgctgcgttattccagcaatatcgccctgatgtgtggcagcggctgtgcgggggcgcataaagagttagttgagtttgccgggaaaattaaagcgcctatagtccatgccctgcgcggtaaagaacatgtcgaatacgataatccatatgatgttggaatgacgggattaatcggcttttcgtcaggtttccataccatgatgaacgccgatacgttagtgctgctcggtactcagtttccctaccgtgtgttctacccgaccgatgccaaaattattcagattgatatcaacccagccagcatcggcgcgcatagcaaggtagatatggcgctggtcggcgatatcaaatcaaccctgcgcgcattgctgccactggtggaagaaaaaaccgaacgcaagtttctggataaggcgctggaagattaccgcgacgcccgcaaagggctggacgatttagctaaaccgagtgagaaagccattcacccgcaatatctggcgcagcaaattagtcattttgccgccgatgacgctattttcacctgtgacgttggtacgccaacggtgtgggcggcacgttatctaaaaatgaacggcaagcgtcgcctgttaggttcgtttaaccatggttcgatggctaacgccatgccgcaggcgctgggcgcgcaggcaaccgagccggaacgccaggtggtcgccatgtgcggcgatggcggttttagcatgttgatgggcgatttcctctcggtagtgcagatgaaactgccagtgaaaattatcgtctttaataacagcgtgctgggctttgtggcgatggagatgaaagctggtggctatttgactgatggcaccgaactacacgacaccaactttgcccgaattgccgaagcctgcggcattacgggtattcgtgtagaaaaagcgtctgaaatcgatgaagctctgcaacgcgccttctccatcgacggtccggtgttggtggatgtggttgtcgccaaagaagaattagccattccaccgcagatcaaactcgaacaggccaaaggtttcagcctgtatatgctgcgcgcaatcatcagcggacgcggtgatgaagtgatcgaactggcgaaaacgaactggctaaggtaa

SEQ ID NO: 2042 - protein, 572 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATTHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRVFYPTDAKIIQIDINPASIGAHSKVDMALVGDIKSTLRALLPLVEEKTERKFLDKALEDYRDARKGLDDLAKPSEKAIHPQYLAQQISHFAADDAIFTCDVGTPTVWAARYLKMNGKRRLLGSFNHGSMANAMPQALGAQATEPERQVVAMCGDGGFSMLMGDFLSVVQMKLPVKIIVFNNSVLGFVAMEMKAGGYLTDGTELHDTNFARIAEACGITGIRVEKASEIDEALQRAFSIDGPVLVDVVVAKEELAIPPQIKLEQAKGFSLYMLRAIISGRGDEVIELAKTNWLR

SEQ ID NO: 2043 - DNA, 969 bp, Escherichia coli
atgacgatgccaacgaatcaatgcccgtggcggatgcaggttcatcacattacgcaagaaacgccggatgtgtggacgatttccctgatttgccacgattactacccatatcgcgccgggcaatatgcgctggtcagcgtgcgaaactcagcagaaacgctgcgtgcttacaccatttcctccacgccaggcgtgagtgaatacatcaccctgaccgtgcggcggattgatgacggtgtcggctcccggtggctgacgcgcgatgtaaaacgcggtgattatctctggctttcggacgcgatgggggaatttacctgcgacgataaagcagaagataaattcctgttgctggcggcaggctgcggcgtcacgccgattatgtcgatgcgtcgctggctggcgaagaaccgtccacaggccgatgtgcaggtgatctacaacgtgcgtacgccgcaggatgtgattttcgccgatgagtggcgtaactatccggtaacgctggtggcggaaaataacgttaccgaaggctttatcgctggtcgtctcactcgcgaactgctgactcgcgttcctgatttagcctcacgtaccgtgatgacctgtggccctgctccatatatggattgggtagagcaggaagtgaaagcgctcggcgtgacgcgtttctttaaagagaaattcttcaccccagtagcggaagcggcgaccagtggtctgaaattcaccaaactgcaaccggcacgagaattttacgctccggttggcaccacgctactggaggcgctggaaagcaataacgttccggttgtcgccgcctgccgtgcgggtgtttgcggctgctgtaagacgaaagtgatttccggtgaatatacggtgagcagcacaatgacgctgaccgacgccgaaatcgctgaaggttacgtactggcctgctcctgccatccgcagggggatttggttctcgcataa

SEQ ID NO: 2044 - protein, 322 aa, Escherichia coli
MTMPTNQCPWRMQVHHITQETPDVWTISLICHDYYPYRAGQYALVSVRNSAETLRAYTISSTPGVSEYITLTVRRIDDGVGSRWLTRDVKRGDYLWLSDAMGEFTCDDKAEDKFLLLAAGCGVTPIMSMRRWLAKNRPQADVQVIYNVRTPQDVIFADEWRNYPVTLVAENNVTEGFIAGRLTRELLTRVPDLASRTVMTCGPAPYMDWVEQEVKALGVTRFFKEKFFTPVAEAATSGLKFTKLQPAREFYAPVGTTLLEALESNNVPVVAACRAGVCGCCKTKVISGEYTVSSTMTLTDAEIAEGYVLACSCHPQGDLVLA

SEQ ID NO: 2045 - DNA, 1653 bp, Escherichia coli
atgttttgtgtgcaatgtgaacaaactatccgtactccggcaggaaacggctgctcatacgcgcaggggatgtgtggtaaaacggcggaaacctctgaccttcaggatttactcatcgcggcgctgcaagggctttcggcctgggcagtgaaagcacgtgaatacggcatcatcaaccacgatgtagacagctttgcgccacgtgcctttttctcaaccctgaccaacgttaacttcgattctccgcgtattgtcggctacgctcgtgaagcgattgccctgcgcgaggcgctgaaagcacaatgcctggctgtagatgccaacgcccgcgtcgataacccgatggctgacctgcaactggtgagcgacgatctcggcgagctgcaacgtcaggcagcagaatttacccctaacaaagataaagcggcgattggcgaaaacattctcggcctgcgtctgctgtgcctgtatggcctgaaaggtgcggcggcctatatggaacacgcgcatgttctcggtcaatacgacaacgatatttatgcccagtaccataaaatcatggcgtggctggggacctggcctgccgatatgaacgcgcttcttgagtgttcaatggaaatcggccagatgaatttcaaagtgatgagcattctggatgcaggcgaaaccggtaaatacggtcacccgaccccaacccaggtcaatgtcaaagcgacggcgggtaaatgcattctgatttccggtcacgatctcaaagatctctacaacctgctggaacagaccgaaggcacgggcgttaatgtctacacccacggcgaaatgctgcctgcgcatggttacccggagttgcgtaaattcaagcatctggtcggtaactacggcagcggctggcagaatcagcaagtggagttcgctcgtttcccaggccccatcgtgatgacctcgaactgcatcatcgacccaaccgtaggcgcttatgacgatcgtatctggacccgcagcatcgttggctggccgggtgtgcgtcatctggatggcgaagatttctctgcagtcattgcccaggcgcaacagatggcgggcttcccgtacagcgaaattccgcacctgatcaccgtgggctttggtcgccagacactgcttggcgcagccgatacgctgattgatctggtgagccgtgaaaaactgcgtcatatcttcctgcttggcggctgtgacggcgcacgcggcgagcgtcactacttcaccgatttcgccaccagcgtgccggatgactgcctgatcctgaccctcgcttgcggtaaatatcgctttaataaacttgagtttggcgatatcgaaggtctgccgcgtctggtagatgctggtcagtgtaacgatgcttactcagcaattattctggcggtaacgctggcagagaaactgggctgtggggtgaacgatctgccgctgtcgctggtgctctcctggtttgaacagaaagcgattgtcattctgctgacgctgctttctctgggtgtgaaaaatatcgtcaccggcccgactgcacctggtttcctgacaccagacctgctggcggtgctgaacgagaaattcggcctgcgttctatcaccactgttgaagaagacatgaagcaactgttgagcgcgtaa

SEQ ID NO: 2046 - protein, 550 aa, Escherichia coli
MFCVQCEQTIRTPAGNGCSYAQGMCGKTAETSDLQDLLIAALQGLSAWAVKAREYGIINHDVDSFAPRAFFSTLTNVNFDSPRIVGYAREAIALREALKAQCLAVDANARVDNPMADLQLVSDDLGELQRQAAEFTPNKDKAAIGENILGLRLLCLYGLKGAAAYMEHAHVLGQYDNDIYAQYHKIMAWLGTWPADMNALLECSMEIGQMNFKVMSILDAGETGKYGHPTPTQVNVKATAGKCILISGHDLKDLYNLLEQTEGTGVNVYTHGEMLPAHGYPELRKFKHLVGNYGSGWQNQQVEFARFPGPIVMTSNCIIDPTVGAYDDRIWTRSIVGWPGVRHLDGEDFSAVIAQAQQMAGFPYSEIPHLITVGFGRQTLLGAADTLIDLVSREKLRHIFLLGGCDGARGERHYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFLTPDLLAVLNEKFGLRSITTVEEDMKQLLSA

SEQ ID NO: 2047 - DNA, 945 bp, Escherichia coli
gtgtcatcgcgcatttcgaatcttctttgcaaggactgggttttcatgttttctgggctgttaatcattctggttcccctgattgtgggttacctcattccgcttcgccaaaaagctgcattaagagttattaatcagctattaagttggatggtttaccttattctcttttttatgggtatcagtctggcgtttctcgataacctcgccagtaacttgttggcaattctgcattattctgccgtcagtattaccgttattttactgtgtaatattgccgccctgatgtggctggagcgcggcctgccatggcgcaaccaccatcatcaagaaaaactcccgtcgcgtattgcgatggcgctggagtcgctaaaactgtgcggcgtagtagtgattggttttgccattggtctgagtggactggctttcttacaacacgcgaccgaagccagtgaatacaccttaattctgctacttttcctcgtcggtattcagttgcgcaataatggcatgaccttaaagcagattgtccttaatcgccggggaatgattgtcgccgtggtggtggttgccagttcattaattggtggtttaattaacgcctttattcttgatcttcccatcaataccgcgctggcaatggcctccggtttcggctggtattctctttccggtattttattgaccgaatcttttggtccggtaatcgggagcgcggcgttttttaatgatctggcccgtgagctgattgctattatgttaatccctgggctgattcgccgtagccgctctactgcactgggcttatgcggtgcgacgtcgatggatttcaccctgcccgttcttcaacgtacaggcgggctggatatggtcccggcggcgattgttcacggttttattcttagtctgttagtgccgattctcatcgcctttttctctgcataa

SEQ ID NO: 2048 - protein, 314 aa, Escherichia coli
MSSRISNLLCKDWVFMFSGLLIILVPLIVGYLIPLRQKAALRVINQLLSWMVYLILFFMGISLAFLDNLASNLLAILHYSAVSITVILLCNIAALMWLERGLPWRNHHHQEKLPSRIAMALESLKLCGVVVIGFAIGLSGLAFLQHATEASEYTLILLLFLVGIQLRNNGMTLKQIVLNRRGMIVAVVVVASSLIGGLINAFILDLPINTALAMASGFGWYSLSGILLTESFGPVIGSAAFFNDLARELIAIMLIPGLIRRSRSTALGLCGATSMDFTLPVLQRTGGLDMVPAAIVHGFILSLLVPILIAFFSA

SEQ ID NO: 2049 - DNA, 702 bp, Escherichia coli
gtggatatgttcagaaaattagcagctgaatgttttggtactttctggcttgtttttggcggctgtggtagtgccgtactggccgcaggcttcccggaattaggcattggttttgccggcgtggcgttggcgttcggtctgaccgttctgacaatggcctttgctgttggtcatatttctggtggtcattttaacccggcggtcactattggtttatgggctggcggacgtttcccggcaaaagaagtcgttggctacgtaattgcccaggttgtcggcggtattgttgcggcggcgctgctgtatttaattgccagtggtaaaacgggttttgacgcggcagccagcggttttgcttctaacggttatggcgagcattcaccaggcggttattccatgctttccgcgctggtagttgaactggtattgagtgcaggtttcctgctggtgatccacggcgcaactgacaaattcgctcctgctggttttgcgccaattgccattggtctggccttaaccctgattcacttaatcagtattccggtgactaacacttccgttaacccggcgcgcagtactgcggttgctatcttccagggcggctgggcattagaacaactgtggttcttctgggtggtgccaattgtcggcggtattatcggtggtctgatttaccggactctactggaaaaacgcgattaa

SEQ ID NO: 2050 - protein, 233 aa, Escherichia coli
MDMFRKLAAECFGTFWLVFGGCGSAVLAAGFPELGIGFAGVALAFGLTVLTMAFAVGHISGGHFNPAVTIGLWAGGRFPAKEVVGYVIAQVVGGIVAAALLYLIASGKTGFDAAASGFASNGYGEHSPGGYSMLSALVVELVLSAGFLLVIHGATDKFAPAGFAPIAIGLALTLIHLISIPVTNTSVNPARSTAVAIFQGGWALEQLWFFWVVPIVGGIIGGLIYRTLLEKRD

SEQ ID NO: 2051 - DNA, 1659 bp, Escherichia coli
atgattcttgagcgcgttgaaattgtgggttttcgcggtatcaaccgtttgtcgttgatgctggaacaaaacaacgtcctgattggggagaacgcgtggggtaaatccagcttgctggacgccttaaccctgctgctatcgccagaatcagatctctaccattttgagcgcgatgatttctggttcccgccgggagatatcaacgggcgagaacatcatctgcatattattttgaccttccgcgaatcgctgccaggccgacatcgggttcgccgctatcggccgctggaagcgtgctggacgccatgcaccgatggttatcaccgtattttttatcgtctggaaggggagagtgcggaagacggcagcgtgatgacactgcgcagttttctcgataaagacggacatccgattgatgttgaggatattaacgatcaggctcgtcatctggtgcgtttaatgccggtgctgcgcttgcgtgatgcccgttttatgcgccgtattcgtaacggcacggtgccaaatgtccccaatgtggaagtcaccgcgcgccagctcgatttcctcgcccgtgaattatcctcacatccgcaaaatctctctgatgggcagattcgtcagggactttccgcaatggtgcaacttcttgagcattatttttctgagcagggagctggacaggcgcgatatcgtttaatgcggcggcgagccagcaatgagcaacgaagctggcgctatctggatatcatcaaccggatgattgaccgacctggagggcgctcgtatcgggttattttgctcggcctgtttgctactttattgcaggcaaaaggcacattgcgactggataaagacgcccgtccattgttgctgatcgaagatccagaaacccgtttacaccccattatgctttcagttgcctggcatctgttgaatcttctgccattgcagcgcattgccaccaccaactctggcgagctgctttcgttaacgccggtagagcatgtttgccgactggtacgtgagtcctcgcgcgttgccgcctggcgtctgggaccgagtggcttgagtaccgaagatagccgacgcatctcctttcacattcgttttaaccgtccgtcatcgctgtttgcccgctgttggctgctggtggaaggggaaacggaaacctgggttatcaatgaactggcgcgtcagtgcggacatcattttgatgccgaagggatcaaggtcattgagtttgcccagtccggactaaagccactggttaaatttgcccggcgaatggggattgaatggcatgtactggtcgatggcgatgaagcagggaagaaatatgccgctacggtacgcagcctgttgaataacgatcgggaagccgaacgagaacatttaacggcgttaccggcgctggatatggaacattttatgtatcgccagggattttccgatgtgttccaccgcgtggcgcaaatcccggaaaatataccgatgaatctgcgcaaagttatctcgaaagcgatccatcgctcttccaaacccgatcttgccattgaagtggcaatggaggccggacgtcgtggtgtggactccgtaccgacgctgctgaaaaaaatgttctcacgcgtgctgtggctggcgcgcggtcgggccgactaa

SEQ ID NO: 2052 - protein, 552 aa, Escherichia coli
MILERVEIVGFRGINRLSLMLEQNNVLIGENAWGKSSLLDALTLLLSPESDLYHFERDDFWFPPGDINGREHHLHIILTFRESLPGRHRVRRYRPLEACWTPCTDGYHRIFYRLEGESAEDGSVMTLRSFLDKDGHPIDVEDINDQARHLVRLMPVLRLRDARFMRRIRNGTVPNVPNVEVTARQLDFLARELSSHPQNLSDGQIRQGLSAMVQLLEHYFSEQGAGQARYRLMRRRASNEQRSWRYLDIINRMIDRPGGRSYRVILLGLFATLLQAKGTLRLDKDARPLLLIEDPETRLHPIMLSVAWHLLNLLPLQRIATTNSGELLSLTPVEHVCRLVRESSRVAAWRLGPSGLSTEDSRRISFHIRFNRPSSLFARCWLLVEGETETWVINELARQCGHHFDAEGIKVIEFAQSGLKPLVKFARRMGIEWHVLVDGDEAGKKYAATVRSLLNNDREAEREHLTALPALDMEHFMYRQGFSDVFHRVAQIPENIPMNLRKVISKAIHRSSKPDLAIEVAMEAGRRGVDSVPTLLKKMFSRVLWLARGRAD

SEQ ID NO: 2053 - DNA, 777 bp, Escherichia coli
atgaacgaactttcccactggcctaatctcaatgtgttgttaacgcgccagccgcgactgcctgtacgtctacatcgcccttaccttgcggcgaatcttagccgtaagcaattgctggaggcgttacgttaccattatgcgttactccgcgggtgtatgtcggcggaagaattcagcttatatttgaatacccccgggctgcaactggcgaagctggaaggcaaaaacggcgagcagttcacgcttgagctgaccatgatgatctcaatggataaagaaggtgacagcaccatcctgttccgcaacagcgaaggtattcctctggcagagctcacttttaccctgtgtgaatatcaggggaaaaggacgatgtttattggcggactgcaaggcgcaaaatgggaaattccacaccaggaaatccagaatgcgacgaaagcctgccacgggctatttcccaaacgcctcgtgatggaagcggcctgtctgtttgcccaacgtttgcaggtagagcagattattgccgtcagcaatgaaacgcatatttaccgcagcctgcgttatcgcgataaagagggcaagatccatgccgattacaacgctttctgggaatcggttggcggcgtatgtgatgctgaacgccattaccgccttccagcacagatagcacgaaaagagattgccgaaatcgccagtaaaaaacgggctgaataccgtcggcgctatgagatgctcgacgctattcagccacaaatggccacgatgttttgtagttag

SEQ ID NO: 2054 - protein, 258 aa, Escherichia coli
MNELSHWPNLNVLLTRQPRLPVRLHRPYLAANLSRKQLLEALRYHYALLRGCMSAEEFSLYLNTPGLQLAKLEGKNGEQFTLELTMMISMDKEGDSTILFRNSEGIPLAELTFTLCEYQGKRTMFIGGLQGAKWEIPHQEIQNATKACHGLFPKRLVMEAACLFAQRLQVEQIIAVSNETHIYRSLRYRDKEGKIHADYNAFWESVGGVCDAERHYRLPAQIARKEIAEIASKKRAEYRRRYEMLDAIQPQMATMFCS

SEQ ID NO: 2055 - DNA, 1155 bp, Escherichia coli
  n 12, 13, 14, 15, 16: n is any nucleotide
atgaatgaatgnnnnncatatggagtattcagaatatttatgaaaaagcggaaaaccgtgaagaagcgttacgttattgcgatggtgatagtcatcgccgggctgattacgttatggagaattcttaacgcacccgtgccgacttatcagacgctgattgtgcgccccggtgatttacagcaaagcgtgctggcgaccggaaagctggacgcgctgcgtaaggttgacgtgggcgcgcaggtcagcggtcagttgaaaacgctgtcggtggcgattggcgataaagtaaaaaaagaccagcttttaggggttattgatcctgaacaggctgaaaaccagatcaaggaggtggaagcaatgctgatggagctacgcgcgcagcggcagcaggcggaagcggagctgaaactggcgcgggtgacgtattcccgtcagcaacgtcttgcacaaacgcaagcggtttcacagcaggatctcgataacgccgcgacggagatggctgtgaaacaggcgcaaattggcaccattgacgcgcaaatcaagcgcaatcaggcctctctcgatacggctaaaaccaatctcgattacacccgcatcgttgccccgatggccggggaagtcacgcaaatcaccactctgcaaggccagacggtgattgccgcacaacaagcaccgaacattctgacgctggcagatatgagcaccatgctggtaaaagcgcaggtttctgaagcggatgtaatccacctgaagccggggcaaaaagcctggtttacggtgcttggcgatccactgacgcgctacgaggggcaaatcaaggatgtgctaccgacgccggaaaagattaacgacgctattttctattacgcccgttttgaagtacccaaccccaatggtttactgcggctggatatgaccgcgcaagtgcatattcagctcaccgatgtgaaaaatgtgctgacgatccctctgtcggcgttaggcgatccggttggcgataatcgttataaagtcaaattgttgcgtaatggtgaaacacgcgagcgtgaagtgacgattggcgcacgtaacgataccgatgttgagattgtcaaagggctggaagcgggcgatgaagtggtgattggtgaggccaaaccaggagctgcgcaatga

SEQ ID NO: 2056 - protein, 384 aa, Escherichia coli
  Xaa 4, 5, 6: Xaa is any amino acid
MNEXXXYGVFRIFMKKRKTVKKRYVIAMVIVIAGLITLWRILNAPVPTYQTLIVRPGDLQQSVLATGKLDALRKVDVGAQVSGQLKTLSVAIGDKVKKDQLLGVIDPEQAENQIKEVEAMLMELRAQRQQAEAELKLARVTYSRQQRLAQTQAVSQQDLDNAATEMAVKQAQIGTIDAQIKRNQASLDTAKTNLDYTRIVAPMAGEVTQITTLQGQTVIAAQQAPNILTLADMSTMLVKAQVSEADVIHLKPGQKAWFTVLGDPLTRYEGQIKDVLPTPEKINDAIFYYARFEVPNPNGLLRLDMTAQVHIQLTDVKNVLTIPLSALGDPVGDNRYKVKLLRNGETREREVTIGARNDTDVEIVKGLEAGDEVVIGEAKPGAAQ

SEQ ID NO: 2057 - DNA, 1947 bp, Escherichia coli
atgacacccttgctcgaattaaaggatattcgtcgcagctatcctgccggtgatgagcaggttgaggtgctgaagggcatcagcctcgatatttatgctggtgagatggtggcgattgtcggcgcttcgggttccggtaaatcgaccctgatgaatattctcggctgcctggataaggccaccagcggcacctatcgcgtagccggtcaggatgttgccacgctggacgccgatgcgctggcgcaactgcgccgcgagcatttcggctttattttccagcgttaccatttgctttcgcatttaaccgccgagcagaacgttgaagtacccgccgtctatgccggtcttgagcggaaacagcggctgcttcgcgcccaggagttactgcaacgactggggctggaagaccgtacagagtattacccggcacagctttcgggtggccagcaacagcgcgtcagcatcgcgcgggcattgatgaacggcggtcaggtaattcttgccgatgaaccgaccggcgcactggacagccattctggcgaagaggtgatggcgatcctgcatcagctgcgcgatcgcgggcatacggtgattatcgtcacccacgatccgcaggttgctgctcaggccgagcgggtgatcgaaattcgcgacggcgaaattgtgcgcaatcctcccgccgttgaaaaagtgaatgctactggcggaacggaacctgttgtcaacacggcgtctggctggcggcagtttgtcagcggttttaacgaggcgctgacgatggcatggcgggcgctggcagcgaataaaatgcgtactttactgaccatgctggggattattatcggtattgcgtcggtggtttccattgtcgtggtgggcgacgccgctaaacaaatggtgctggcggatattcgttctattggtacgaatactattgatgtctatcccgggaaagattttggcgatgacgatccgcaatatcagcaggcgctgaagtacgacgacttaatcgccatccaaaaacaaccgtgggttgcctctgccacgcccgccgtctcgcaaaacctgcgcctgcgttataacaatgttgatgtggctgccagtgccaatggcgtgagcggcgattattttaatgtctatggcatgaccttcagtgaagggaacacctttaatcaggagcagctgaacggtcgtgcgcaggtcgtggttctcgacagtaatactcgccgccagcttttcccccataaagcagatgtggttggcgaggtgattctggtcggcaatatgcccgccagagtcattggtgtggcggaagaaaaacagtcgatgtttggtagcagtaaagtgctgcgtgtctggctgccatacagcacgatgtccgggcgagttatggggcagtcgtggctgaactccattactgtcagggtgaaagaaggctttgacagcgctgaggcggaacagcaactcacgcgtttactttcactgcgccacggtaagaaggatttctttacctggaacatggatggcgtcttgaaaaccgttgaaaagaccacacgtactttacaactgtttctgacgctggtggcggtgatttcgctggtggtgggcggtattggtgtaatgaatattatgctggtgtcagtgaccgagcggacgcgggaaattggcattcgcatggctgtaggtgcgcgagcaagcgatgttttgcaacagtttttgatcgaagccgtactggtttgcctggttggtggcgcgttgggaataacactgtcactgttaattgctttcaccttgcagcttttcttacccggctgggagattggtttttcaccgttagcgctgctgctggcgtttctctgctcgacggtcaccgggattttatttggctggttacccgcacgaaatgcggcacgactggatccagtagatgctctggcacgagagtaa

SEQ ID NO: 2058 - protein, 648 aa, Escherichia coli
MTPLLELKDIRRSYPAGDEQVEVLKGISLDIYAGEMVAIVGASGSGKSTLMNILGCLDKATSGTYRVAGQDVATLDADALAQLRREHFGFIFQRYHLLSHLTAEQNVEVPAVYAGLERKQRLLRAQELLQRLGLEDRTEYYPAQLSGGQQQRVSIARALMNGGQVILADEPTGALDSHSGEEVMAILHQLRDRGHTVIIVTHDPQVAAQAERVIEIRDGEIVRNPPAVEKVNATGGTEPVVNTASGWRQFVSGFNEALTMAWRALAANKMRTLLTMLGIIIGIASVVSIVVVGDAAKQMVLADIRSIGTNTIDVYPGKDFGDDDPQYQQALKYDDLIAIQKQPWVASATPAVSQNLRLRYNNVDVAASANGVSGDYFNVYGMTFSEGNTFNQEQLNGRAQVVVLDSNTRRQLFPHKADVVGEVILVGNMPARVIGVAEEKQSMFGSSKVLRVWLPYSTMSGRVMGQSWLNSITVRVKEGFDSAEAEQQLTRLLSLRHGKKDFFTWNMDGVLKTVEKTTRTLQLFLTLVAVISLVVGGIGVMNIMLVSVTERTREIGIRMAVGARASDVLQQFLIEAVLVCLVGGALGITLSLLIAFTLQLFLPGWEIGFSPLALLLAFLCSTVTGILFGWLPARNAARLDPVDALARE

SEQ ID NO: 2059 - DNA, 255 bp, Escherichia coli
ttgtataagatttgcgaaggatgtcgaagcatggaaaagggtactgttaagtggttcaacaatgccaaagggtttggtttcatctgccctgaaggcggcggcgaagatattttcgctcattattccaccattcagatggatggttacagaacgctaaaagctggacaatccgttcagtttgatgtccaccaggggccaaaaggcaatcacgccagtgttattgtgcccgtcgaagtagaagcggcagtcgcatag

SEQ ID NO: 2060 - protein, 84 aa, Escherichia coli
MYKICEGCRSMEKGTVKWFNNAKGFGFICPEGGGEDIFAHYSTIQMDGYRTLKAGQSVQFDVHQGPKGNHASVIVPVEVEAAVA

SEQ ID NO: 2061 - DNA, 1239 bp, Escherichia coli
atgagcagcgcaattcatagacttagcgacactcttttacgaaaattaagcggatcaccaaccacaaaaaacgccttttttaatgacggtggcaatcttagcgtaagacattccaccagcggcctgttaacctggtatttcacttacagggccggaactggtaggcaggtatcaccggaacgtctgagactgggcaattatcccgatctgagcctgaaagcagccagggaaaaagcagcacagtgtcgcgcctggctggctgaggggaaaaatccgcgctatgagcttaatcgtgctgtacaggatgcgttagcccccgtgacagttaaggaagcgctcacttactggcttgaatcgtatgcaaaggaaaagcgcactgactacgaatcactgaaaagccggatcaataaacacataatcagccagattggcgctttgccgttggaaaaatgcgagctacggcactggttggcatgttttgaccagatggcaaagcgaagcccagtatctgccggatttttgctacaggtatgcaaacaggcgcttaagtactgccgaaaacgacgatacgcaatcagcaacgttcttgatgatatggttgtcggtgatgtgggaaaaaaagcagaagtgagcgagcgcgtactaacaaataaggagcttggggaattactccgcgccctggatgacaaaatattcccgccatactacagcgccctaattcgcctcctgattgtttttggatgccgtaccactgagctaaggcgctctgaggtgcaggagtgggattttaaagaaatgctctggacagtaccgaaggagcacagcaaaacgaaggtcgccatattcaggccaataccggaaagcattttgccgttcgtcacgcaactggtggagcagaacagacacacaggcttattgcttggtgaactgaaaggacaatcttcggtagcagagtacggaagaacagcgcacagacgaattaatcaagccccctggacgttacacgatatccggcacacatttacaaccatactgaacgatttaggcgtggatccgcatattgtcgagcagcttacagcccaccagatgccagggatgcaacgagtctataaccactcccgctaccttgatgcaaaacgtgatgctcttaatctatgggtagaccgtctcgagcttctccagaacaatgatgaaaaaatcgttgttatgaccccgcgaatttacccccaaaattcttga

SEQ ID NO: 2062 - protein, 412 aa, Escherichia coli
MSSAIHRLSDTLLRKLSGSPTTKNAFFNDGGNLSVRHSTSGLLTWYFTYRAGTGRQVSPERLRLGNYPDLSLKAAREKAAQCRAWLAEGKNPRYELNRAVQDALAPVTVKEALTYWLESYAKEKRTDYESLKSRINKHIISQIGALPLEKCELRHWLACFDQMAKRSPVSAGFLLQVCKQALKYCRKRRYAISNVLDDMVVGDVGKKAEVSERVLTNKELGELLRALDDKIFPPYYSALIRLLIVFGCRTTELRRSEVQEWDFKEMLWTVPKEHSKTKVAIFRPIPESILPFVTQLVEQNRHTGLLLGELKGQSSVAEYGRTAHRRINQAPWTLHDIRHTFTTILNDLGVDPHIVEQLTAHQMPGMQRVYNHSRYLDAKRDALNLWVDRLELLQNNDEKIVVMTPRIYPQNS

SEQ ID NO: 2063 - DNA, 192 bp, Escherichia coli
gatcgcgtaatccgtgaggatgaatgtcgtaagttaactggagtgtgtcgcactacacgctacgaactggagaaaaaagggagctttccgtctcgccgtaatcttggtgggcgttctgtaggttggctgctgtccgaggttatggaatgggttaaaagccgggatcgcattaattcaggtaaggcagcgtaa

SEQ ID NO: 2064 - protein, 63 aa, Escherichia coli
DRVIREDECRKLTGVCRTTRYELEKKGSFPSRRNLGGRSVGWLLSEVMEWVKSRDRINSGKAA

SEQ ID NO: 2065 - DNA, 180 bp, Escherichia coli
atggcgacaaaagcagtaaacgcaaaatcacaaaccgttgcggcaagggttccgcatgaagttatgaacaatgttgaggcggtaaaaatgcctggcgaaagtacggggcaatttgttactgcggcattaaaacgagaagttgaatatcgccagcggcgcaaggccaaagaaccagagtaa

SEQ ID NO: 2066 - protein, 59 aa, Escherichia coli
MATKAVNAKSQTVAARVPHEVMNNVEAVKMPGESTGQFVTAALKREVEYRQRRKAKEPE

SEQ ID NO: 2067 - DNA, 918 bp, Escherichia coli
atgacatataaaacaaaggcgaccgggggcggtcgccaatggatacacactaaacttgaacgcatcaccaacaatgccacatttgcggctggtgggcaatgcaatcagtctggttcagttcgttgccatacctgcaatgagcgcttttccctgtactctttaaggaattgctcaagggcaaaagcacatggcgcgaatctttctgattcatgctctatctttctgcgccgtcttttccgtgccggtgataatgttttggtcaattctttatcggtcattgtgttgtcctgcatagcaatgcgccgtaataccttacaccacggcgctgatggtgattactctggttctttggccttgcgccgctggcgatattcaacttctcgttttaatgccgcagtaacaaattgccccgtactttcgccaggcatttttaccgcctcaacattgttcataacttcatgcggaacccttgccgcaacggtttgtgattttgcgtttactgcttttgtcgccatgtggtgtacccctcataaaaaacaaatgcagtatgcaggaaaaaaaataagtgttcaacacttgacgtgtttaacacctgggtttaaattggtgttcaacaccttgttggcgcaaggtgcagaaacgacgaaacccggcagtgcgctaacactaaccgggcttctaaccaccaacgatagcgaaagtatcgaggtagctatgagaaatcataccacacacccgcaagggcgggactcgcacaacctgaataaatacatctggcgttttatcaccctgagcactgcacaaccgcgcgtgattaccattgaggccaccagcgaacaggaagcgcgtcagcaatctcctgatggctgcgtgatggtattcgctgcccgtattcgccagggggtgagtcatgcataa

SEQ ID NO: 2068 - protein, 305 aa, Escherichia coli
MTYKTKATGGGRQWIHTKLERITNNATFAAGGQCNQSGSVRCHTCNERFSLYSLRNCSRAKAHGANLSDSCSIFLRRLFRAGDNVLVNSLSVIVLSCIAMRRNTLHHGADGDYSGSLALRRWRYSTSRFNAAVTNCPVLSPGIFTASTLFITSCGTLAATVCDFAFTAFVAMWCTPHKKQMQYAGKKISVQHLTCLTPGFKLVFNTLLAQGAETTKPGSALTLTGLLTTNDSESIEVAMRNHTTHPQGRDSHNLNKYIWRFITLSTAQPRVITIEATSEQEARQQSPDGCVMVFAARIRQGVSHA

SEQ ID NO: 2069 - DNA, 228 bp, Escherichia coli
atgcataaaataccctttgatgttcttgttcattctgaaaacgcattaatccgcgcaaaggaaatggacgcattactacttaagttaattgatgtgccggaaagtggcgatgaatctgattcaatgatgttttctgccgtgcgtacgctattaacgcctgttattaatgaattaaatacagtgatggcaattcacgagaataataaagcgcagcacaccggagaataa

SEQ ID NO: 2070 - protein, 75 aa, Escherichia coli
MHKIPFDVLVHSENALIRAKEMDALLLKLIDVPESGDESDSMMFSAVRTLLTPVINELNTVMAIHENNKAQHTGE

SEQ ID NO: 2071 - DNA, 300 bp, Escherichia coli
atgaaaaataaaaattctggcgttactgccagcggccccgctcgtcctgaatttatgaacggcgatatttaccgcgataaatatggcggcatggtaacgattaaaggcgtggcagaacggcgcatcacctaccgtcgtgaaggctacgaatatgattgcgtgatgcctgtttatcagtttcggcgtgatttttctctggtacaggcagcgccccgcagtaaaccaaccagcagggagaaagcacgcgccaatattcaggaaataaaaaagatgcttaacgtattcaggggtaaaaaatga

SEQ ID NO: 2072 - protein, 99 aa, Escherichia coli
MKNKNSGVTASGPARPEFMNGDIYRDKYGGMVTIKGVAERRITYRREGYEYDCVMPVYQFRRDFSLVQAAPRSKPTSREKARANIQEIKKMLNVFRGKK

SEQ ID NO: 2073 - DNA, 1749 bp, Escherichia coli
atgaaactggcaccgaacgtaaaaaaacagccacgcggaataaaacacaaagacacagaggtaattattttcgcgggtagtgatgcctggtcgcacgcgaaacaatggcaggagcaggatggccccgcatccggcgataatgtgccgcctgtgtggcttgggccaaatcagcttgccgaacttgatgcactgaaaattgttccggatgggaaaaagcgcgtaaggctgtaccaggccggagaactggatttggtggagaccaaaaagattggtcagaagctggcggcggcagatattcaggacgcaaatttttaccccgaaggaatgcacgtccagaagtgtgaaaactggcggcgctatctgaatgctgagcgtgaaaatattgccgcagggcttaccatgccggagcagaaaaatacgcaactggcacaaatggcagacagtgagcgtgcgcagctgcttgccgagcgctttgatggcgtttgtgtgcatcctgaaagtgaaatcgttcacgtatggcgcggcggggtatggtgtccggtcagcacaatggagctgagccgcgaaatggtggcgatctattcagagcacagggccactttcagcaagcgcgtaatcaataacgccgtggaagcgttaaaagttattgccgaaccaatgggcgagccgtccggcgatttgctgccgttcgccaatggtgcgcttgacctgaaaacgggggaattttccccgcacacgccggagaactggatcaccacgcacaacggcattgagtacacgccaccagcacccggggagaacatccgcgataacgcgccaaactttcataaatggcttgagcacgcagccggaaaagacccgcgcaagatgatgcgtatatgtgccgcgctgtacatgattatggcgaaccggtacgactggcagatgtttattgaggccaccggagacggcgggagcggtaaaagtacattcacacacatagccagccttctggcagggaaacaaaacacggtaagcgctgaaatgacatcgcttgatgatgctggtgggcgtgcgcaggttgtcgggagtcgtcttatcgtcctggcagaccagccgaaatatacaggcgaaggaacgggcatcaagaaaatcacgggcggcgaccccgtggaaattaacccgaaatatgaaaagcgttttacggcggtaatcagggcggtggtgctggcaaccaataacaatccgatgatattcaccgaacgggccggaggtgtggcacgtcgtcgggtgatattccggttcgataacatcgtaagcgaggcagaaaaagacagggagctaccggaaaagatcgcggctgaaatccctgtcattatccgccgcttgctggcgaactttgccgaccctgaaaaggcacgggctttactcattgaacagcgtgacggtgatgaagcactggcaataaagcaacagacggatccggttattgagttttgccagttcctgaattttctggaggaagcacgcggcctgatgatgggcggcggtggcgattcagtgaagtacacgaccagaaacagcctttaccgcgtctatctggcgtttatggcgtacgcaggcaggagcaaaccgctaaacgtaaatgactttggcaaggctatgaagccagccgcgaaagtttacggacatgaatatattacgcggaaagttaaaggagtaacgcagactaacgcaataacaacagacgattgcgacgcgtttttataa

SEQ ID NO: 2074 - protein, 582 aa, Escherichia coli
MKLAPNVKKQPRGIKHKDTEVIIFAGSDAWSHAKQWQEQDGPASGDNVPPVWLGPNQLAELDALKIVPDGKKRVRLYQAGELDLVETKKIGQKLAAADIQDANFYPEGMHVQKCENWRRYLNAERENIAAGLTMPEQKNTQLAQMADSERAQLLAERFDGVCVHPESEIVHVWRGGVWCPVSTMELSREMVAIYSEHRATFSKRVINNAVEALKVIAEPMGEPSGDLLPFANGALDLKTGEFSPHTPENWITTHNGIEYTPPAPGENIRDNAPNFHKWLEHAAGKDPRKMMRICAALYMIMANRYDWQMFIEATGDGGSGKSTFTHIASLLAGKQNTVSAEMTSLDDAGGRAQVVGSRLIVLADQPKYTGEGTGIKKITGGDPVEINPKYEKRFTAVIRAVVLATNNNPMIFTERAGGVARRRVIFRFDNIVSEAEKDRELPEKIAAEIPVIIRRLLANFADPEKARALLIEQRDGDEALAIKQQTDPVIEFCQFLNFLEEARGLMMGGGGDSVKYTTRNSLYRVYLAFMAYAGRSKPLNVNDFGKAMKPAAKVYGHEYITRKVKGVTQTNAITTDDCDAFL

SEQ ID NO: 2075 - DNA, 258 bp, Escherichia coli
atgcgcacatcaggaaaacttaataatcagaagaagcagcataaccgcgccattgaccttacagagcactggctgagagtggcgataaaaatcatcgaccgcaacacgggggaaggatacgcgaaagcacatcccgacctgataagcgcattcatgaccacagcggcggcaaactttgccacgctgacagaatgggagattgccgaagcggaacaggtaacaaccatcaacgttaaaaccggagaggtggaatcatga

SEQ ID NO: 2076 - protein, 85 aa, Escherichia coli
MRTSGKLNNQKKQHNRAIDLTEHWLRVAIKIIDRNTGEGYAKAHPDLISAFMTTAAANFATLTEWEIAEAEQVTTINVKTGEVES

SEQ ID NO: 2077 - DNA, 423 bp, Escherichia coli
atgacagcacagatagccgcttacgggcggctggtggacgacccgcaggtaaaacagaccagcaagggcacaccgatgacgctggcgcgtatggcggtcccccttccgtgcagccaggcagatgacggaacggcgacgatgtggttatccgtcctggcatttggcagacaggccgaagcactggaaaggcaccgcaagggtgaactcctgagcgtggcgggtaacatgcagatcagccagtggactgggcagaacggagaaacgcggcagggctggcaggttatcgcagacagtgtaatcagtgcgcgaacggcgcgactgggcggcaaaaaaggtcaacagggccaggctactgacgcgctgaacagggcaaaacaacaggcggggaatgatgatccgtacggggataacataccgttttaa

SEQ ID NO: 2078 - protein, 140 aa, Escherichia coli
MTAQIAAYGRLVDDPQVKQTSKGTPMTLARMAVPLPCSQADDGTATMWLSVLAFGRQAEALERHRKGELLSVAGNMQISQWTGQNGETRQGWQVIADSVISARTARLGGKKGQQGQATDALNRAKQQAGNDDPYGDNIPF

SEQ ID NO: 2079 - DNA, 93 bp, Escherichia coli
gtgggcctgaacacggggcgggaggcgcggaaaaaagcgcatttttgtgattttatcgtcatcatcatcatgagcgtaatttattgtttttaa

SEQ ID NO: 2080 - protein, 30 aa, Escherichia coli
MGLNTGREARKKAHFCDFIVIIIMSVIYCF

SEQ ID NO: 2081 - DNA, 207 bp, Escherichia coli
atggctgaagagaaaaaaggtggtgtttcggtgtacataagccccgaaatcgtggaggtgctcaagcagcgccacaaaaaaaactatgaggctggcgtagcggctggactggatccgctgatgacgccggagccgtcgataggttcacttgtacgctcttatttacttgcggcgcttgggatgcataaaaattatgggggtgaataa

SEQ ID NO: 2082 - protein, 68 aa, Escherichia coli
MAEEKKGGVSVYISPEIVEVLKQRHKKNYEAGVAAGLDPLMTPEPSIGSLVRSYLLAALGMHKNYGGE

SEQ ID NO: 2083 - DNA, 1056 bp, Escherichia coli
atggcaggcaaagcaacggcacttaacactaaccagcttttcatgtacctgaatcgcggggatattgcggattttaaattcagccctctgtttactacgctgtttttcccgaacgtggcgacattcaacacgcaaaacatcatgctggataccctggacattgaagaagtcaccatgtcggcgttttgttcgcctatggtgggtagccaggttcagcgcgataaagggtacgaaaccagcacaatcaaacctggctacatgaagccaaagcacgaaatcgatccaacaaaaaccatcatgcgcatggctggagaagatccagcacagcttaacgaccctacctaccgccgtatgcgcctgattactggcaacatgcgccgccagataaacgccattaaagcgcgcgtggaatggctggcggtgaatgcgataacgaccggaaaaaacatcattgagggcgaaggcatagaacgctatgaaatagactggaagatcccaagtaaaaacatcgccagacagggaccgggtaaaaagtggtcagaggcagataaggaaacacacgatccaatctatgacatcgagctttatgctgatcaggctggttgccccgcaaacgtcatgattatgggcgctgaggtatggcgcacgttacgcagctttaaaaaattccgtgagctgtacgatctttcccgtggttcagagtccgccgtagagctggcctgtaaaaacctgggcgaagtggtgagctttaaaggctatctgggcgatattgcccttatcgtctattccggcaaatacgccgacagcgacggcacagaaaaatatttccttgagcctgatttgcttgtcctgggcaacaccaacaataaagggctggtggcctatggtgcgattatggatcaggacgcagtaagaacgggcgcaacgcaaaacatgttttacccgaaaaactggattgaggacggcgatccggcgattgagtacgtgcagacgcacagcgcaccgcagccggttccggcagatattcgcaaatttgttaccgtcaaaattgcttaa

SEQ ID NO: 2084 - protein, 351 aa, Escherichia coli
MAGKATALNTNQLFMYLNRGDIADFKFSPLFTTLFFPNVATFNTQNIMLDTLDIEEVTMSAFCSPMVGSQVQRDKGYETSTIKPGYMKPKHEIDPTKTIMRMAGEDPAQLNDPTYRRMRLITGNMRRQINAIKARVEWLAVNAITTGKNIIEGEGIERYEIDWKIPSKNIARQGPGKKWSEADKETHDPIYDIELYADQAGCPANVMIMGAEVWRTLRSFKKFRELYDLSRGSESAVELACKNLGEVVSFKGYLGDIALIVYSGKYADSDGTEKYFLEPDLLVLGNTNNKGLVAYGAIMDQDAVRTGATQNMFYPKNWIEDGDPAIEYVQTHSAPQPVPADIRKFVTVKIA

SEQ ID NO: 2085 - DNA, 336 bp, Escherichia coli
atggacactccatacattgagttatttgcaggcagtcagcaggtcgccacgacgctggtacattttgccgctgatgctggcgttattcaggaatttaccccgctgatgctggcggacaatggcgagtttaagccgtgggatggtcaggaatctggcaaggctgtttatctgacttcgtatcctgtggacacgtcaaagcagaaatcagcacagtgttacaagacggggatattcaatattgccgccgttaactggcctgagagcgtcgacaccgatgcgaaaaaatgcgccgcctttgcgggttctggcgtatccgttcagccgctggcccgataa

SEQ ID NO: 2086 - protein, 111 aa, Escherichia coli
MDTPYIELFAGSQQVATTLVHFAADAGVIQEFTPLMLADNGEFKPWDGQESGKAVYLTSYPVDTSKQKSAQCYKTGIFNIAAVNWPESVDTDAKKCAAFAGSGVSVQPLAR

SEQ ID NO: 2087 - DNA, 123 bp, Escherichia coli
atgccggaaaggacccataaaaaaaagccggatttctccggccttgtctcagatggttttcagtatgcgatcgatgtcgccgtcatcgccctggtttctgccatcgtatgccatgccagctga

SEQ ID NO: 2088 - protein, 40 aa, Escherichia coli
MPERTHKKKPDFSGLVSDGFQYAIDVAVIALVSAIVCHAS

SEQ ID NO: 2089 - DNA, 414 bp, Escherichia coli
atggcaacgaatgaaagcatcatgacgctaccgctggcgagtaaatttaaagccgaagcgcgggcaatggctgacagagggttatcaacctacgaggccatatatcaacttaacaaactggaagagcaggacaagccgcgcgctgatgcgattatggcgcttgatgaatctggcgactatcagccgctgttacgtgcaatggcaaacgtgccttgtatcgatgttggtacggctaaaagcatccttagcatgaccatagagcaggaacgtccgaaggttgcgccggaacttaccgcagcctttgaaaactttatggacatgcacagcccgcaagccgtatcagctggcatggcatacgatggcagaaaccagggcgatgacggcgacatcgatcgcatactgaaaaccatctga

SEQ ID NO: 2090 - protein, 137 aa, Escherichia coli
MATNESIMTLPLASKFKAEARAMADRGLSTYEAIYQLNKLEEQDKPRADAIMALDESGDYQPLLRAMANVPCIDVGTAKSILSMTIEQERPKVAPELTAAFENFMDMHSPQAVSAGMAYDGRNQGDDGDIDRILKTI

SEQ ID NO: 2091 - DNA, 543 bp, Escherichia coli
atgaaatcgcacctgatgaacaaaaaaaacatggcgaaaagctgccgtgtaagtgcgacagcgttcgacaagtggggagtgactcccgttgaacgtaaaggccgtgaggcgttttacgatgttgccagcgtgatagacaatagggttaacaatgcaattagccagcttacaaacgacaaaggcgatattgatgatgatgaactcttacgagtcaggatcagattactgacagcacaggcggaggcgcaggaacttaaaaacgagcgcgatcgcggtgacgtgattgatactgagttttgcctgtacgcgctttcaaagctggcgagtcagatttcatcaatcatggacagcctcccgcttactatgcaaaggagcttcccacagattacccccgccatgctggataggcttaaaagggaagtggttaaagcctgtaatgccagtgccagagttgccgacaacctcccacagatactggctgattacttgaaagaaacaaccggaaacgtaccggaaaagttgctacagaagaaaggcgagtaa

SEQ ID NO: 2092 - protein, 180 aa, Escherichia coli
MKSHLMNKKNMAKSCRVSATAFDKWGVTPVERKGREAFYDVASVIDNRVNNAISQLTNDKGDIDDDELLRVRIRLLTAQAEAQELKNERDRGDVIDTEFCLYALSKLASQISSIMDSLPLTMQRSFPQITPAMLDRLKREVVKACNASARVADNLPQILADYLKETTGNVPEKLLQKKGE

SEQ ID NO: 2093 - DNA, 576 bp, Escherichia coli
gtgttgtggctattctgccgttgccgtgctggtggatatttccgttatggggatcaccatatcggcatcatgcccaccagccagcgcaattttgcgcttttctttaagttcagcaagttaccgcgccggattacgccaatggctgtttccgaaagaatcaacgggttaggccttaatgggctgcgtggtaattatcagcatccagaatatgacgggttatgtttccgacctcctcaatttgaggttcccgaaaatatcaacgggttaggctggtttccccgatgttcgccgctggcgaatttcgaaaatatcaaccagttaccgccgcaaccgctccggcttcttccagtggtacgtaattttctccgtttcccgatacagtgccacgcggcgattgtaggccagcatttcaagaacgcggatccgtatgttgcgcatatccacatcattaagctggataccatcacggcgcatcacctcagcaacaacacgcgcataattttcggctgtcacgctgtccggctgcgtggcctgttcgtcagtctgctggctgattccaccagcacggcggattaa

SEQ ID NO: 2094 - protein, 191 aa, Escherichia coli
MLWLFCRCRAGGYFRYGDHHIGIMPTSQRNFALFFKFSKLPRRITPMAVSERINGLGLNGLRGNYQHPEYDGLCFRPPQFEVPENINGLGWFPRCSPLANFENINQLPPQPLRLLPVVRNFLRFPIQCHAAIVGQHFKNADPYVAHIHIIKLDTITAHHLSNNTRIIFGCHAVRLRGLFVSLLADSTSTAD

SEQ ID NO: 2095 - DNA, 282 bp, Escherichia coli
atgacagaagccgaaatactgggattaatccgccgtgctggtggaatcagccagcagactgacgaacaggccacgcagccggacagcgtgacagccgaaaattatgcgcgtgttgttgctgaggtgatgcgccgtgatggtatccagcttaatgatgtggatatgcgcaacatacggatccgcgttcttgaaatgctggcctacaatcgccgcgtggcactgtatcgggaaacggagaaaattacgtaccactggaagaagccggagcggttgcggcggtaa

SEQ ID NO: 2096 - protein, 93 aa, Escherichia coli
MTEAEILGLIRRAGGISQQTDEQATQPDSVTAENYARVVAEVMRRDGIQLNDVDMRNIRIRVLEMLAYNRRVALYRETEKITYHWKKPERLRR

SEQ ID NO: 2097 - DNA, 321 bp, Escherichia coli
atgggtaaaacgaacgactggctggactttgatcaactggcggaagaaaaagttcgcgacgcgctaaaaccgccatctatgtataaagtgatattagtcaatgatgattatactccgatggagtttgttattgacgtgttacaaaaattcttttcttatgatgtagaacgtgcaacgcaattgatgctcgctgttcactaccaggggaaggccatttgcggagtctttaccgctgaggttgcagaaaccaaagtggcgatggtgaacaagtacgcgagggagaatgagcatccattgctgtgtacgctagaaaaagcctga

SEQ ID NO: 2098 - protein, 106 aa, Escherichia coli
MGKTNDWLDFDQLAEEKVRDALKPPSMYKVILVNDDYTPMEFVIDVLQKFFSYDVERATQLMLAVHYQGKAICGVFTAEVAETKVAMVNKYARENEHPLLCTLEKA

SEQ ID NO: 2099 - DNA, 438 bp, Escherichia coli
atgctcaatcaagaactggaactcagtttaaatatggctttcgccagagcgcgcgagcaccgtcatgagtttatgaccgtcgagcacttgttactggcgctgctcagtaacccatctgcccgggaggcgctggaagcgtgttctgtggatttggttgcgctccgtcaggaactggaagcctttattgaacaaaccacacccgttctgcctgccagtgaagaggagcgcgacacacagccgacgctgagttttcagcgtgtactgcaacgtgcggtcttccatgtccagtcctccggtcgcaatgaggttaccggtgcaaacgttctggtcgctatctttagcgaacaggagtcgcaggcggcatatctgttgcgcaaacatgaagtcagccgtcttgatgtggtgaactttatctctcatggcacgcgtaaagagtaa

SEQ ID NO: 2100 - protein, 145 aa, Escherichia coli
MLNQELELSLNMAFARAREHRHEFMTVEHLLLALLSNPSAREALEACSVDLVALRQELEAFIEQTTPVLPASEEERDTQPTLSFQRVLQRAVFHVQSSGRNEVTGANVLVAIFSEQESQAAYLLRKHEVSRLDVVNFISHGTRKE

SEQ ID NO: 2101 - DNA, 1773 bp, Escherichia coli
atggagaatttcacgacgaacctgaatcagcttgcgcgagtgggcggaatcgacccactgattggtcgtgagaaggagctggagcgtgctattcaggttctctgccgtcgccgtaaaaacaacccgctgctggtgggggagtctggtgtcggtaaaaccgcgattgcggaggggcttgcatggcgaattgttcagggcgatgtgccggaagtgatggctgactgtacgatttactctctcgatatcggttctctgttagcgggcacaaaatatcgcggcgactttgaaaaacgttttaaagcgttgctcaagcagctggagcaagacactaatagcatcctgtttattgatgagatccacaccattatcggtgcgggtgcagcgtctggtggccaggtcgatgcggctaacctgatcaaaccgttgctctccagcggtaaaatccgcgtaattggttcgacaacctatcaggagttcagcaacatttttgagaaagaccgtgctctggcgcgtcgcttccagaaaattgatattactgaaccgtcaatcgaagaaactgttcaaatcatcaatggcctgaaaccgaagtatgaagcgcaccacgacgtgcgttataccgcaaaagcggtgcgtgcggcggtagagctggcggtgaaatacattaacgatcgtcatctgccggataaagcgattgatgttatcgacgaagcgggcgctcgcgcacgtctgatgccggtaagcaaacgcaagaaaaccgttaatgtggcggatattgaatccgtggtggcccgtattgcacgcattccagagaagagtgtttctcagagtgaccgcgataccctgaaaaacctcggcgatcgcctgaaaatgctggtcttcggtcaggataaagccattgaggcgctgactgaagccattaagatggcgcgtgcaggtttaggtcacgaacataaaccggtcggttcgttcctgtttgccggccctactggggtcgggaaaacagaggtgacggtacagctttcgaaagcgttgggcattgagcttctgcgctttgatatgtccgagtatatggaacgccataccgtcagccgtctgattggtgcgcctccgggatacgttggttttgatcagggcggtttgctgactgatgcggtcatcaagcatccacatgcggtgctgctgctggacgaaatcgagaaagcgcacccggacgtgttcaacatcctcttgcaggtgatggacaacggtacactgaccgataacaacggacgcaaagcggacttccgtaacgtggtgctggtgatgaccactaacgcgggggtacgtgaaaccgagcgcaaatccattggtcttatccaccaggataacagcaccgatgcgatggaagagatcaagaagatctttacaccggaattccgtaaccgtctcgacaacattatctggttcgatcatctgtcaaccgacgtgatccatcaggtggtggataaattcatcgtcgagttgcaggttcagttggatcagaaaggtgtttctctggaagtgagccaggaagcgcgtaactggctggccgagaaaggttacgaccgggcaatgggcgcacgtccgatggcgcgtgtcatccaggacaacctgaaaaaaccgctcgccaacgaactgctgtttggttcgctggtggacggcggtcaggtcaccgtcgcgctggataaagagaaaaatgagctgacttacggattccagagtgcacaaaagcacaaggcggaagcagcgcattaa

SEQ ID NO: 2102 - protein, 590 aa, Escherichia coli
MENFTTNLNQLARVGGIDPLIGREKELERAIQVLCRRRKNNPLLVGESGVGKTAIAEGLAWRIVQGDVPEVMADCTIYSLDIGSLLAGTKYRGDFEKRFKALLKQLEQDTNSILFIDEIHTIIGAGAASGGQVDAANLIKPLLSSGKIRVIGSTTYQEFSNIFEKDRALARRFQKIDITEPSIEETVQIINGLKPKYEAHHDVRYTAKAVRAAVELAVKYINDRHLPDKAIDVIDEAGARARLMPVSKRKKTVNVADIESVVARIARIPEKSVSQSDRDTLKNLGDRLKMLVFGQDKAIEALTEAIKMARAGLGHEHKPVGSFLFAGPTGVGKTEVTVQLSKALGIELLRFDMSEYMERHTVSRLIGAPPGYVGFDQGGLLTDAVIKHPHAVLLLDEIEKAHPDVFNILLQVMDNGTLTDNNGRKADFRNVVLVMTTNAGVRETERKSIGLIHQDNSTDAMEEIKKIFTPEFRNRLDNIIWFDHLSTDVIHQVVDKFIVELQVQLDQKGVSLEVSQEARNWLAEKGYDRAMGARPMARVIQDNLKKPLANELLFGSLVDGGQVTVALDKEKNELTYGFQSAQKHKAEAAH

SEQ ID NO: 2103 - DNA, 984 bp, Escherichia coli
atgtcttcgaattaccttacgccttccgatctcaaaaccattctccactccaaacgcgccaatatttattatctggaaaaatgccgggtacaggtgaatggtgggcgggtggagtatgttaccagcgaaggtaaagagtcgtactactggaatatccccattgcgaataccacggcgttgatgctgggaatgggaacttccgttacccaggcggcgatgcgtgaatttgctcatgccggggtgatggtaggcttttgtggtacggatggcacgccgctgtattcagcaaatgaagtggatgttgatgtctcctggctcagcccacaaagtgaatatcgccctacagagtatctccagcagtgggtttctttctggtttgttgaagacaaacgacttgctgccgcgaaacgttttcagttaatccgcctgacacatatcgataagcactggtccagctcgaaaatgctgcgtgaacacgcatttcaacctgatgttaatgcgctgcataccctcctgaatcgtacttgtgaagaaatagacgcggcagaaaaccatacgcagcttatgctcgttgaggccaaattgactaaagcgttatacaaaatggtcagtcaaaccgtggggtatggcgatttcactcgcgcaaaacggggcggtggtatcgatatggccaaccgcttcctcgatcaagggaattatctggcttatggactggcagcagtggcggcgtgggtaacaggtatcccgcacggtttagctgtaatgcatggtaagacacgtcgcggcgggcttgtttttgaccttgccgatctgattaaagatgctcttgttatgccgcaagcatttattgccgcaatggcgggagaagatgctcaggagtttcgtcaacgctgtgttaatatctttcaacaagcggatgcgctggatgtcatgatcacctctctgcaggaaacggcccaggcactggctaaggctgaccaatga

SEQ ID NO: 2104 - protein, 327 aa, Escherichia coli
MSSNYLTPSDLKTILHSKRANIYYLEKCRVQVNGGRVEYVTSEGKESYYWNIPIANTTALMLGMGTSVTQAAMREFAHAGVMVGFCGTDGTPLYSANEVDVDVSWLSPQSEYRPTEYLQQWVSFWFVEDKRLAAAKRFQLIRLTHIDKHWSSSKMLREHAFQPDVNALHTLLNRTCEEIDAAENHTQLMLVEAKLTKALYKMVSQTVGYGDFTRAKRGGGIDMANRFLDQGNYLAYGLAAVAAWVTGIPHGLAVMHGKTRRGGLVFDLADLIKDALVMPQAFIAAMAGEDAQEFRQRCVNIFQQADALDVMITSLQETAQALAKADQ

SEQ ID NO: 2105 - DNA, 3234 bp, Escherichia coli
atgaatgtcctaattatctcacgctgtacgaaaaatgctcgcgtggaaagctgccgtattattgatcagtttgccgaacgcactggtgacgcagcatggcaaacggtgattactctggaaggcgttaatacactccgccgtttactgcgcaaaaccgccaggcgaaataccgcagtggcttgtcactggctgaagaagaatgggcaaacggagctgatgtggattgtcggcaatattcgtcgctttaatgctcaaggccgcgttcccacaaatcgaacaacgcaaatcagcctggtgaacaaagaagaaaatcgctggcagtgcgcggaaagtattgcactgctggcggctatcgctgggctatttcatgattttggtaaatcaggacgcagctttcagcaaagcctgactcaaaagaatacccgcagttatcaaccttaccgacatgaatggatttcactgcggctctttcagacgtttgtcggtgagcggcccgacgatgtgtggctggcgaagcttggcgaactcacggcagatgatgaatctgcgattcttgagcgcctgcaaaaagacactcctcaattttcaaatagcccgttcagttcgctgcaaccattagccaaaacggtaggctggctgatcctttcccatcatcgaatgccggagaatctttctccacagtcggaacaatcatgtaaagggtgtgaaagttggctggagaagcaacttaatgctgactggaatgccgttaaccaccgcagagatgactggtcacaacaggattttgcgcacgtctggcagtttccatcaggaacgccgcttcaaagcgcgagctggcgggaaaaagcgcgtcagatagcccgccgggcaagcaacgcgctcggtttaaagacatatgggcagatggaacagttgttccccttacatatggcgcgtttttgtctgatgcttgccgatcattactattcctcaagcgatgcgcagcaaaaatggcaggacccggattatatcgtctgggcaaatagcgatcgccaaagcggcacgctcaaacaacgggtagacgaacaccttgtgggcgtcgcgcatcatgcgtatctgcttgggcggcaactgatgcacacacgggcatcgcttccggcaattgcccgacataaaggttttagccagcgggctacagatgtgaattatcgctggcaagataaagcctgggatgtggcgcgagcgttacgtgaacgaagtcgtgaagagggatttttcggcgtcaatatggcctcgacggggtgtggtaaaacctttgcgaacgcccgcattatgtatgcacttgccgacgagcgagaagggtgccgctttaccgttgcgctgggattgcgcacgctgactttacaaaccggcgatgctctgcgcagtcggcttgggctgggtgaggatgagctggcggtactgattggttcggcggcagttaatcaactgtggcaacaggaaaaaatagacaatgattgcggaagtgcttcgcaagagtcgccggcagaggagcaacagttcgttaagtacgaaggcagcctgcataccggggcgctggaaaaatggttgaaggatgacagcaaacttaaggagttagtaagcgcgccgattctggtctcgacgattgatcatcttatttccgcgaccgagggcgtgcgaggcgggaaacagcttccggcgatgttgcgcctgttaaccagcgatttagtgctcgacgaacctgatgactttgatattgctgatcttcatgcggtatgtcgattgatgaactgggccgggatgctgggaacgcgggtattactttcttccgcgacgttaccgccaggtttgattcaggcgctgttcgcggcttatcttgctgggcgaaaaatgtggcaggcgtcttgtggtatcaacggcaggcctgtcaatatatgctgcgcctggtttgatgaaaaagatgctgatgccacgcaaatttacgacggacctgggtttcgtgatgctcatgccaaatttgttgcacgacgagcggtaatgctggctgaaaaagaacgactgcatttcgggcgtgtagcttcggtttcatcagcatcaggcgcgatacaagatgttaccgaaagtgtggcccagacggtgcatacgcaaatgctgaagttgcatcaggcgcatcgccagcgacacgaaagcggtaaaaccgtttcgctgggcctggtgcgcttcgcgaatatcaatccactggttgcggtgaccaaagccctgattgccattccttcaccagaagatgtctgcattcattactgtgtttaccactcccgacatccgctggcggtgcgttcagatattgagaagcgactggatcgcgcttttactcgtcataacgaactcgatttctggaacaacgaagatatcgcagatgccttacataaccgtccggaatcgcaccatctgtttgtggtgttggggacatcggttatagaagtggggcgtgactgggatgcggactggggaattatcgaaccaagctccatgcgttcgataattcaatttgccggacgtattcagcgccaccgtagaaatgtgccgaccagtgagaatctggttattttgcgtagcaatatcaaatcattgcagaaaaaagcccccgcattttgtaagcctggtttcgaaacaaaagaacacttgctgaatagccacgatatttgcgaactgattccgatcgcggactaccggacgattaacgccttgccgcggatcctgtctgccaataatgccaacaaactggcggagctagaacatagtcgtttatccgccgaattgatgagcagtaaaagcaaacatgtggtggcggcgcaatggtggcgtgcaccgctaagctggaacggctggatgcagcgccagacgccatttcgttattcccctttgccggaggcggtgttttttctgcatatggatgatgaagaaagcgaagcgcgtttctattcccgcacgggcgacaacgagcgtaaagcgcaagggaatttcaggcgagaagaggtgagatgcgccagcggcgtcgcttgctggggcgtgatggattaccaacacgttttgttgaatttagctgataagcaaagttgtgagatagcaaacgttggggaaaagtttgcggaggtgagagtacccgtcagtgaagaagatgcggtcgatgactggcgttatcacccctggttaggtgtgtttcgcaacatgtga

SEQ ID NO: 2106 - protein, 1077 aa, Escherichia coli
MNVLIISRCTKNARVESCRIIDQFAERTGDAAWQTVITLEGVNTLRRLLRKTARRNTAVACHWLKKNGQTELMWIVGNIRRFNAQGRVPTNRTTQISLVNKEENRWQCAESIALLAAIAGLFHDFGKSGRSFQQSLTQKNTRSYQPYRHEWISLRLFQTFVGERPDDVWLAKLGELTADDESAILERLQKDTPQFSNSPFSSLQPLAKTVGWLILSHHRMPENLSPQSEQSCKGCESWLEKQLNADWNAVNHRRDDWSQQDFAHVWQFPSGTPLQSASWREKARQIARRASNALGLKTYGQMEQLFPLHMARFCLMLADHYYSSSDAQQKWQDPDYIVWANSDRQSGTLKQRVDEHLVGVAHHAYLLGRQLMHTRASLPAIARHKGFSQRATDVNYRWQDKAWDVARALRERSREEGFFGVNMASTGCGKTFANARIMYALADEREGCRFTVALGLRTLTLQTGDALRSRLGLGEDELAVLIGSAAVNQLWQQEKIDNDCGSASQESPAEEQQFVKYEGSLHTGALEKWLKDDSKLKELVSAPILVSTIDHLISATEGVRGGKQLPAMLRLLTSDLVLDEPDDFDIADLHAVCRLMNWAGMLGTRVLLSSATLPPGLIQALFAAYLAGRKMWQASCGINGRPVNICCAWFDEKDADATQIYDGPGFRDAHAKFVARRAVMLAEKERLHFGRVASVSSASGAIQDVTESVAQTVHTQMLKLHQAHRQRHESGKTVSLGLVRFANINPLVAVTKALIAIPSPEDVCIHYCVYHSRHPLAVRSDIEKRLDRAFTRHNELDFWNNEDIADALHNRPESHHLFVVLGTSVIEVGRDWDADWGIIEPSSMRSIIQFAGRIQRHRRNVPTSENLVILRSNIKSLQKKAPAFCKPGFETKEHLLNSHDICELIPIADYRTINALPRILSANNANKLAELEHSRLSAELMSSKSKHVVAAQWWRAPLSWNGWMQRQTPFRYSPLPEAVFFLHMDDEESEARFYSRTGDNERKAQGNFRREEVRCASGVACWGVMDYQHVLLNLADKQSCEIANVGEKFAEVRVPVSEEDAVDDWRYHPWLGVFRNM

SEQ ID NO: 2107 - DNA, 1308 bp, Escherichia coli
atggaaaaaacggcgctaatacaatttattactgaatacatcgcttcgcgaaggcaacccaaaatcgatgcctttgaaaaagaagccgcaaagcgagtggaacagggcgaggacgccagcgttatcgctcaggagcggcaggaactcgaagcacgctacttgccacgtaactggttaacggatgcggcaaagcgtgccgggcaaatcaaattagtcactcatggcgctaaattcagtcatggtgattctaaagccagtagcttttatctggaaacctccgctaacgaaagctatttaaacacagcatcgttggcgaatgtcgctactgacgcgattggtaacgccgctgcacttgacgtagcaaagttgctacaaaccgatgtgaacggagattcactgcttgccagcctgaagcgtggtgattatcaggcattaagtacgtttgcagaggataaagtgcaactggagctgtgggtagctgggtttagccaggcatggactactggacggccttccagccataaactggcgaaacaaatctatttccctgttgcggatggttatcacctgttatgcccactgttttccagttcactggcgcaggcgatgtatgaaaagctaaccgccgtgcgctttagtgaggagtcgaaagccattcgcgatgcccgcaaagcaggaaaatggcactcccagccagatatctggtttcctaatcttgccgaaatgcattttggcggcacaaaaccgcagaatatttctttgctcaatagtgtgcggggtggccgtgtctggctgttgccgtcaatgccgcccacctgggcgacgctggatcgcgcgccacaaaacatgcgcagtattttttccctacgcggcgatttcaatcgggcggcttcaggcattgtcgcccagatgacctacttactgaaggttgacataaataatgtccatatccgaactgtgcgggcgaaatatattgatgagttgatcgatttgctgttcatgcaggcatccgcttttcagcaagaaaaatggcagggatggtccgcacaatcaccagacttacctcgccaccaacaactttggctggacccgtggcgaagcctctcagatgagactttcaaacaggagcgtgagaaaaacgactggcaagtaactgtcgccgatgatttcgcacgctggctgaactatcgcctgaaaaaatccagttttgacgtaggcgctgtcgaacaaaaagagtggcgcagccagtctctgttcgctcaacggatgcgtgaaatggaagctgttttgcaggaggcgctgaaatga

SEQ ID NO: 2108 - protein, 435 aa, Escherichia coli
MEKTALIQFITEYIASRRQPKIDAFEKEAAKRVEQGEDASVIAQERQELEARYLPRNWLTDAAKRAGQIKLVTHGAKFSHGDSKASSFYLETSANESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAVRFSEESKAIRDARKAGKWHSQPDIWFPNLAEMHFGGTKPQNISLLNSVRGGRVWLLPSMPPTWATLDRAPQNMRSIFSLRGDFNRAASGIVAQMTYLLKVDINNVHIRTVRAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 2109 - DNA, 216 bp, Escherichia coli
atgagttatctgctcttgttaccccatatacgcatcgaaaacgctaacgctgtctccgggttgacctggggattcccgtcgatgacccattttctcggttatgtccatgcgctttctcgcaaagtcgtggatgaatttggcgtaagttttgatggttgtgcggtagtaagccatgaacagcatattcaggcgtacagctctgggcgcgatttttag

SEQ ID NO: 2110 - protein, 71 aa, Escherichia coli
MSYLLLLPHIRIENANAVSGLTWGFPSMTHFLGYVHALSRKVVDEFGVSFDGCAVVSHEQHIQAYSSGRDF

SEQ ID NO: 2111 - DNA, 642 bp, Escherichia coli
atgcacttgacggtttctctactgattgaatgtaatggcgaaatcaccaatggtgaatatggcagaaaagttctttgtgactatctgaaaatgctttgccagagccacaaactggcgggcggcagcattgtcagtatgcgcgatccgcagctttttcatgcgcctgaagatgaaaagcaactgcgtaaaatcgtctggcggttaatgccgggttatgcgctttacgatcgcagtgaatggctggctgaacatcaccaacaacatcccgacatctcgttgctggatgcctggcttgatttcgccgcgattaaatatcaggccgaatctccggctgaagacaacagcgcaaaatgggtataccagccgaagccaatacctggtttcctggtaccgttaatgtgtggctaccaacgcatttctcctgtttacgcacccggtgaagttgaaaatgcgcgcgacaccgtgacgccatttgcctttgccgaagcggtatatggcattggcgaatggcgcggattacatcgcactacagacttgcaagcgctgatgtggcgttaccgcacaacggacactggctactattgttcggcaacgccagttgttgatgattttacctttaatgaatatgacgatttagaataa

SEQ ID NO: 2112 - protein, 213 aa, Escherichia coli
MHLTVSLLIECNGEITNGEYGRKVLCDYLKMLCQSHKLAGGSIVSMRDPQLFHAPEDEKQLRKIVWRLMPGYALYDRSEWLAEHHQQHPDISLLDAWLDFAAIKYQAESPAEDNSAKWVYQPKPIPGFLVPLMCGYQRISPVYAPGEVENARDTVTPFAFAEAVYGIGEWRGLHRTTDLQALMWRYRTTDTGYYCSATPVVDDFTFNEYDDLE

SEQ ID NO: 2113 - DNA, 1002 bp, Escherichia coli
atggcaaaggctcctgtagcaataaaaacggcgtcggtactggcatttgagcgcaaactggcaacctctgacgcggtaatgtacgcaggtaactggcaaggaaatgaatggcaacccattgagattcaggagaaagcggtccgcggaaccatctctaatcgcctgaaaaatgccattgtcagcgatcccacaaaactggatgctgaaatccaaaaagccaacctgcaacgggtggatgtggcttcgcttccggtagatacggatacgttaaaggtggtgtttacgctgcgtgtgctgggtaatttatccacaccgtcagtatgtaatgatatggcttaccaggaggcgctttccggggtcattgaaggttacatcagcgaacatggctttaaagagctggcgcttcgctatgcgctgaatctggcaaatggtcgttttctgtggcgcaaccgcattggtgccgaacagatccaggtgaaagtgactgctaacgagacgtcatggacttttaacagccatgacttctctttacgtcaatttgaccagggacaggcagcggtcacgcagctggcggccattatagagcaaggattaagcgcaaaagagtgggtgatgcttaccgttgaagcgcaggttcgtcttggtgccgggcaagaagtttttccgtcgcaggagctggtactcgacagcaacagtagtaaaagtcgcgtgttataccaggtggctggcattgccggtattcactctcagaagattggcaatgctttacgtaccattgatacctggcatccaaaggttgatgaattgggggctatagccgtggaaccttacggttctgtaaccagtcgcggtgtggcctgccgtcaaccgaaagaaaaactcgacttttataccttactggacaattgggtgactaaagggatgaaaccagacgttgagcagcagcactacgtgatggctgtgctgatccgtggcggtgtctttggtgagaaatcggaataa

SEQ ID NO: 2114 - protein, 333 aa, Escherichia coli
MAKAPVAIKTASVLAFERKLATSDAVMYAGNWQGNEWQPIEIQEKAVRGTISNRLKNAIVSDPTKLDAEIQKANLQRVDVASLPVDTDTLKVVFTLRVLGNLSTPSVCNDMAYQEALSGVIEGYISEHGFKELALRYALNLANGRFLWRNRIGAEQIQVKVTANETSWTFNSHDFSLRQFDQGQAAVTQLAAIIEQGLSAKEWVMLTVEAQVRLGAGQEVFPSQELVLDSNSSKSRVLYQVAGIAGIHSQKIGNALRTIDTWHPKVDELGAIAVEPYGSVTSRGVACRQPKEKLDFYTLLDNWVTKGMKPDVEQQHYVMAVLIRGGVFGEKSE

SEQ ID NO: 2115 - DNA, 555 bp, Escherichia coli
atggatcactaccttgagatccgcgttctgccagatcctgaattttcgagcgaaatgttgatggcggcgttatttgcaaaactgcatcgggtattaggtgcaagagggcaaggcgatatcggcgtgagtttccctgacgtaaatgttatgcctggagcgcgtttacgcttgcatggtagcgcccaggcattgcaggcgcttgaagcctcaacgtggcgtaaaggactaacggactattgccaatgttcacctgtcactcccgttccagaaataaaaggctggcgagtagtaagccgcgtgcaggttaaaagtaaccctcagcgtctgttaaggcgttcagtgaaaaaaggctggctaactgaagaacaggcaattgaacgactggcgacgcaggctgaacagcggactgatttaccttttctcaatatgaagagtttgtcgagtcagcaactgttcaagttgtttatccgtcatggtgatttgctcaaagaaccggttaaaggggaatttagtagttatggattaagcgcaaccgccactattccctggttttga

SEQ ID NO: 2116 - protein, 184 aa, Escherichia coli
MDHYLEIRVLPDPEFSSEMLMAALFAKLHRVLGARGQGDIGVSFPDVNVMPGARLRLHGSAQALQALEASTWRKGLTDYCQCSPVTPVPEIKGWRVVSRVQVKSNPQRLLRRSVKKGWLTEEQAIERLATQAEQRTDLPFLNMKSLSSQQLFKLFIRHGDLLKEPVKGEFSSYGLSATATIPWF

SEQ ID NO: 2117 - DNA, 219 bp, Escherichia coli
atggccaaagaagacaatattgaaatgcaaggtaccgttcttgaaacgttgcctaataccatgttccgcgtagagttagaaaacggtcacgtggttactgcacacatctccggtaaaatgcgcaaaaactacatccgcatcctgacgggcgacaaagtgactgttgaactgaccccgtacgacctgagcaaaggccgcattgtcttccgtagtcgctga

SEQ ID NO: 2118 - protein, 72 aa, Escherichia coli
MAKEDNIEMQGTVLETLPNTMFRVELENGHVVTAHISGKMRKNYIRILTGDKVTVELTPYDLSKGRIVFRSR

SEQ ID NO: 2119 - DNA, 705 bp, Escherichia coli
atgcgcctggttcagctttctcgccattcaatagccttcccttccccggaaggcgcattacgtgagcctaacggcctgctggcactggggggcgatcttagccctgcgcgcctattaatggcttatcagcgtggtattttcccgtggttttctcctggcgaccccatcctctggtggtcgcccgatccccgcgcggtgttatggccagaatcactgcatatcagccgtagtatgaagcgatttcataaacgctcaccctatcgtgtcacgatgaattacgcttttggtcaggtcatcgaaggctgtgccagcgatcgcgaagaaggaacctggatcacgcgtggcgtggtcgaagcctaccatcgccttcacgaactcggtcatgcccactccattgaagtctggcgtgaagatgagcttgtcggcggtatgtacggcgtggcccagggaacactattttgtggcgagtccatgttcagccggatggaaaatgcgtccaaaacggcgcttctggtcttctgtgatgaatttatccgtcatggcggtaaacttatcgactgccaggtccttaacgatcacacagcatcgcttggtgcctgcgaaattccccgccgggattaccttaattatctcaatcaaatgcgcctcggacgattgccgaataatttctgggtacctcgatgcttgttttcaccacaagaatga

SEQ ID NO: 2120 - protein, 234 aa, Escherichia coli
MRLVQLSRHSIAFPSPEGALREPNGLLALGGDLSPARLLMAYQRGIFPWFSPGDPILWWSPDPRAVLWPESLHISRSMKRFHKRSPYRVTMNYAFGQVIEGCASDREEGTWITRGVVEAYHRLHELGHAHSIEVWREDELVGGMYGVAQGTLFCGESMFSRMENASKTALLVFCDEFIRHGGKLIDCQVLNDHTASLGACEIPRRDYLNYLNQMRLGRLPNNFWVPRCLFSPQE

SEQ ID NO: 2121 - DNA, 1722 bp, Escherichia coli
atgcgcgctttgctaccctatctggcactgtataaacgtcataaatggatgttaagtcttggtatcgtgctggcaattgtcacgctgctcgccagtatcggtctgttgaccctttccggctggttcctctccgcctcagcggtagcgggggttgccggactgtacagcttcaactatatgctacccgctgcgggcgtgcgtggcgcagcaatcacccgtactgccgggcgttattttgaacgtctggtaagtcacgacgcgactttccgcgtgttgcagcatctgcgcatatacaccttcagcaaattgctgcccctctcccctgccggactggcgcgctatcgtcagggtgaattactcaaccgcgtggtggcggatgttgatacgctcgatcatctttacctgcgcgttatctcgccgctggtaggtgcttttgtggtgattatggtggtgacaatcgggttaagtttccttgatttcaccctcgcctttacgctgggcggcattatgttactgacgcttttcctgatgccaccactgttttatcgtgcgggaaaaagcaccgggcaaaatctgactcatcttcgcgggcagtatcgccaacaactgacggcctggctgcaagggcaagctgagctgaccatttttggtgccagcgatcgttatcgcacgcaattagagaatacagaaattcagtggctggaagcgcaacgccgtcaatctgaactgaccgcattgtcgcaagcgataatgctgctcattggcgcgttagcggtgatcctgatgctgtggatggcgtccggtggcgttggcggcaatgctcaacccggcgcgttaattgccctgtttgtcttctgcgcgttagccgcgtttgaagcgctggcaccagtaacgggtgcatttcagcatctggggcaagtcattgcctctgccgtacggatcactgatttaacggatcaaaaaccggaagtcaccttccctgatacccaaactcgtgttgccgatcgcgtttcgctgacattacgggatgttcagttcacttatccggagcaatcccaacaggcacttaaagggatttatcttcaggtaaacgccggggaacatattgcgattctcgggcgaaccggatgcggcaaatcaacactgttacaactgctgacccgcgcatgggacccgcaacagggcgagattttgcttaacgatagtcccatagccagcctgaatgaagcggctctacgacagaccatcagcgttgttccccagcgagtgcatctgtttagcgccacgctgcgtgataatctgttactcgcctcgcctggtagtagtgatgaggctctggcggagatcttgcgtcgcgttggtctggagaagctgctcgaggatgcaggtctcaacagttggttaggtgaaggcggacgccagctctccggtggtgaactgcgccgtctggctatcgcccgtgcgctgttacatgatgcgccgctggtattgctggatgaacctacagaaggcttagatgccacaaccgaaagtcagatccttgaattgcttgcagaaatgatgtgcgagaaaacggtgttaatggtcacccatcgacttcgcggactctctcgtttccaacaaataatagtgatggacaacgggcaaattattgagcaaggtactcacgcagaactgcttgccagacaggggcgttattaccagtttaagcagggtttgtaa

SEQ ID NO: 2122 - protein, 573 aa, Escherichia coli
MRALLPYLALYKRHKWMLSLGIVLAIVTLLASIGLLTLSGWFLSASAVAGVAGLYSFNYMLPAAGVRGAAITRTAGRYFERLVSHDATFRVLQHLRIYTFSKLLPLSPAGLARYRQGELLNRVVADVDTLDHLYLRVISPLVGAFVVIMVVTIGLSFLDFTLAFTLGGIMLLTLFLMPPLFYRAGKSTGQNLTHLRGQYRQQLTAWLQGQAELTIFGASDRYRTQLENTEIQWLEAQRRQSELTALSQAIMLLIGALAVILMLWMASGGVGGNAQPGALIALFVFCALAAFEALAPVTGAFQHLGQVIASAVRITDLTDQKPEVTFPDTQTRVADRVSLTLRDVQFTYPEQSQQALKGIYLQVNAGEHIAILGRTGCGKSTLLQLLTRAWDPQQGEILLNDSPIASLNEAALRQTISVVPQRVHLFSATLRDNLLLASPGSSDEALAEILRRVGLEKLLEDAGLNSWLGEGGRQLSGGELRRLAIARALLHDAPLVLLDEPTEGLDATTESQILELLAEMMCEKTVLMVTHRLRGLSRFQQIIVMDNGQIIEQGTHAELLARQGRYYQFKQGL

SEQ ID NO: 2123 - DNA, 726 bp, Escherichia coli
gtgaccattgaagccgaggatctgtttatcacgtcgccggaaggtaaaacgctggccggaccgctgaattttactttgccagcaggccaacgagcagtgttggttggtcgcagcggttcaggtaaaagttcactgttgaacgcgctttctggttttctctcatatcagggatcgctacgaatcaacgggatagaattacgcgatttatcaccggaatcatggcgtaaacatctctcctgggttgggcaaaacccacaattaccggcagcaacattacgggataacgtactactggcgcgacctgatgccagcgaacaagagttacaaacagcgctggataacgcctgggtcagtgagtttctaccgctcctgccgcaaggcattgattcgcctgttggtgaccaggctgcccgcctttccgtggggcaggcgcagcgcgtggcggtggcccgtgcgttactaaatccctgttcgctattactgttggatgaacccgctgccagccttgatgctcacagtgaacagcgcgtaatggaggcgctgaataccgcctctctgcgccagacaacgttaatggtcacccaccagttagaagatcttgctgactgggatgtcatttgggtaatgcaggatggtcagattattgagcaaggacgttacgcggaattaagtgtggctggcggcccattcgccacattactggcccatcgtcaggaggagatttaa

SEQ ID NO: 2124 - protein, 241 aa, Escherichia coli
MTIEAEDLFITSPEGKTLAGPLNFTLPAGQRAVLVGRSGSGKSSLLNALSGFLSYQGSLRINGIELRDLSPESWRKHLSWVGQNPQLPAATLRDNVLLARPDASEQELQTALDNAWVSEFLPLLPQGIDSPVGDQAARLSVGQAQRVAVARALLNPCSLLLLDEPAASLDAHSEQRVMEALNTASLRQTTLMVTHQLEDLADWDVIWVMQDGQIIEQGRYAELSVAGGPFATLLAHRQEEI

SEQ ID NO: 2125 - DNA, 474 bp, Escherichia coli
atgaaaacattgtctcagaacaccacctcttcggcctgtgcaccggagactggcctgcaacaactggttgccaccatagtccctgatgaacagcgcatcagcttctggccgcagcattttggcctcattccacagtgggtgaccctggagccccgtgtcttcggctggatggaccgtctgtgcgaaaactactgcggtggtatctggaatctgtacaccctgaacaacggcggggcatttatggcccctgaaccggatgactatgatgacgaaacatgggtactgttcaatgccatgaacggtaaccgcgctgaaatgagcccggaagccgccggcattgccgcctgtctgatgatgtacagtcatcacgcctgccgtacggagtgttatgccatgacggttcattattaccgtctgcgggattacgccctgcagcatccggaatgcagcgccattatgcgcattattgactga

SEQ ID NO: 2126 - protein, 157 aa, Escherichia coli
MKTLSQNTTSSACAPETGLQQLVATIVPDEQRISFWPQHFGLIPQWVTLEPRVFGWMDRLCENYCGGIWNLYTLNNGGAFMAPEPDDYDDETWVLFNAMNGNRAEMSPEAAGIAACLMMYSHHACRTECYAMTVHYYRLRDYALQHPECSAIMRIID

SEQ ID NO: 2127 - DNA, 471 bp, Escherichia coli
  n 448, 449, 450, 451, 452: n is any nucleotide
atgcaacagctttcctttctgcccggagagatgacgcccggcgagcgcagtctcattctgcgggccctgaaaaccctggaccgccatcttcatgaacccggcgtggccttcacctccacccgtgcggcacgggaatggctgattctgaacatggcgggactggagcgtgaagagttccgggtgctgtatctgaataaccagaatcagctgattgccggtgaaaccctcttcaccggcaccatcaaccgcacggaagtccatccccgggaagtgattaaacgcgccctgtatcacaatgccgcagccgtggtgctggcacacaatcacccgtccggtgaagtcacccccagtaaggcagaccgccttatcacggaacgtctggtacaggcactgggcctggtggatatccgggtgccggaccatctgatagtcggtggcagccaggttnnnnncattccattcattaattaa

SEQ ID NO: 2128 - protein, 156 aa, Escherichia coli
  Xaa 150, 151: Xaa is any amino acid
MQQLSFLPGEMTPGERSLILRALKTLDRHLHEPGVAFTSTRAAREWLILNMAGLEREEFRVLYLNNQNQLIAGETLFTGTINRTEVHPREVIKRALYHNAAAVVLAHNHPSGEVTPSKADRLITERLVQALGLVDIRVPDHLIVGGSQVXXIPFIN

SEQ ID NO: 2129 - DNA, 528 bp, Escherichia coli
  n 510, 511, 512, 513, 514: n is any nucleotide
atgaataaatcccgtcaaaaagaattaacccgctggttaaaacagcaaagcgtcatctcccaacgttggctgaatatttctcgtctgctgggctttgtgagcggcatattgatcatttcccaggcctggttcatggcgcgaattctgcaacatatgattatggagaatattccccgtgaagccctgctgcttccctttacgttactgtttctgacctttgtactgcgcgcatgggtggtctggttacgcgaacgggtgggttatcacgccgggcagcatatccgctttgccatccgccgtcaggttctcgaccgtctgcaacaagcagggccagcgtggattcagggtaaaccagcggggagctgggcgacgctggtactcgagcaaattgacgatatgcatgattactatgcacgctacctgccgcaaatggcgctggcagtgtcggtgccgctgctgattgtggtggctatcttcccctctaactgggccgcggcgctcattctgctnnnnncattcattcattaa

SEQ ID NO: 2130 - protein, 175 aa, Escherichia coli
  Xaa 171, 172: Xaa is any amino acid
MNKSRQKELTRWLKQQSVISQRWLNISRLLGFVSGILIISQAWFMARILQHMIMENIPREALLLPFTLLFLTFVLRAWVVWLRERVGYHAGQHIRFAIRRQVLDRLQQAGPAWIQGKPAGSWATLVLEQIDDMHDYYARYLPQMALAVSVPLLIVVAIFPSNWAAALILLXXFIH

SEQ ID NO: 2131 - DNA, 1071 bp, Escherichia coli
atgctgccgattgcacaaattgttaacaaaatcgtcatactctttttttacgtctgtaaattccctacaatcctgccattgtctgccaacaactatggggatctcatgggcacgaccaaacacagtaaactgcttatcctgggttcaggcccggcgggatacaccgctgctgtctacgcggcgcgcgccaacctgcaacctgtgctgattaccggcatggaaaaaggcggccaactgaccaccaccacggaagtggaaaactggcctggcgatccaaacgatctgaccggtccgttattaatggagcgcatgcacgaacatgccaccaaatttgaaactgaaatcatctttgatcacatcaacaaagttgatttgcagaatcgtccgttccgtctgactggcgatagcggcgaatacacttgcgacgcgctgattattgccaccggagcttctgcacgctatctcggcctgccctctgaagaagcctttaaaggccgtggagtttctgcttgtgcaacctgcgacggtttcttctatcgcaaccagaaagttgcggtcatcggcggcggcaataccgcggttgaagaggcgctgtatctgtctaacatcgcttcggaagttcatctgattcaccgccgtgatggtttccgtgcggaaaaaatcctcattaagcgtctgatggataaagtggagaacggcaacattattctgcacaccaaccgtacgctggaagaagtgaccggcgatcagatgggtgtcactggcgttcgtctgcgcgatacgcaaaacagcgataacatcgagtcactcgacgttgccggtctgtttgttgctatcggtcacagcccgaatactgccattttcgaagggcagctggaactggaaaacggctacatcaaagtacagtcgggtattcatggtaatgccacccagaccagcatccctggcgtctttgccgcaggcgacgtgatggatcacatttatcgccaggccattacatctgctggtacaggctgcatggcagctcttgatgcggaacgctacctcgacggtttagctgacgcaaaataa

SEQ ID NO: 2132 - protein, 356 aa, Escherichia coli
MLPIAQIVNKIVILFFYVCKFPTILPLSANNYGDLMGTTKHSKLLILGSGPAGYTAAVYAARANLQPVLITGMEKGGQLTTTTEVENWPGDPNDLTGPLLMERMHEHATKFETEIIFDHINKVDLQNRPFRLTGDSGEYTCDALIIATGASARYLGLPSEEAFKGRGVSACATCDGFFYRNQKVAVIGGGNTAVEEALYLSNIASEVHLIHRRDGFRAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 2133 - DNA, 396 bp, Escherichia coli
  n 4, 5, 6, 7, 8: n is any nucleotide
atgnnnnnacgtgtgggactttccccaacgccgtgccttgagcgtgtgcgtcggctggaaagacaagggtttattcagggctatacggcgctgctgaacccccattatctggatgcatcacttctggtattcgttgagattactctgaatcgtggcgcaccggatgtgtttgaacaattcaataccgctgtacaaaaacttgaagaaattcaggagtgtcatttagtatccggtgatttcgactacctgttgaaaacacgcgtgccggatatgtctgcttaccgtaagttactgggggaaaccctgctgcgtctgcctggtgtcaatgacacacggacatacgttgttatggaagaagtcaagcagagtaatcgtctggttattaagacgcgctaa

SEQ ID NO: 2134 - protein, 131 aa, Escherichia coli
  Xaa 2, 3: Xaa is any amino acid
MXXRVGLSPTPCLERVRRLERQGFIQGYTALLNPHYLDASLLVFVEITLNRGAPDVFEQFNTAVQKLEEIQECHLVSGDFDYLLKTRVPDMSAYRKLLGETLLRLPGVNDTRTYVVMEEVKQSNRLVIKTR

SEQ ID NO: 2135 - DNA, 4044 bp, Escherichia coli
ttgagccaggaatacactgaagacaaagaagtcacattgacaaagttaagtagcggccgccgtcttctggaggcgttgctgatccttattgtcctgtttgccgtctggttgatggctgccttactaagctttaacccttcggaccccagctggtcgcaaacggcctggcatgaacctatccataatttaggtgggatgcccggtgcgtggttggcagatacgctgttctttatttttggcgtgatggcttacaccattcccgtcattattgtcggcggttgttggtttgcctggcgtcatcagtccagcgacgaatacattgattattttgccgtttcgctacgcatcattggcgttttggcgctcatccttacctcctgtggtctggcggcaatcaacgctgacgatatctggtattttgcctccggtggcgtcattggcagcttactaagcactacgctacaaccactgctacacagtagcgggggaactattgcgctgctctgcgtttgggcagcgggcctgacgctgttcaccggttggtcatgggtgaccattgctgaaaaactcggcggctggattttaaatattcttaccttcgccagtaatcgtacccgtcgcgatgatacctgggtcgatgaagatgagtatgaagacgacgaagagtatgaagatgaaaatcacggcaaacagcatgaatcacgccgtgcccgtattcttcgcggcgcgctagcgcgtcgtaaacggttggcggaaaaattcattaatccgatggggcggcaaacagatgctgcgctgttctccggtaagcggatggatgatgaagaagagattacctacactgcacgcggtgtggctgccgaccctgacgacgtcctgttttcgggcaatcgtgcaacgcagccagaatatgacgaatacgatccattattaaacggtgcgccaattaccgaacctgttgctgtagcagctgctgctaccacggcgacacaaagctgggctgcaccggttgaacctgtgactcagacgccgccagttgcctctgttgatgttccacctacgcaacctacagtagcctggcagcctgtaccggggccgcaaacgggagaaccggttattgcacctgcaccggaaggttacccacagcagtcacaatatgcgcagcctgcagtgcaatataatgagccgctgcaacaacctgtacagccacagcagccgtattatgcgcctgcggctgaacagcctgtgcaacaaccttactacgctcctgcgccggaacagtctgcgcaacagccgtattacgcccctgcgccagaacaaccggtggcaggtaacgcctggcaagccgaagagcagcaatccacttttgctccacagtctacataccagacggagcaaacttatcagcagccagccgctcaggagccgttgtaccaacagccgcaacccgttgaacagcagcctgttgtggagcctgaacccgttgtagaagagacaaaacccacgcgtccgccgctttactattttgaagaagtggaagagaagcgagcccgtgaacgtgaacaacttgcggcctggtatcaaccgattccagaaccggttaaagaaccggaaccgatcaaatcttcgctgaaagcaccttctgttgcagcagtacctccagtagaagccgctgccgctgtttctccgctggcatctggtgtgaaaaaagcgacactggcgacgggggctgccgcaaccgttgccgcgccagtcttcagtctggcaaatggcggtggaccgcgtccgcaggtcaaagaggggattggcccgcagttgccacgaccgaaacgcatccgcgtgccaactcgtcgtgaactggcgtcttacggtattaagctgccctcacagcgtgcggcagaagaaaaagcccgtgaagcccagcgtaatcagtacgattctggcgatcagtacaacgatgatgaaatcgatgcgatgcagcaggatgaactggcacgtcagttcgcccagacgcagcagcaacgctatggcgaacagtatcaacatgatgtgcccgtgaacacagaagatgcagatgctgcggcagaggcagaactggctcgtcagtttgctcaaactcaacaacaacgttattccggcgaacaaccggctggggcgaatccgttctcgctggatgattttgaattttcgccaatgaaagcgttgctggatgatggtccacacgaaccgctgtttacgccaattgttgaacctgtacagcagccgcaacaaccggtagcaccgcagcagcaatatcagcagccgcaacaaccggtagcaccgcagcagcaatatcagcagccgcaacaaccggttgcaccgcagccgcagtatcagcagccgcaatatcagcagccacaacagccggttgcacagcagccgcaatatcagcagccacaacaaccggttgcacagcagccgcagtatcagcagccacaacagccggttgtatcacagccgcaggataccctgcttcatccgctgttgatgcgtaatggcgacagccgtccgttgcataaaccgacgacgccactgccttctctggatttgctgacaccgccgccgagcgaagtggagccggtagatacctttgcgcttgaacaaatggcgcgcctggtagaagcgcgtctggctgatttccgtattaaagccgatgttgtcaattactctccggggccagttatcactcgctttgaattgaacctggcaccgggcgtaaaagcagcgcgcatttctaacttgtcacgtgaccttgcccgttcactttcgacggtggcggtgcgtgtcgttgaagttattcctggcaaaccctatgtaggtctggagttaccgaataaaaaacgacaaaccgtttatctgcgcgaagttttggataacgccaaattccgcgataatccgtcgccattaaccgtggtgctgggtaaagatatcgccggtgagccggtggttgccgatctggcgaaaatgccgcacttgttggttgcggggactaccggttccggtaagtctgtcggggtgaacgcgatgatcctgagcatgctttataaagcacagccagaagatgtgcgtttcatcatgatcgacccgaaaatgctggagctttcggtttatgaaggcattccgcacctgttaacggaagttgttactgatatgaaagatgccgccaacgcgctgcgctggtgtgttaacgagatggagcgtcgttataaactgatgtctgcgctgggtgtgcgtaatctggcgggttataacgaaaaaattgctgaagccgatcgcatgatgcgtccgattccagacccgtactggaagccgggtgatagtatggatgcgcagcatccggtgctgaaaaaagaaccatacattgtggtgttggtggacgaatttgccgacctgatgatgacggtaggtaaaaaagtggaagagctgatagcacgtctggcgcaaaaagcccgtgccgcgggtatccacctcgtactggcaacgcagcgtccatcggttgatgttattactggtctgattaaagcgaatattccgacccgtatcgcctttaccgtatccagtaagattgactcacgtaccattcttgatcaggctggtgcggaatcactgctgggtatgggggatatgctctactctgggccgaactccacgttgccggtacgtgtccatggtgcttttgttcgcgatcaggaagttcatgccgtggtgcaggactggaaagcgcgtggtcgcccacagtatgttgatggcatcacctccgacagtgaaagcgaaggtggcgtgggcggtttcgatggcgctgaagaactggatccgttgttcgatcaggcggtgcagtttgtcactgaaaaacgcaaagcgtcaatttctggcgtacagcgtcagttccgcattggttataaccgtgcagcgcgtattatcgaacagatggaagcgcaggggattgtcagcgaacaggggcacaacggaaatcgtgaagtgctggccccaccgccatttgactaa

SEQ ID NO: 2136 - protein, 1347 aa, Escherichia coli
MSQEYTEDKEVTLTKLSSGRRLLEALLILIVLFAVWLMAALLSFNPSDPSWSQTAWHEPIHNLGGMPGAWLADTLFFIFGVMAYTIPVIIVGGCWFAWRHQSSDEYIDYFAVSLRIIGVLALILTSCGLAAINADDIWYFASGGVIGSLLSTTLQPLLHSSGGTIALLCVWAAGLTLFTGWSWVTIAEKLGGWILNILTFASNRTRRDDTWVDEDEYEDDEEYEDENHGKQHESRRARILRGALARRKRLAEKFINPMGRQTDAALFSGKRMDDEEEITYTARGVAADPDDVLFSGNRATQPEYDEYDPLLNGAPITEPVAVAAAATTATQSWAAPVEPVTQTPPVASVDVPPTQPTVAWQPVPGPQTGEPVIAPAPEGYPQQSQYAQPAVQYNEPLQQPVQPQQPYYAPAAEQPVQQPYYAPAPEQSAQQPYYAPAPEQPVAGNAWQAEEQQSTFAPQSTYQTEQTYQQPAAQEPLYQQPQPVEQQPVVEPEPVVEETKPTRPPLYYFEEVEEKRAREREQLAAWYQPIPEPVKEPEPIKSSLKAPSVAAVPPVEAAAAVSPLASGVKKATLATGAAATVAAPVFSLANGGGPRPQVKEGIGPQLPRPKRIRVPTRRELASYGIKLPSQRAAEEKAREAQRNQYDSGDQYNDDEIDAMQQDELARQFAQTQQQRYGEQYQHDVPVNTEDADAAAEAELARQFAQTQQQRYSGEQPAGANPFSLDDFEFSPMKALLDDGPHEPLFTPIVEPVQQPQQPVAPQQQYQQPQQPVAPQQQYQQPQQPVAPQPQYQQPQYQQPQQPVAQQPQYQQPQQPVAQQPQYQQPQQPVVSQPQDTLLHPLLMRNGDSRPLHKPTTPLPSLDLLTPPPSEVEPVDTFALEQMARLVEARLADFRIKADVVNYSPGPVITRFELNLAPGVKAARISNLSRDLARSLSTVAVRVVEVIPGKPYVGLELPNKKRQTVYLREVLDNAKFRDNPSPLTVVLGKDIAGEPVVADLAKMPHLLVAGTTGSGKSVGVNAMILSMLYKAQPEDVRFIMIDPKMLELSVYEGIPHLLTEVVTDMKDAANALRWCVNEMERRYKLMSALGVRNLAGYNEKIAEADRMMRPIPDPYWKPGDSMDAQHPVLKKEPYIVVLVDEFADLMMTVGKKVEELIARLAQKARAAGIHLVLATQRPSVDVITGLIKANIPTRIAFTVSSKIDSRTILDQAGAESLLGMGDMLYSGPNSTLPVRVHGAFVRDQEVHAVVQDWKARGRPQYVDGITSDSESEGGVGGFDGAEELDPLFDQAVQFVTEKRKASISGVQRQFRIGYNRAARIIEQMEAQGIVSEQGHNGNREVLAPPPFD

SEQ ID NO: 2137 - DNA, 612 bp, Escherichia coli
atgaaaaaaattgccatcacctgtgcattactctcaagtttagtagcaagcagcgtttgggctgatgccgcaagcgatctgaaaagccgcctggataaagtcagcagctttcacgccagcttcacacaaaaagtgactgacggtagcggcgcggcggtgcaggaaggccagggcgatctgtgggtgaaacgtccaaacttattcaactggcatatgactcaacctgatgaaagcattttggtttctgacggtaaaacactgtggttctataacccgttcgttgagcaagctacggcaacctggctgaaagatgccaccggtaatacgccgtttatgctgattgcccgcaaccagtccagcgactggcagcagtacaatatcaaacagaatggcgatgactttgttctgacgccgaaagccagcaatggcaatctgaagcagttcaccattaacgtgggacgtgatggcacaatccatcagtttagcgcggtggagcaggacgatcagcgcagcagttatcagctgaaatcccagcaaaatggggctgtggatgcagcgaaatttaccttcaccccgccgcaaggcgtcacggtagatgatcaacgtaagtag

SEQ ID NO: 2138 - protein, 203 aa, Escherichia coli
MKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPPQGVTVDDQRK

SEQ ID NO: 2139 - DNA, 1344 bp, Escherichia coli
gtgagcaatctgtcgctcgatttttcggataatacttttcaacccctggccgcgcgtatgcggccagaaaatttagcacagtatatcggccagcaacatttgctggctgtggggaagccgttgccgcgcgctatcgaagccgggcatctgcattctatgatcctctgggggccgccgggtaccggcaaaacaaccctcgctgaagtgattgcccgctatgcgaacgctgatgtggaacgtatttctgccgtcacctctggcgtgaaagagattcgcgaggcgatcgaacgcgctcggcaaaaccgcaatgcaggtcgccgcactattctttttgttgacgaagttcaccgtttcaacaaaagccagcaggatgcatttctgccacatattgaagacggcaccattacttttattggcgcaaccactgaaaacccgtcgtttgagcttaattcggcactgctttcccgtgcccgtgtctatctgttgaaatccctgagtacagaggatattgagcaagtactaactcaggcgatggaagacaaaacccgtggctatggtggtcaggatattgttctgccagatgaaacacgacgcgccattgctgaactggtgaatggcgacgcgcgccgggcgttaaatacgctggaaatgatggcggatatggccgaagtcgatgatagcggtaagcgggtcctgaagcctgaattactgaccgaaatcgccggtgaacgtagcgcccgctttgataacaaaggcgatcgcttttacgatctgatttccgcattgcataagtcggtacgtggtagcgcacccgatgcggcgctctactggtatgcgcgaattattaccgccggtggcgatccgttatatgttgcgcgtcgttgcctggcaattgcttccgaagatgtcggcaatgccgacccacgggcgatgcaggtggcaattgcggcctgggattgctttactcgcgttggcccggcggaaggtgaacgcgccattgctcaggcgattgtttacctggcctgcgcgccaaaaagcaacgctgtctacactgcgtttaaagccgcgctggccgatgctcgcgaacgtccggattatgacgtgccggttcatttgcgtaatgcgccgacgaaattaatgaaggaaatgggctacgggcaggaatatcgttacgctcatgatgaagcaaacgcttatgctgccggtgaggtttacttcccgccggaaatagcacaaacacgctattatttcccgacaaacaggggccttgaaggcaagattggcgaaaagctcgcctggctggctgaacaggatcaaaatagccccataaaacgctaccgttaa

SEQ ID NO: 2140 - protein, 447 aa, Escherichia coli
MSNLSLDFSDNTFQPLAARMRPENLAQYIGQQHLLAVGKPLPRAIEAGHLHSMILWGPPGTGKTTLAEVIARYANADVERISAVTSGVKEIREAIERARQNRNAGRRTILFVDEVHRFNKSQQDAFLPHIEDGTITFIGATTENPSFELNSALLSRARVYLLKSLSTEDIEQVLTQAMEDKTRGYGGQDIVLPDETRRAIAELVNGDARRALNTLEMMADMAEVDDSGKRVLKPELLTEIAGERSARFDNKGDRFYDLISALHKSVRGSAPDAALYWYARIITAGGDPLYVARRCLAIASEDVGNADPRAMQVAIAAWDCFTRVGPAEGERAIAQAIVYLACAPKSNAVYTAFKAALADARERPDYDVPVHLRNAPTKLMKEMGYGQEYRYAHDEANAYAAGEVYFPPEIAQTRYYFPTNRGLEGKIGEKLAWLAEQDQNSPIKRYR

SEQ ID NO: 2141 - DNA, 1176 bp, Escherichia coli
ttgcaggtcaaaacggaaaacctgcaagcggagcgtaactcccgatcgaaatccattggccaggcgaaagcgcgcggggaagatatcgagcctttacgtctggaagtgaacaaactgggcgaagagctggatgcagcaaaagccgagctggatgctttacaggctgaaattcgcgatatcgcgctaaccatccctaacctgcctgcagatgaagtgccggtaggtaaagacgaaaatgacaacgttgaagtcagtcgctggggcaccccgcgtgagtttgactttgaagttcgtgaccatgtgacgctgggtgaaatgcactctggcctcgactttgcagccgcagttaagttgactggttcccgctttgtcgtcatgaaagggcagattgctcgcatgcaccgcgcactgtcgcagtttatgctggatctgcataccgaacagcatggctacagtgagaactatgttccgtacctggttaaccaggacacgctgtacggtacgggtcagctgccgaaatttgctggcgatctgttccatactcgtccgctggaagaagaagcagacaccagtaactatgcgctgatcccaacggcagaagttccgctgaccaacctggtacgcggtgaaatcatcgatgaagatgatctgccaattaagatgaccgcccacaccccatgtttccgttctgaagctggttcatatggtcgtgacactcgtggtctgatccgtatgcaccagttcgacaaagttgaaatggtgcagatcgtgcgcccggaagactcaatggcggcgctggaagagatgaccggtcatgcggaaaaagtcctgcagctgctgggcctgccgtaccgtaaaatcatcctttgtaccggcgacatgggctttggcgcttgcaaaacttacgacctggaagtatggatcccggcacagaacacctaccgcgagatctcttcctgctccaacgtttgggatttccaggcacgtcgtatgcaggcacgttgccgcagcaagtcggacaagaaaacccgtctggttcataccctgaacggttctggtcttgctgttggtcgtacgctggttgcagtaatggaaaactatcagcaggctgatggtcgtattgaagtaccagaagttctgcgtccgtatatgaacggactggaatatattggctaa

SEQ ID NO: 2142 - protein, 391 aa, Escherichia coli
MQVKTENLQAERNSRSKSIGQAKARGEDIEPLRLEVNKLGEELDAAKAELDALQAEIRDIALTIPNLPADEVPVGKDENDNVEVSRWGTPREFDFEVRDHVTLGEMHSGLDFAAAVKLTGSRFVVMKGQIARMHRALSQFMLDLHTEQHGYSENYVPYLVNQDTLYGTGQLPKFAGDLFHTRPLEEEADTSNYALIPTAEVPLTNLVRGEIIDEDDLPIKMTAHTPCFRSEAGSYGRDTRGLIRMHQFDKVEMVQIVRPEDSMAALEEMTGHAEKVLQLLGLPYRKIILCTGDMGFGACKTYDLEVWIPAQNTYREISSCSNVWDFQARRMQARCRSKSDKKTRLVHTLNGSGLAVGRTLVAVMENYQQADGRIEVPEVLRPYMNGLEYIG

SEQ ID NO: 2143 - DNA, 2445 bp, Escherichia coli
atgaaaacgaaaatccctgatgcggtattggctgctgaggtgagtcgccgtggtttggtaaaaacgacagcgatcggcggcctggcaatggccagcagcgcattaacattaccttttagtcggattgcgcacgctgtcgatagcgctattccaacaaaatcagacgaaaaggttatctggagcgcctgtacagttaactgtggtagtcgctgcccgctacgtatgcacgtagtggacggtgaaatcaaatatgtcgaaacggacaataccggcgatgacaattacgacggcctgcaccaggttcgcgcctgtctgcgtgggcgttccatgcgtcgccgtgtctacaatccggaccgcctgaaatatccgatgaaacgagtcggggcgcgcggtgaaggcaaattcgagcgcattagctgggaagaagcctacgacatcatcgcgaccaaaatgcagcgcctgatcaaagagtacggcaacgagtctatctatctgaactatggcaccggtacgctgggcggcaccatgacccgctcgtggccgccgggaaataccctggtcgcgcggctaatgaactgctgcggcggttatctgaaccattatggcgactactcctccgcgcaaattgcggaaggtctgaactatacctacggcggctgggcagatggtaacagcccgtcggatatcgaaaacagtaaactggtagtgctgtttggtaataaccctggcgaaacgcgaatgagtggcggtggggtgacttactatcttgaacaggcgcgccagaaatctaatgctcgcatgatcatcatcgatccgcgctataccgacaccggtgccgggcgtgaagatgagtggatccctattcgtccgggaacagatgccgcactggttaacggtctggcgtatgtcatgatcaccgaaaacctggtagatcaggaattcctcgataaatattgcgttggctacgacgagaaaaccctgccagccagtgcgccgaaaaatggtcactataaagcttatattctgggtgaaggacccgatggcgtggctaaaacaccggaatgggcctcgcaaatcaccggtgttccggcagacaaaatcatcaaactggctcgtgaaatcggcagtaccaaaccggcgtttatcagccagggatggggcccgcagcgtcatgctaacggtgaaatcgcaacccgtgctatctcgatgctggcgattctgaccggtaacgttggtattaacggggggaacagcggcgcgcgcgaaggttcatacagcttaccgtttgtccgtatgccgactctcgaaaacccgatccagaccagcatttctatgtttatgtggaccgatgccattgaacgtggcccggaaatgacggcgctgcgtgatggtgtgcgcgggaaagataagctggatgtgccgatcaaaatgatctggaactatgccggtaactgcctgattaatcagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcactggatgcatcctgcgggaatatgtcttacgttattttcaatgatcaggtcattaaaccgcgctttgaatgtaagactatctatgagatgaccagcgaactggcaaaacgtcttggcgtcgaacaacagtttactgaaggtcgtactcaggaagagtggatgcggcatctgtatgcccagtcgcgggaagcgattcctgaactgccaacgtttgaagagttccgtaagcaggggatctttaaaaagcgcgatccgcaagggcatcacgttgcttataaagctttccgtgaagatccgcaggcaaatccactgaccacgccatcggggaaaattgagatttattcgcaggcgctggctgacattgccgctacctgggaattgccagaaggtgatgtgatcgatccactgccgatctacacgccgggctttgaaagttatcaggatccgctgaacaaacagtatccgctgcagcttacgggtttccactataaatctcgcgttcactcaacttacggcaacgttgatgtgctgaaagcagcttgccgtcaggaaatgtggatcaacccgcttgatgcgcaaaaacgcggtatcaacaacggcgataaagtcaggatctttaatgatcgtggtgaggttcatattgaggcgaaagtgacgccacgaatgatgccgggtgtggtcgcactgggtgaaggtgcctggtatgacccggatacaaaacgtgtcgataagggcggttgtattaacgtactgaccactcaacgtccgtctcctcttgccaaggggaatccatcacatacgaaccttgttcaggttgaaaaggtgtaa

SEQ ID NO: 2144 - protein, 814 aa, Escherichia coli
MKTKIPDAVLAAEVSRRGLVKTTAIGGLAMASSALTLPFSRIAHAVDSAIPTKSDEKVIWSACTVNCGSRCPLRMHVVDGEIKYVETDNTGDDNYDGLHQVRACLRGRSMRRRVYNPDRLKYPMKRVGARGEGKFERISWEEAYDIIATKMQRLIKEYGNESIYLNYGTGTLGGTMTRSWPPGNTLVARLMNCCGGYLNHYGDYSSAQIAEGLNYTYGGWADGNSPSDIENSKLVVLFGNNPGETRMSGGGVTYYLEQARQKSNARMIIIDPRYTDTGAGREDEWIPIRPGTDAALVNGLAYVMITENLVDQEFLDKYCVGYDEKTLPASAPKNGHYKAYILGEGPDGVAKTPEWASQITGVPADKIIKLAREIGSTKPAFISQGWGPQRHANGEIATRAISMLAILTGNVGINGGNSGAREGSYSLPFVRMPTLENPIQTSISMFMWTDAIERGPEMTALRDGVRGKDKLDVPIKMIWNYAGNCLINQHSEINRTHEILQDDKKCELIVVIDCHMTSSAKYADILLPDCTASEQMDFALDASCGNMSYVIFNDQVIKPRFECKTIYEMTSELAKRLGVEQQFTEGRTQEEWMRHLYAQSREAIPELPTFEEFRKQGIFKKRDPQGHHVAYKAFREDPQANPLTTPSGKIEIYSQALADIAATWELPEGDVIDPLPIYTPGFESYQDPLNKQYPLQLTGFHYKSRVHSTYGNVDVLKAACRQEMWINPLDAQKRGINNGDKVRIFNDRGEVHIEAKVTPRMMPGVVALGEGAWYDPDTKRVDKGGCINVLTTQRPSPLAKGNPSHTNLVQVEKV

SEQ ID NO: 2145 - DNA, 618 bp, Escherichia coli
atgacaacccagtatggattttttattgattccagccgttgcaccggttgcaaaacctgcgagctggcttgtaaagactacaaagatttgacgccagaagtcagcttccgccgcatttatgaatatgctggtggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtatgcattggctgccgttactgtcatatggcttgcccgtatggcgcaccgcaatataacgaaacgaaaggccatatgaccaaatgcgatggttgttatgaccgtgttgcggagggaaaaaaaccgatctgcgtagagtcctgcccgctgcgggcgctggatttcggccctatcgacgagctgcgtaaaaaacatggcgatctggcggccgttgcgccgttgccgcgagctcactttaccaaaccgaatattgtgatcaaacccaatgccaacagccgcccaaccggggataccactggctatctggcaaacccgaaggaggtgtga

SEQ ID NO: 2146 - protein, 205 aa, Escherichia coli
MTTQYGFFIDSSRCTGCKTCELACKDYKDLTPEVSFRRIYEYAGGDWQEDNGVWHQNVFAYYLSISCNHCEDPACTKVCPSGAMHKREDGFVVVDEDVCIGCRYCHMACPYGAPQYNETKGHMTKCDGCYDRVAEGKKPICVESCPLRALDFGPIDELRKKHGDLAAVAPLPRAHFTKPNIVIKPNANSRPTGDTTGYLANPKEV

SEQ ID NO: 2147 - DNA, 864 bp, Escherichia coli
atgggaagtggatggcatgaatggccgctgatgatcttcacggtcttcgggcaatgtgtagcgggtggttttatcgttctggctttggcgctgctcaaaggcgacctgcgagcagaagcccagcagcgtgttatcgcctgcatgttgggtttatgggtgctgatgggcattggctttatcgcctctatgcttcatcttggttcaccgatgcgcgcttttaactcgctcaatcgggtaggggcttcagcactcagtaacgaaattgccagcggttcgatcttttttgctgtaggcggcatcggctggttgctggcaatgctgaaaaagctttcaccggcattgcgtacgctttggctggtggtgacgatggttcttggcgtagtctttgtctggatgatggtgcgtgtgtataacagcatcgatacagtacccacctggtacagcatctggacaccgatgggcttcttcctgacgatgtttatgggcggcccgttactgggttacctgttgctgagtctggctggtgtcgatggctgggcgatgcgtctgctgccagccatttctgttctggcactggtagtgagtggcgtgatgtcagtgatgcagggcgcagagctggcgaatattcatagctctgtgcagcaggccgcagcgctggtgccggactatggtgcgctgatgtcctggcggatcgtgcttttggccgttgccctgtgcttgtggattgcaccacagctaaaaggttatcagcctgcggttccgctactttctgtatcattcattctgcttctggcaggggaattaatcggtcgtggcgtattctatggtttgcatatgaccgtggggatggctgtcgcaagttaa

SEQ ID NO: 2148 - protein, 287 aa, Escherichia coli
MGSGWHEWPLMIFTVFGQCVAGGFIVLALALLKGDLRAEAQQRVIACMLGLWVLMGIGFIASMLHLGSPMRAFNSLNRVGASALSNEIASGSIFFAVGGIGWLLAMLKKLSPALRTLWLVVTMVLGVVFVWMMVRVYNSIDTVPTWYSIWTPMGFFLTMFMGGPLLGYLLLSLAGVDGWAMRLLPAISVLALVVSGVMSVMQGAELANIHSSVQQAAALVPDYGALMSWRIVLLAVALCLWIAPQLKGYQPAVPLLSVSFILLLAGELIGRGVFYGLHMTVGMAVAS

SEQ ID NO: 2149 - DNA, 627 bp, Escherichia coli
atgaccaaaccgtatgttcgtcttgataaaaatgatgctgccgttttgcttgttgatcaccaggctggtttactttcccttgtacgagatatcgaacccgataagtttaaaaataacgtgctggcgctgggtgacctggctaagtatttcaacttaccaactattcttaccaccagttttgaaaccggtcctaacggcccattagttccagaactgaaagcacaattccccgatgcaccttacattgctcgcccgggaaatattaacgcctgggataacgaagattttgtaaaagctgtcaaagcgacaggtaaaaaacagttaattattgccggtgtggtaaccgaagtttgcgtggcattcccggcgctttcagccattgaagaagggtttgacgtctttgtcgtgactgacgcgtcagggacctttaatgaaattacccggcattcggcatgggatcgcatgtcgcaagctggtgcgcaattgatgacatggttcggcgtggcgtgcgagctgcatcgcgactggcgtaatgatattgaaggactggcgacgttgttctctaaccacattcctgattatcgtaacttgatgaccagttatgacacgttaacgaagcagaaataa

SEQ ID NO: 2150 - protein, 208 aa, Escherichia coli
MTKPYVRLDKNDAAVLLVDHQAGLLSLVRDIEPDKFKNNVLALGDLAKYFNLPTILTTSFETGPNGPLVPELKAQFPDAPYIARPGNINAWDNEDFVKAVKATGKKQLIIAGVVTEVCVAFPALSAIEEGFDVFVVTDASGTFNEITRHSAWDRMSQAGAQLMTWFGVACELHRDWRNDIEGLATLFSNHIPDYRNLMTSYDTLTKQK

SEQ ID NO: 2151 - DNA, 1149 bp, Escherichia coli
atgtccacgtatacccggcctgtcatgcttttgctgtctggcctgcttttgttgactctggcgattgcggtgttaaatacactcgtgccgctttggctcgcccaggaacacatgtctacatggcaggtaggcgttgtcagctcatcctattttaccggcaaccttgtcggtacattgctgacagggtatgtcattaaacgcattggctttaaccgtagctattatctggcctccttcatttttgccgctggctgtgccggccttggcctgatgattggattctggagttggttggcgtggcgttttgtcgctggcatcggctgtgccatgatttgggtggttgttgagagtgcgctgatgtgcagtgggacgtcgcgtaaccgcgggcggttgcttgctgcgtatatgatggtttattacgtcggaacgtttttaggccagttactggtcagcaaagtctcaaccgagttgatgagtgtattgccgtgggttacaggtttgacgttggcaggaatcttaccgctgttgtttacgcatgtcctgaatcagcaggctgaaaaccatgattcgacgtcaattacgtcaatgctaaaactccgtcaggcacggcttggcgtgaatggctgcattatctcaggaatcgtgctgggatctctatatggcctgatgccgctgtacctcaatcacaaaggggtgagcaatgccagcattggtttctggatggcggtactggtcagtgcgggtatcctcgggcaatggccgattggacgtctggcggataagtttggtcgactgctggtgttgcgtgttcaggtctttgtcgtcattctcggcagtattgcgatgcttagccaggcggcgatggccccagcgttattcatcctcggtgccgctggctttacgctatatccggtggcgatggcctgggcttgtgagaaagttgaacatcatcaactggtagcgatgaaccaggccttactgttgagctataccgtgggaagcctgcttggcccgtcatttaccgctatgctaatgcagaatttctccgataatttattatttatcatgatcgccagcgtatcgtttatctatttgctgatgctgcttcgcaacgccggtcatacgccgaaacccgtggctcacgtgtaa

SEQ ID NO: 2152 - protein, 382 aa, Escherichia coli
MSTYTRPVMLLLSGLLLLTLAIAVLNTLVPLWLAQEHMSTWQVGVVSSSYFTGNLVGTLLTGYVIKRIGFNRSYYLASFIFAAGCAGLGLMIGFWSWLAWRFVAGIGCAMIWVVVESALMCSGTSRNRGRLLAAYMMVYYVGTFLGQLLVSKVSTELMSVLPWVTGLTLAGILPLLFTHVLNQQAENHDSTSITSMLKLRQARLGVNGCIISGIVLGSLYGLMPLYLNHKGVSNASIGFWMAVLVSAGILGQWPIGRLADKFGRLLVLRVQVFVVILGSIAMLSQAAMAPALFILGAAGFTLYPVAMAWACEKVEHHQLVAMNQALLLSYTVGSLLGPSFTAMLMQNFSDNLLFIMIASVSFIYLLMLLRNAGHTPKPVAHV

SEQ ID NO: 2153 - DNA, 798 bp, Escherichia coli
atgagtaatttaactaattgtaatacaacagaaaataccgctacggcgggggctaccaagtcagttattggtcgcattcactcctttgaatcctgtggaaccgtagacggcccgggtattcgctttatcacctttttccagggctgcctgatgcgctgcctgtattgtcataaccgcgacacctgggatacgcatggcggtaaagaagttaccgttgaagatttgatgaaggaagtggtgacctatcgccactttatgaacgcttccggcggcggcgttaccgcatccggcggtgaggcaatcctacaagctgagtttgttcgtgactggttccgcgcctgcaaaaaagaaggcattcatacctgtctggacaccaacggttttgttcgtcgttacgatccggtgattgatgaactgctggaagtaaccgacctggtaatgctcgatctcaaacagatgaacgacgagatccaccaaaatctggttggagtttccaaccaccgcacgctggagttcgctaaatatctggcgaacaaaaatgtgaaggtgtggatccgctatgttgttgtcccaggctggtctgacgatgacgattcagcgcatcgccttggtgaatttacccgtgatatgggcaacgttgagaaaatcgagctcctcccctaccacgaactgggcaaacacaaatgggtggcaatgggtgaagaatacaaactcgatggtgttaaaccaccgaagaaagagaccatggaacgcgtgaaaggcattcttgagcagtacggtcataaggtcatgttctaa

SEQ ID NO: 2154 - protein, 265 aa, Escherichia coli
MSNLTNCNTTENTATAGATKSVIGRIHSFESCGTVDGPGIRFITFFQGCLMRCLYCHNRDTWDTHGGKEVTVEDLMKEVVTYRHFMNASGGGVTASGGEAILQAEFVRDWFRACKKEGIHTCLDTNGFVRRYDPVIDELLEVTDLVMLDLKQMNDEIHQNLVGVSNHRTLEFAKYLANKNVKVWIRYVVVPGWSDDDDSAHRLGEFTRDMGNVEKIELLPYHELGKHKWVAMGEEYKLDGVKPPKKETMERVKGILEQYGHKVMF

SEQ ID NO: 2155 - DNA, 996 bp, Escherichia coli
atgtctattaaaaagctcgatgatggtcgttatgaagtggacgtcagaccgcagggtgcagatggaaaacgtatcaggcggaaatttaaaactaaaggtgaagctcaagcattcgaacgtcatgtactggttaactaccacaacaaagagtggctggagaagccagccgaccgccgaactcttacagagttgttaggcagatggtggatatatcacggaaaatcacatgagcgtggagatattgaacgggggcgtttgacgacaataatcgccaaatttgcagaaatgggagtgtccagagctgaccagctaacaaagaaaacgataactgattatcgcgttgtaatgatgaacgatggtctaaaaccagccagcgtaaatcggcatctggcaataatgagcgggatgttcaccaagttaattgacgccggtgaataccattctcacaacccgttccgtgaggttaagcgattacgtgaagctgttacagaaatggcttttttgtccagtgaagagattacacggctgttatccatgctcgatggtgatgaattaaatgcgactctggtctgcctttctactggtggacgctggagtgaagtgtctaatttaaaagctgaacacatcattaaccagatggttacgtttatgaaaactaaaaacggaaagcgcaggacaattcccgtttcgcaggacctgattaaacggatcaagaccaaaaattcaggcaggctttttaatgccagttactacaaagtgcgcaacgctctcagggaagtaaaacccgatttacctgacggacaggcagtgcatgttttgaggcatacatttgccacacattttataatgaatggaggtaacataatcacattgcagcgcatcctgggtcattctaacattcagcaaactatgacctacgcacactttgcaccggatttcttacaagatgcagtgactcttaacccggtgtcaggaatgtccataatgcgtccataa

SEQ ID NO: 2156 - protein, 331 aa, Escherichia coli
MSIKKLDDGRYEVDVRPQGADGKRIRRKFKTKGEAQAFERHVLVNYHNKEWLEKPADRRTLTELLGRWWIYHGKSHERGDIERGRLTTIIAKFAEMGVSRADQLTKKTITDYRVVMMNDGLKPASVNRHLAIMSGMFTKLIDAGEYHSHNPFREVKRLREAVTEMAFLSSEEITRLLSMLDGDELNATLVCLSTGGRWSEVSNLKAEHIINQMVTFMKTKNGKRRTIPVSQDLIKRIKTKNSGRLFNASYYKVRNALREVKPDLPDGQAVHVLRHTFATHFIMNGGNIITLQRILGHSNIQQTMTYAHFAPDFLQDAVTLNPVSGMSIMRP

SEQ ID NO: 2157 - DNA, 357 bp, Escherichia coli
atgagtattggatcagaaatgaataacgatgttggagaaaaagtatctgatctcacaaaaagtaaaaaatgtgacatcaaacttgcagccgcaccgtcggatttgctctcgaaagagggatttgctctttacatcggtaagacgcctcgtgctgttgctgaaatggcgaaagcaggcaagttaccagccttttatatgacggacccattaaagccgggcggtcatgctgagttatggattaatcgccgtgagtgggacaagtacgcagcccaactagttgatgaagctccgacagaatggcatgactggaaaaatcgcattagttacagcaaatcaagacatggccgtgcggcttaa

SEQ ID NO: 2158 - protein, 118 aa, Escherichia coli
MSIGSEMNNDVGEKVSDLTKSKKCDIKLAAAPSDLLSKEGFALYIGKTPRAVAEMAKAGKLPAFYMTDPLKPGGHAELWINRREWDKYAAQLVDEAPTEWHDWKNRISYSKSRHGRAA

SEQ ID NO: 2159 - DNA, 501 bp, Escherichia coli
atgacagtgatgacgctcaatctcgttgaaaaacaaccagcaactatgcgccggataattggtaagcatcttgccgtccctcgctggcaggagacatgtgattattataatcagatgatggagcgcgaacggctaacggtttgcttccatgcacagttaaaacagcgtcatgcaacgatgcgttttgaagaaatgaacgacgtcgaacgtgaacggctggtttgtgcaattgatgaattgcgtggggcattctcaaaacgccgtcaggtcggtgcaagtgagtatgcatatattagctttttaactgtcagtcagcgccgtactttatttatgcacgcacgactgacagaaaaagaatttaatcagccatactggcgaattaatgaagagtcatgttactggcgtgatgctttattccgtgcattacgtgaattattcagtctgtttgaatatgcaccgacaattctgacgtcggtaaaaccagagcaatatctgcattaa

SEQ ID NO: 2160 - protein, 166 aa, Escherichia coli
MTVMTLNLVEKQPATMRRIIGKHLAVPRWQETCDYYNQMMERERLTVCFHAQLKQRHATMRFEEMNDVERERLVCAIDELRGAFSKRRQVGASEYAYISFLTVSQRRTLFMHARLTEKEFNQPYWRINEESCYWRDALFRALRELFSLFEYAPTILTSVKPEQYLH

SEQ ID NO: 2161 - DNA, 213 bp, Escherichia coli
atgcatacagtttctgaaaatcagtgcggtaaatacgcattaatgctgcaacaggccagaaccgaagcacaggccgatgcagcaacgcgcttttcttctcatcttgatgccatgattcgccacatcacaaaggcggagttatcccgcgtggagatagtcgagttgctcagtcaggagtctgccaaattccataatctaggactcaataaataa

SEQ ID NO: 2162 - protein, 70 aa, Escherichia coli
MHTVSENQCGKYALMLQQARTEAQADAATRFSSHLDAMIRHITKAELSRVEIVELLSQESAKFHNLGLNK

SEQ ID NO: 2163 - DNA, 396 bp, Escherichia coli
gtgattgtctgcgctgaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataa

SEQ ID NO: 2164 - protein, 131 aa, Escherichia coli
MIVCAEMDEQWGYVGAKSRQRWLFYAYDSLRKTVVAHVFGERTMATLGRLMSLLSPFDVVIWMTDGWPLYESRLKGKLHVISKRYTQRIERHNLNLRQHLARLGRKSLSFSKSVELHDKVIGHYLNIKHYQ

SEQ ID NO: 2165 - DNA, 276 bp, Escherichia coli
gtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggtaactgcccgcattatgggcgttggcctcaacacgattttacgtcacttaaaaaactcaggccgcagtcggtaa

SEQ ID NO: 2166 - protein, 91 aa, Escherichia coli
MASVSISCPSCSATDGVVRNGKSTAGHQRYLCSHCRKTWQLQFTYTASQPGTHQKIIDMAMNGVGCRVTARIMGVGLNTILRHLKNSGRSR

SEQ ID NO: 2167 - DNA, 291 bp, Escherichia coli
atgaaaaatatattgcttaataactggctgaagatttcagtcatgaaaaatggtgatttgtcgctagctgatattaaacgcgataaaaacactggggatatggtggaatcaactatagccatttatgcggataaattaaatctcctgtctgatgtggtcaatttacttgttaaacgcgctgtatttcataagcaaatttcatccgtggatgaactgacaaaattaacgacagaaatcgccagctattgcgctgatgaatttaagaagctgaacgacaaaaggagctggtaa

SEQ ID NO: 2168 - protein, 96 aa, Escherichia coli
MKNILLNNWLKISVMKNGDLSLADIKRDKNTGDMVESTIAIYADKLNLLSDVVNLLVKRAVFHKQISSVDELTKLTTEIASYCADEFKKLNDKRSW

SEQ ID NO: 2169 - DNA, 225 bp, Escherichia coli
atgccggacaacgtagattttattcaggaacaacaggctgaattactggagcgccagattaacgcggcaagggtaaaacattgcggtgtttctgcgctggtttgcgaagagtgtgacgtgccaatacctgctgcccgtcgtgcggcttatccgtcagccacgcgttgtgtttcctgtcagtcagtctttgaagcaaaaaacaaacattaccggagaacggcatga

SEQ ID NO: 2170 - protein, 74 aa, Escherichia coli
MPDNVDFIQEQQAELLERQINAARVKHCGVSALVCEECDVPIPAARRAAYPSATRCVSCQSVFEAKNKHYRRTA

SEQ ID NO: 2171 - DNA, 276 bp, Escherichia coli
atgagtattcgtattgaaattggcgaacgttatgtcgttaccagtgacagctttcagtttattctccacgagaaaaagagagcggaaagcggtaaaaacgccggtcaggaatggctgtcggtggttggttattacccgaaattaagccagctcgtttccggcatgatgcatcacgatattctgaccggaagcgcaaagtcttttgctgatttaaacgcgcaggttgagcaactcagcaagcgttgttcagaggcttttggctcatatggccgttaa

SEQ ID NO: 2172 - protein, 91 aa, Escherichia coli
MSIRIEIGERYVVTSDSFQFILHEKKRAESGKNAGQEWLSVVGYYPKLSQLVSGMMHHDILTGSAKSFADLNAQVEQLSKRCSEAFGSYGR

SEQ ID NO: 2173 - DNA, 2295 bp, Escherichia coli
ttggctcatatggccgttaaagcctccgggcgttttgtccctccatcagcatttgccgcaggcaccggtaaggcgtttaccggtgcttatgcatggaacgcgccacgcgaggctgtcgggcgcgaaagaccccttacacgtgacgagatgcgtcaggtgcaaggtgttttatccacgattaaccgcctgccttactttttgcgctcgctgtttacttcacgctatgactacatccggcgcaataaaagcccggtgcacgggttttatttcctcacatccacttttcagcgtcgtttatggccgcgcattgagcgcgtgaatcagcgccatgaaatgaacaccgacgcgtcgttactgtttctggcagagcgtgaccattatgcgcgtctgccggggatgaatgacaaggaactgaaaaagtttgccgcccgtatctcatcgcagcttttcatgatgtatgaggaactctgcgatgcatgggttgatgcacatggcgagaaagaatcgctgtttacggatgaggctcaggcgcatctgtatggtcatgttgctggcgctgcacgagctttcaatatttcccctctctactggaaaaaataccgtaaaggacagatgaccacgaggcaggcatattctgccattgcccgtctgtttaacgatgagtggtggactcatcagcttaaaggtcagcgtatgcgctggcatgaggcgttactgattgctgtcggggaggtgaataaagaccgttctccttatgccagtaaacatgccattcgtgatgtgcgtgcgcgccgccaggcaaatctggaatttcttaaatcgtgtgaccttgaaaacagggaaaccggcgagcgcatcgaccttatcagtaaggtgatgggaagtatttctaatcctgaaattcgccggatggagctgatgaacaccattgccggtattgagcgttacgccgccgcagagggtgatgtggggatgtttatcacgctgaccgcgccgtcaaagtatcacccgacacgtcaggtcggaaaaggcgaaagtaaaaccgtccagctaaatcacggctggaacgatgaggcatttaatccaaaggatgcgcagcgttatctctgccgcatctggagcctgatgcgcacggcattcaaggataatgatttacaggtctacggtttgcgtgtcgtcgagccacaccacgacggaacgccgcactggcatatgatgcttttttgtaatccacgtcagcgtaaccagattatcgaaaccatgcgtcgctacgcgctcaaagaggatggcgacgaaagaggagccgagcgaaaccgttttcaggcgaaacaccttaaccggggcggtgctgcggggtatatcgcgaaatacatttcaaaaaatatcgacggctatgcactggatggtcagctcgataacgataccggcagacctctgaaagatactgccgcggctgttactgcatgggcgtcaacgtggcgcatcccgcaatttaaaacggttggtctgccgacaatgggggcttaccgtgaactacgcaaattgcctcgtggcgtcagcattgctgatgagtttgacgaacgcgtcgaggctgcacgcgccgccgcagacagtggtgattttgcgttgtatatcagcgcgcagggtggggcaaatgttccgcgcgattgtcagactgtcagggttgcccgtagcccgtcggatgacgttaacgagtacgaggaagaagtcgagagagtggtcggcatttacgcgccgcatctcggcgcgcgtcatattcatatcaccagaacgacggactggcgcattgtgccgaaagtgccggtcgttgagcctttgactttaaaaagcggcatcgccgcgcctcggagtcctgtcaataactgtggaaagctcaccggtggtgatacttcgttaccggctcccacaccttctgaacacgccgcagcagtgctaaatctggttgatgacggtgttatcgaatggaacgacacggaggtcgtgagggcgctcaggggggcattaaaacacgacctgagaacaccaaatcgtcagcaaagaaacggaagcccgttaaaaccacatgaaattgcaccatcggccagactgacccgatcggaaagaatgcaaattacccgtatccgcgttgaccttgctcagaacggtatcaggccgcagcgatgggagcttgaggcgctggcgcgtggcgcgaccgtaaattatgacgggaaaaaattcacgtatccggtcgctgatgagtggccgggattctcaacagtaatggagtggacataa

SEQ ID NO: 2174 - protein, 764 aa, Escherichia coli
MAHMAVKASGRFVPPSAFAAGTGKAFTGAYAWNAPREAVGRERPLTRDEMRQVQGVLSTINRLPYFLRSLFTSRYDYIRRNKSPVHGFYFLTSTFQRRLWPRIERVNQRHEMNTDASLLFLAERDHYARLPGMNDKELKKFAARISSQLFMMYEELCDAWVDAHGEKESLFTDEAQAHLYGHVAGAARAFNISPLYWKKYRKGQMTTRQAYSAIARLFNDEWWTHQLKGQRMRWHEALLIAVGEVNKDRSPYASKHAIRDVRARRQANLEFLKSCDLENRETGERIDLISKVMGSISNPEIRRMELMNTIAGIERYAAAEGDVGMFITLTAPSKYHPTRQVGKGESKTVQLNHGWNDEAFNPKDAQRYLCRIWSLMRTAFKDNDLQVYGLRVVEPHHDGTPHWHMMLFCNPRQRNQIIETMRRYALKEDGDERGAERNRFQAKHLNRGGAAGYIAKYISKNIDGYALDGQLDNDTGRPLKDTAAAVTAWASTWRIPQFKTVGLPTMGAYRELRKLPRGVSIADEFDERVEAARAAADSGDFALYISAQGGANVPRDCQTVRVARSPSDDVNEYEEEVERVVGIYAPHLGARHIHITRTTDWRIVPKVPVVEPLTLKSGIAAPRSPVNNCGKLTGGDTSLPAPTPSEHAAAVLNLVDDGVIEWNDTEVVRALRGALKHDLRTPNRQQRNGSPLKPHEIAPSARLTRSERMQITRIRVDLAQNGIRPQRWELEALARGATVNYDGKKFTYPVADEWPGFSTVMEWT

SEQ ID NO: 2175 - DNA, 453 bp, Escherichia coli
atggcaaaaattcacgaggtaaagctgcacgcgaaatatttcgaccttgtgctggaaggaaagaaacgtgcagagttccggaaaaatgaccgtaattatgagcgcggggacacgttgattttgcatgaatgggtgcagggtgtgtatacggggcgaaaggttgaagcccggataacagatgttactgacctgtcagactggctggaagattatgtcttgctaagtattgagcggcttaatacaggcgcatgtgagattgtgaactggaaagaacttagtgagcgtggtctggtattcagaattaatcatgaaattatgcatcagctcggccttgctgttatgtatgaaccagagacggggatgtctggcggggcaatggttgccacggatggagcatggaactattcagatgaacagatggagcgtgcacagcaaaacgggtggcttggataa

SEQ ID NO: 2176 - protein, 150 aa, Escherichia coli
MAKIHEVKLHAKYFDLVLEGKKRAEFRKNDRNYERGDTLILHEWVQGVYTGRKVEARITDVTDLSDWLEDYVLLSIERLNTGACEIVNWKELSERGLVFRINHEIMHQLGLAVMYEPETGMSGGAMVATDGAWNYSDEQMERAQQNGWLG

SEQ ID NO: 2177 - DNA, 600 bp, Escherichia coli
ttgagcataattggttcaatactctatccaacagaaaaaagccagccagttgctaaaactgaaacatcaaccgttgcagaacacaaagtccaaaaaacattcgaatatggtgaaaaaacactcaaggaatatcggaacgagtcaaagaaaacacgacacgatattgtgaatagttacattgattttaaggaagttccagccaccgcgtcagatgcgttttatgcctgcatgagtgagtatacatttaccaaagatgatgagttgaaactcggtgatgttcttgggtggtgctttaatgattatgaaaatgacccgaattcactaaacaataaaatcaatcttgatacatttcagagtaattttagtggttgggatggttcttatcgtccattggaaaaactaattaaagataatatgaacgatgattcatcttataaacatgtgtcaacggtatatcatctggttttgaataaagacccgcatgccattgtgaaaaccacgtttcgcggaactaatgcttatggaggagtggtgaaacagacgattgctgcgcgtgttgatataaaaactggtaaggtgatatcaatcatagataattga

SEQ ID NO: 2178 - protein, 199 aa, Escherichia coli
MSIIGSILYPTEKSQPVAKTETSTVAEHKVQKTFEYGEKTLKEYRNESKKTRHDIVNSYIDFKEVPATASDAFYACMSEYTFTKDDELKLGDVLGWCFNDYENDPNSLNNKINLDTFQSNFSGWDGSYRPLEKLIKDNMNDDSSYKHVSTVYHLVLNKDPHAIVKTTFRGTNAYGGVVKQTIAARVDIKTGKVISIIDN

SEQ ID NO: 2179 - DNA, 783 bp, Escherichia coli
atgaaagttataaaccaacttaagaagtttgataagaaaagaacgccagatgatggccgtattagtttgttatatgaaaacgcgattaagtatgatatgtactctgtatatattaaagataaaaatgatacagaatacctctttgactgtttggttgatgggaagataaaggcttttaaatgggatgatgaggaacgtagatttcatataagttcatacttggatatttctgagcttacgcctgattctttttttggtatttattactaccgtgcgcatgagttgcgatttaactctttaaatgatttaacctttttaagggagttgttttttagagtgaagtctaattatgaaaatataaagtttagtcgtgaaaaatatatttatcgacagcaaaaaaaagaaataactgatgtgatgcttgttctctcaacgattataagaatgtatcgtgaacgggatgctgaaactgtgtttagtgagttttcaataatgaccgaagtcgctggtagtttatgggtataccatgacgataaaaacaggatgcgtaaagagcttcgtttatgcctgaattctcttgttcagaatggagatcttgttgaaacaagtagtggatttaggctaacaggaaaggcactgaacacaatatctacattcaataaagatgagttgcggtacagagagaatttgagcactcagaagaaaatgttttgggctacttttttcgcagcagtcggcggcgtaggaagtatgattgcagctataatagggcttctaaaatga

SEQ ID NO: 2180 - protein, 260 aa, Escherichia coli
MKVINQLKKFDKKRTPDDGRISLLYENAIKYDMYSVYIKDKNDTEYLFDCLVDGKIKAFKWDDEERRFHISSYLDISELTPDSFFGIYYYRAHELRFNSLNDLTFLRELFFRVKSNYENIKFSREKYIYRQQKKEITDVMLVLSTIIRMYRERDAETVFSEFSIMTEVAGSLWVYHDDKNRMRKELRLCLNSLVQNGDLVETSSGFRLTGKALNTISTFNKDELRYRENLSTQKKMFWATFFAAVGGVGSMIAAIIGLLK

SEQ ID NO: 2181 - DNA, 162 bp, Escherichia coli
atgaagcgggcgggcgaggcggggaaagcactgcgcgctggcggtggtgctgattttattttttcagcgtctcagcgcgtcgtgatggcatttagtcggcctgctggggcgttggtgtgtctgcggggtgttttgtgcggtggtgagcgtgtgagggcgtga

SEQ ID NO: 2182 - protein, 53 aa, Escherichia coli
MKRAGEAGKALRAGGGADFIFSASQRVVMAFSRPAGALVCLRGVLCGGERVRA

SEQ ID NO: 2183 - DNA, 1035 bp, Escherichia coli
atgagcaagaaaaaagggaaaacactgcaacctgcggcaaaaaaaatgaccgccagcgccccgaaaatggaggcattcacctttggcgaaccggtgccggtactcgaccgccgtgacattctggattacgtcgaatgcatcagtaacggcagatggtatgagccaccggtcagctttaccggtctggcaaaaagtctgcgtgctgccgtgcatcacagctcaccgatttacgtcaaacgtaatattctggcttcaacgtttatcccgcacccgtggctttcccagcaggatttcagccgctttgtgctggattttctggttttcggtaatgcgtttctggaaaagcgttacagcaccaccggtaaggtcatcagactggaaacctcaccggcaaaatatacccgccgtggcgtggaggaggatgtttactggtgggtgccgtccttcaacgagccgacagccttcgcgcccggttccgtgtttcacctgctggagcccgatattaatcaggagctgtacggcctgccggaatatctcagcgcccttaactctgcctggctgaatgagtcagccacgctgttccgccgcaagtattacgaaaacggcgcacatgccggatacatcatgtacgtcaccgatgccgtgcaggaccgcaacgatatcgaaatgcttcgcgaaaacatggtgaagtcgaaaggccgcaacaactttaaaaacctgtttctctatgccccgcaggggaaagccgacggcattaaaattatcccgctcagtgaagtggcgacgaaggacgatttttttaatatcaaaaaagccagcgccgctgacctgctggacgcgcaccgcatcccctttcagttgatgggcggcaagccggagaacgtcgggtcgctgggtgatattgagaaagtggcaaaggtctttgtccgcaatgagcttatcccgctacaggacaggatccgcgagataaacggctggctcggtcaggaggtcatccgctttaaaaactactcactggacactgacaacggctga

SEQ ID NO: 2184 - protein, 344 aa, Escherichia coli
MSKKKGKTLQPAAKKMTASAPKMEAFTFGEPVPVLDRRDILDYVECISNGRWYEPPVSFTGLAKSLRAAVHHSSPIYVKRNILASTFIPHPWLSQQDFSRFVLDFLVFGNAFLEKRYSTTGKVIRLETSPAKYTRRGVEEDVYWWVPSFNEPTAFAPGSVFHLLEPDINQELYGLPEYLSALNSAWLNESATLFRRKYYENGAHAGYIMYVTDAVQDRNDIEMLRENMVKSKGRNNFKNLFLYAPQGKADGIKIIPLSEVATKDDFFNIKKASAADLLDAHRIPFQLMGGKPENVGSLGDIEKVAKVFVRNELIPLQDRIREINGWLGQEVIRFKNYSLDTDNG

SEQ ID NO: 2185 - DNA, 1773 bp, Escherichia coli
atgaccatcaccacagacaccactcttttacacgacccgcgtcgtcaggcggcgctgctgtactggcagggattttccgtgccgcagattgccgccatgttgcagatgaaacgcccgacagtgcagagctggaaacagcgcgacggctgggacaacgttgcccccatcagccgtgtcgaaatgagcctggaagcgcggctgacccagctcattatcaaaccgcagaaaaccggcggtgacttcaaggaaattgacctgctgggacgccagattgaacgactggcacgggtaaatcgttacagccagaccggcaacgaggcagaccttaatccgaacgtcgctaaccgcaacaaaggcgggcggcgcaaaccgaaaaaaaattttttcagtgacgaggccatcgaaaagctggagcagattttctttgagcagtctttcgactatcagttgcactggtatcgcgccgggcttgagcaccgcatccgcgatatcctgaaatcccgccagattggtgcgacgttttatttttcccgcgaggcgctgctgcgcgccctgaaaaccggccataaccagatttttctgtcggccagtaaaacgcaggcgtatgtgttccgcgaatacatcatcgcctttgcccggctggttgacgttgacctgaccggtgacccgattgtcctgggcaataacggcgcaaaactgatttttctcggcaccaactccaacaccgcacagagccataacggcgacctgtacgtcgacgagattttctggatcccgaattttcaggtactgcgtaaggtggcatcaggtatggcctcacagagtcacctgcgctcgacctatttctccaccccgtccacgctggcgcacgacgcctacccgttctggtcaggtgaactgttcaaccggggacgcgccagcgccgccgaacgcgtggaaatcgacgtcagtcataacgcccttgccggtgggcttctctgtgcggacggccagtggcggcagattgtcaccattgaggacgccctgaaaggtggctgcacgctgttcgacattgaacagctcaaacgcgaaaacagcgccgacgattttaaaaacctgttcatgtgtgaatttgttgacgacaaggcgtcggtgttcccgttcgaggagctgcaacgctgcatggtcgacacgctggaagaatgggaagactatgcgccgtttgccgccaatccgttcggctcccgcccggtctggattggttacgacccgtcacaccgtggcgacagcgccggatgcgtggtactggcaccgccggtggtggccggtggcaaattcagaatacttgagcgtcaccagtggaaaggcatggactttgccacccaggcggaatccatccgcaaactcaccgaaaaatacaacgtcgaatacatcggtattgatgccaccggcctcggtgtcggcgtgttccagctcgtgcgctcgttctatcccgccgcgcgcgatatccgctacacgccggaaatgaaaaccgcaatggtgctcaaggcaaaagacgtcatccgccgtggctgtctggaatatgacgtcagcgccaccgacatcaccagctcgtttatggctatccgcaagaccatgaccagcagcggacgcagcgccacttatgaggccagccgcagcgaggaagccagccacgccgacctcgcctgggcgaccatgcacgccctgttaaatgagccactcaccgccggtatcagcaccccgctgacatccaccattctggagttttactga

SEQ ID NO: 2186 - protein, 590 aa, Escherichia coli
MTITTDTTLLHDPRRQAALLYWQGFSVPQIAAMLQMKRPTVQSWKQRDGWDNVAPISRVEMSLEARLTQLIIKPQKTGGDFKEIDLLGRQIERLARVNRYSQTGNEADLNPNVANRNKGGRRKPKKNFFSDEAIEKLEQIFFEQSFDYQLHWYRAGLEHRIRDILKSRQIGATFYFSREALLRALKTGHNQIFLSASKTQAYVFREYIIAFARLVDVDLTGDPIVLGNNGAKLIFLGTNSNTAQSHNGDLYVDEIFWIPNFQVLRKVASGMASQSHLRSTYFSTPSTLAHDAYPFWSGELFNRGRASAAERVEIDVSHNALAGGLLCADGQWRQIVTIEDALKGGCTLFDIEQLKRENSADDFKNLFMCEFVDDKASVFPFEELQRCMVDTLEEWEDYAPFAANPFGSRPVWIGYDPSHRGDSAGCVVLAPPVVAGGKFRILERHQWKGMDFATQAESIRKLTEKYNVEYIGIDATGLGVGVFQLVRSFYPAARDIRYTPEMKTAMVLKAKDVIRRGCLEYDVSATDITSSFMAIRKTMTSSGRSATYEASRSEEASHADLAWATMHALLNEPLTAGISTPLTSTILEFY

SEQ ID NO: 2187 - DNA, 570 bp, Escherichia coli
atgcgcatcgtcgggaaactgatgccgacatgtgactcctctaatcactattcaggactcctgacaatggcaaaaaaagtctcaaaattctttcgtatcggcgttgagggtgacacctgtgacgggcgtgtcatcagtgcgcaggatattcaggaaatggctgaaacctttgacccgcgtgtctacggttgccgcattaacctggaacatctgcgcggcatcctgcctgacggtatttttaaacgttatggcgatgtggccgaacttaaggccgaaaagattgacgatgattcggcgctgaaaggcaaatgggcgctgtttgcgaaaatcaccccgaccgatgaccttatcgcgatgaacaaggccgcgcagaaggtctacacctcaatggaaattcagccgaactttgccaacaccggcaaatgttatctggtgggtctggccgtcaccgatgacccggcaagcctcggcacggaatacctggaattctgccgcacggcaaaacacaaccccctgaaccgcttcaaattaagccctgaaaacctgatttcagtggcaacgcctgtttga

SEQ ID NO: 2188 - protein, 189 aa, Escherichia coli
MRIVGKLMPTCDSSNHYSGLLTMAKKVSKFFRIGVEGDTCDGRVISAQDIQEMAETFDPRVYGCRINLEHLRGILPDGIFKRYGDVAELKAEKIDDDSALKGKWALFAKITPTDDLIAMNKAAQKVYTSMEIQPNFANTGKCYLVGLAVTDDPASLGTEYLEFCRTAKHNPLNRFKLSPENLISVATPV

SEQ ID NO: 2189 - DNA, 357 bp, Escherichia coli
ttgagctggaatttgaagacctgcctgaaacagtgttcaccgcccctgaccgaaaaggtgaagtccatttttggccgcaaacaggccagcgatgatgcccgtctgaatgacgtgcatgaagcggtgaccgctgttgctgaacatgtgcaggaaaaactgagcgccactgagcagcgcctcgctgagatggaaaccgccttttccgcacttaagcaggaggtgactgacagggcggatgaaaccagccaggcattcacccgcctgaaaaacagtctcgaccacaccgaaagtctgacccagcagcgccgcagcaaggccactggtggtggcggtgacgccctgatgacgaactgctga

SEQ ID NO: 2190 - protein, 118 aa, Escherichia coli
MSWNLKTCLKQCSPPLTEKVKSIFGRKQASDDARLNDVHEAVTAVAEHVQEKLSATEQRLAEMETAFSALKQEVTDRADETSQAFTRLKNSLDHTESLTQQRRSKATGGGGDALMTNC

SEQ ID NO: 2191 - DNA, 1074 bp, Escherichia coli
atgcgccaggaaacccgctttaaatttaatgcttacctgtcccgtgttgccgaactgaacggcatcgacgccggtgatgtgtcgaaaaaattcaccgttgaaccgtcggtcacccagaccctgatgaacaccatgcaggagtcctctgactttctgacccgcatcaatattgtgccggtcagcgaaatgaaaggggaaaaaattggcatcggtgtcaccggctccatcgccagcaccaccgacaccgccggtggcaccgagcgtcagccgaaggacttctcgaagctggcgtcaaacaagtacgaatgcgaccagattaacttcgatttttatatccgctacaaaacgctggacctgtgggcgcgttatcaggatttccagctccgtatccgtaacgccattatcaagcgtcagtcccttgatttcatcatggccggttttaacggcgtgaagcgtgccgaaaactctgaccgcagcagtaatccgatgctgcaggatgtggcggtcggctggctgcagaaataccgcaatgaagccccggcgcgcgtgatgagcaaggtcactgacgaggaaggtcacacgacctctgaggtcatccgcgtgggtaagggcggtgattatgccagccttgatgcactggtgatggatgcgaccaacaacctgattgaaccgtggtatcaggaagaccctgaccttgtggtgattgtgggtcgtcagctactggcggacaagtatttccccatcgttaacaaggagcaggacaacagcgaaatgctggccgctgacgtcatcatcagccagaaacgcatcggtaacctgccggcggtacgcgtcccgtacttcccggcggatgcgatgctcatcacgaagctggaaaacctgtccatctactacatggatgacagccatcgccgcgtgattgtggaaaacccgaaactcgaccgcgtggagaactacgagtcaatgaacattgattacgtggtggaagactacgccgccggttgtctggtggaaaaaattaaggtcggtgatttctccacaccggctaaggcgaccgcagagccgggagcgtaa

SEQ ID NO: 2192 - protein, 357 aa, Escherichia coli
MRQETRFKFNAYLSRVAELNGIDAGDVSKKFTVEPSVTQTLMNTMQESSDFLTRINIVPVSEMKGEKIGIGVTGSIASTTDTAGGTERQPKDFSKLASNKYECDQINFDFYIRYKTLDLWARYQDFQLRIRNAIIKRQSLDFIMAGFNGVKRAENSDRSSNPMLQDVAVGWLQKYRNEAPARVMSKVTDEEGHTTSEVIRVGKGGDYASLDALVMDATNNLIEPWYQEDPDLVVIVGRQLLADKYFPIVNKEQDNSEMLAADVIISQKRIGNLPAVRVPYFPADAMLITKLENLSIYYMDDSHRRVIVENPKLDRVENYESMNIDYVVEDYAAGCLVEKIKVGDFSTPAKATAEPGA

SEQ ID NO: 2193 - DNA, 744 bp, Escherichia coli
atgacgagtcccgcacagcgccacatgatgcgggtctcggcagcgatgaccacgcagcgggaagccgccccgctgcgacatgcaactgtctatgagcagatgctggtcaagctggccgcagaccagcgcacactgaaagcgatttattcaaaagagctgaaggccgcgaaaaagcgcgaactgctgccgttctggttgccgtgggtgaacggcgtgctggagcagggcaaaggcgcacaggatgacattctgatgacggtcatgctgtggcgtctggataccggcgatattgccggtgcgctggagattgcccgttatgccctgaaatacggtctgaccatgccgggtaaacaccgccgcaccccgccgtatatgttcaccgaggaggtcgcgctcgcggccatgcgcgcccacgcggccggtgagtctgtggatacccgcctgctgacggagacccttgaactgactgccgctgctgacatgcctgatgaagtgcgcgcaaagctgcacaaaatcaccggtctgtttctgcgtgacggtggtgatgccgccggtgcgctggctcacctgcaacgtgcgacacagctcgactgtcaggcaggcgtcaaaaaagagattgagcgactggagcgggagctgaaacctaagccggagccgcaacccaaagcggccacccgtgccacgcgtaagacccggagcgtgacaccggcaaaacgtggacgcccgaaaaagaaagccagttaa

SEQ ID NO: 2194 - protein, 247 aa, Escherichia coli
MTSPAQRHMMRVSAAMTTQREAAPLRHATVYEQMLVKLAADQRTLKAIYSKELKAAKKRELLPFWLPWVNGVLEQGKGAQDDILMTVMLWRLDTGDIAGALEIARYALKYGLTMPGKHRRTPPYMFTEEVALAAMRAHAAGESVDTRLLTETLELTAAADMPDEVRAKLHKITGLFLRDGGDAAGALAHLQRATQLDCQAGVKKEIERLERELKPKPEPQPKAATRATRKTRSVTPAKRGRPKKKAS

SEQ ID NO: 2195 - DNA, 474 bp, Escherichia coli
gtgtccggtgagggtacggtggtcatcccgcaaccggcaggcgacgagccggtgattaaaaacacgttcttttttcccgatatcgacccgaagcgcgtccgggaacgtatgcgccttgagcagaccgtcgcccccgcccgtctgcgtgaggccatcaagtcaggcatggcggaaacaaatgcggagctgtacgagtaccgcgaacagaaaattgccgccggttttacgcgtctggcggacgttccggcggacgacatcgacggtgaaagtatcaaagttttttactacgagcgcgccgtgtgtgcgatggcgaccgcgtcgctttatgagcgttatcgcggtgtggatgccagtgcgaaaggcgacaagaaggtcgacagcattgacagcaccattgatgagctgtggcgggatatgcgctgggcagtggcgcgcatccaggacaagccgcgctgcatcgtgagtcaaatctga

SEQ ID NO: 2196 - protein, 157 aa, Escherichia coli
MSGEGTVVIPQPAGDEPVIKNTFFFPDIDPKRVRERMRLEQTVAPARLREAIKSGMAETNAELYEYREQKIAAGFTRLADVPADDIDGESIKVFYYERAVCAMATASLYERYRGVDASAKGDKKVDSIDSTIDELWRDMRWAVARIQDKPRCIVSQI

SEQ ID NO: 2197 - DNA, 273 bp, Escherichia coli
gtggcgggatatgcgctgggcagtggcgcgcatccaggacaagccgcgctgcatcgtgagtcaaatctgatgaagacctttgcgctacagggcgacacgctcgatgccatctgtgtccggtattacgggcgcactgagggcgtggttgagaccgtgctcgccgcaaatccgggactggctgaactgggggcggtgctgccacatggcaccgccgtcgaactgcccgacgttcagaccgcgcccgtggctgaaactgtcaatctgtgggagtaa

SEQ ID NO: 2198 - protein, 90 aa, Escherichia coli
MAGYALGSGAHPGQAALHRESNLMKTFALQGDTLDAICVRYYGRTEGVVETVLAANPGLAELGAVLPHGTAVELPDVQTAPVAETVNLWE

SEQ ID NO: 2199 - DNA, 282 bp, Escherichia coli
atgacagcagaagaaaaaagcgtcctgtcgcttttcatgattggggtgctgattgttgtcggcaaggtgcttgccggtggtgaacccatcaccccgcgtctgtttatcgggcgcatgttgctcggtggttttgtctcgatggttgccggtgttgttctggtgcagtttcctgacctgtcactgcctgcggtgtgcggtatcggctccatgctgggtatcgccggttatcaggtgattgagattgccattcagcgccgctttaagggcagggggaaaccgtaa

SEQ ID NO: 2200 - protein, 93 aa, Escherichia coli
MTAEEKSVLSLFMIGVLIVVGKVLAGGEPITPRLFIGRMLLGGFVSMVAGVVLVQFPDLSLPAVCGIGSMLGIAGYQVIEIAIQRRFKGRGKP

SEQ ID NO: 2201 - DNA, 498 bp, Escherichia coli
atgccggtaattaacacgcatcagaatatcgccgcctttctcgacatgctggccgtgtccgaagggacggcgaaccatccgctgacgaaaaaccggggctatgacgtgatagtcaccggactggacgggaagccggaaatcttcactgactacagtgaccacccgttcgcacatgaccgaccggcgaaggtgtttaaccatcgcggtgaaaaatccacggcctccggtcgctatcagcagctttacctgttctggccgcattaccgcaaacagcttgccctgcctgatttcagtccgttgtcacaggacagactcgccattcagttgatccgcgaacgcggtgcactggatgacatccgggcgggacgcattgagcgcgccatttcacgctgtcgcaatatctgggcgtccctgccgggtgccggttacggtcagcgtgagcattcactggaaaaactggtcaccgtctggcgtaccgctggcggcgtaccggcttaa

SEQ ID NO: 2202 - protein, 165 aa, Escherichia coli
MPVINTHQNIAAFLDMLAVSEGTANHPLTKNRGYDVIVTGLDGKPEIFTDYSDHPFAHDRPAKVFNHRGEKSTASGRYQQLYLFWPHYRKQLALPDFSPLSQDRLAIQLIRERGALDDIRAGRIERAISRCRNIWASLPGAGYGQREHSLEKLVTVWRTAGGVPA

SEQ ID NO: 2203 - DNA, 543 bp, Escherichia coli
ttgagcgcgccatttcacgctgtcgcaatatctgggcgtccctgccgggtgccggttacggtcagcgtgagcattcactggaaaaactggtcaccgtctggcgtaccgctggcggcgtaccggcttaaacggagtaaacaccatgaagaaattatccctttcactgatgctgaacgtgtcgctggcgctgatgctggcactgtccctgatttatccgcagagcgtggccgtcagttttgtcgccgcccgggcgattctggcgacggttatctgtgtggttgccggtggtgtcggcgtgtatgccacagagtatgtactggaacgctacgggcgggagctgccgccggaatcgctggccgtgaagattgtcacgtcgctgtttttgcagccggtgccgtggcgcagacggtcggcggctctggtagtgatggtggcgacgtttatctcgctggttgccgccgggtggatttttaccgcgctgatttacctcgtggtgtcggtgttcttccggctgatacgtacggcctgccgtcagcgttttga

SEQ ID NO: 2204 - protein, 180 aa, Escherichia coli
MSAPFHAVAISGRPCRVPVTVSVSIHWKNWSPSGVPLAAYRLKRSKHHEEIIPFTDAERVAGADAGTVPDLSAERGRQFCRRPGDSGDGYLCGCRWCRRVCHRVCTGTLRAGAAAGIAGREDCHVAVFAAGAVAQTVGGSGSDGGDVYLAGCRRVDFYRADLPRGVGVLPADTYGLPSAF

SEQ ID NO: 2205 - DNA, 426 bp, Escherichia coli
atgaagaaattatccctttcactgatgctgaacgtgtcgctggcgctgatgctggcactgtccctgatttatccgcagagcgtggccgtcagttttgtcgccgcccgggcgattctggcgacggttatctgtgtggttgccggtggtgtcggcgtgtatgccacagagtatgtactggaacgctacgggcgggagctgccgccggaatcgctggccgtgaagattgtcacgtcgctgtttttgcagccggtgccgtggcgcagacggtcggcggctctggtagtgatggtggcgacgtttatctcgctggttgccgccgggtggatttttaccgcgctgatttacctcgtggtgtcggtgttcttccggctgatacgtacggcctgccgtcagcgttttgaggggcgggaaccatgtcaaggctga

SEQ ID NO: 2206 - protein, 141 aa, Escherichia coli
MKKLSLSLMLNVSLALMLALSLIYPQSVAVSFVAARAILATVICVVAGGVGVYATEYVLERYGRELPPESLAVKIVTSLFLQPVPWRRRSAALVVMVATFISLVAAGWIFTALIYLVVSVFFRLIRTACRQRFEGREPCQG

SEQ ID NO: 2207 - DNA, 426 bp, Escherichia coli
atgtcaaggctgatgattgtgctggttgtgttgttatcactggcggtggctggtctgtttatggtgaaacacaaaaatgccagcctgcgcgcctcgctggacagggcgaacaacgtcgccagcgggcagcagacgaccatcaccatgctgaaaaatcagcttcatgttgccctcaccagagcagacaaaaacgagctggcgcaggtggtactgcgtcaggaactggagaacgccgcgaagcgtgaagcacagcgcgagaaaaccatcacgaggttacttaatgaaaacgaagattttcgccgctggtacggcgctgacctgcctgatgctgtgcgccggttgcaccagcgccccgcctgcactgacgccagtgattgtccacaacgcctgcccgaaagtgagtctttgcccgatgccgggcagtga

SEQ ID NO: 2208 - protein, 141 aa, Escherichia coli
MSRLMIVLVVLLSLAVAGLFMVKHKNASLRASLDRANNVASGQQTTITMLKNQLHVALTRADKNELAQVVLRQELENAAKREAQREKTITRLLNENEDFRRWYGADLPDAVRRLHQRPACTDASDCPQRLPESESLPDAGQ

SEQ ID NO: 2209 - DNA, 174 bp, Escherichia coli
gtgagtctttgcccgatgccgggcagtgacccggagacgaacggcgatttaagtgctgatatccggcagcttgagaacgcgctggcacgctgtgccagccaggtaaaaatgattaaacactgtcaggacgaaaacgatgctcaaacccgacagcctgcgcagggcgctgactga

SEQ ID NO: 2210 - protein, 57 aa, Escherichia coli
MSLCPMPGSDPETNGDLSADIRQLENALARCASQVKMIKHCQDENDAQTRQPAQGAD

SEQ ID NO: 2211 - DNA, 420 bp, Escherichia coli
gtgctgaaaactaaccccgatatgctgcggatattcgtggataacgggagtattgcctccacactggcggcgtcgctgtcattcgaaaagcgttacacgctcaatgtgattgtgaccgactttaccggtgattttgacctgctcatcgtgccggtgctggcgtggctgcgggaaaatcagcccgacatcatgaccaccgacgaaggccagaaaaagggcttcacgttttatgcggacatcaacaatgacagcagctttgatatcagtatcagcctgatgctgaccgagcgcacgctggtcagtgaggtggacggcgcgctgcatgtgaagaatatcccggaacccacgccgccggagccggtcacccgcccgatggagctttatatcaatggcgaactggtgagcaagtgggatgaatga

SEQ ID NO: 2212 - protein, 139 aa, Escherichia coli
MLKTNPDMLRIFVDNGSIASTLAASLSFEKRYTLNVIVTDFTGDFDLLIVPVLAWLRENQPDIMTTDEGQKKGFTFYADINNDSSFDISISLMLTERTLVSEVDGALHVKNIPEPTPPEPVTRPMELYINGELVSKWDE

SEQ ID NO: 2213 - DNA, 453 bp, Escherichia coli
atgaatgagtttaagcgttttgaagaccggctgaccggactgactgaatcgctgtcaccgtcagggcgtcggcgactgagtgccgaactggcgaaacgtctgcggcagagtcagcagcgtcgggtgatggcacagaaagccccggacggcacaccctacgcaccacgccagcagcagagcgccagaaaaaagaccggtcgtgttaagcgaaaaatgtttgcgaaacttatcaccagtcgttttttgcatatccgcgccagcccggaacaggcatcaatggaattttacggcgggaagtcgccgaaaatcgccagtgtgcatcagttcggtctgtcggaagaaacccggaaagacggtaagaaaattgattatccggcgcgtcctctgctcggctttaccggtgaggatgtgcagatgattgaagagattatcctggctcacctcgaccgttag

SEQ ID NO: 2214 - protein, 150 aa, Escherichia coli
MNEFKRFEDRLTGLTESLSPSGRRRLSAELAKRLRQSQQRRVMAQKAPDGTPYAPRQQQSARKKTGRVKRKMFAKLITSRFLHIRASPEQASMEFYGGKSPKIASVHQFGLSEETRKDGKKIDYPARPLLGFTGEDVQMIEEIILAHLDR

SEQ ID NO: 2215 - DNA, 636 bp, Escherichia coli
atgaacactctcgcaaatatccaggaactcgcgcgcgcactgcgcaacatgattcgcaccggccttgtcgtcgaaaccaaccttaaagccggtcgctgccgtgtgcagaccggcggcatgtgcaccgactggcttcagtggctgacctgtcgtgccgggcgttcgcgcacatggtgggcaccttccgtgggggaacaggtgctgattctggccgtgggcggtgaactcgacacggcgttcgttctgccggggatttattccggcgataaccctgcaccgtctgcgtcggcggatgccctgcatatccgtttccctgacggggcggtgattgagtatgaacctgaaaccagtgcgctcacggtaagcggaattaaaacggccagcgtgacggcttctgattctgttactgccacggtgccggtggtcatggtgaaagcgtcaacccgcatcaccctggacacaccggaggtggtctgcaccaacaggctgattaccggcacgctggaagtacagaagggcgggacgatgcgcggcaacattgaacacaccggcggtgaactctcatcaaacggtaaggtactgcatacccataaacaccccggcgacagcggcggcacaaccgggggacctctatga

SEQ ID NO: 2216 - protein, 211 aa, Escherichia coli
MNTLANIQELARALRNMIRTGLVVETNLKAGRCRVQTGGMCTDWLQWLTCRAGRSRTWWAPSVGEQVLILAVGGELDTAFVLPGIYSGDNPAPSASADALHIRFPDGAVIEYEPETSALTVSGIKTASVTASDSVTATVPVVMVKASTRITLDTPEVVCTNRLITGTLEVQKGGTMRGNIEHTGGELSSNGKVLHTHKHPGDSGGTTGGPL

SEQ ID NO: 2217 - DNA, 348 bp, Escherichia coli
atgactgcgcgttatctcggaatgaatcgcagtgatggcctgactgtcactgaccttgagcatatcagccagagtatcggcgatatcctgcgcacaccggtcggctcgcgggtgatgcgtcgtgattacggctcgttgctggcgtcaatgattgaccagccgcagaccccggcgcttgagttgcagattaaggtcgcctgttacatggcggtgctgaaatgggaaccccgcgtcaccctgtcatccgtcaccactgagcgcagttttgacgggcgaatgacagttacgttaaccggccagcacaacgacaccggccagccactttcgttaaccatccctgtgagttga

SEQ ID NO: 2218 - protein, 115 aa, Escherichia coli
MTARYLGMNRSDGLTVTDLEHISQSIGDILRTPVGSRVMRRDYGSLLASMIDQPQTPALELQIKVACYMAVLKWEPRVTLSSVTTERSFDGRMTVTLTGQHNDTGQPLSLTIPVS

SEQ ID NO: 2219 - DNA, 909 bp, Escherichia coli
atgccgattatcgacctgaaccagctacccgcaccggatgtggtcgaggagctggactttgaaaccattcttgctgaacgcaaggcgacactgatttccctttacccggaagaccagcaggaggcggtcgcccgtaccctgacgctggaatccgaacctctcgtcaaactgctggaggaaaatgcttatcgtgagcttatctggcgtcagcgtgtgaatgaggccgcacgggcggtgatgctggcctgtgcagccggtaatgaccttgatgtgattggtgccaattacaacaccacgcgcctgactatcaccccggcagatgattcgaccattccgccgacaccggcagtgatggagtctgacaccgattatcgtctgcgtattcagcaggcgtttgagggcttaagcgtcgccgggtcggtgggtgcctatcagtatcatggtcgcagtgccgacgggcgtgtcgcggatatctctgtcaccagtccgtctccggcctgcgtcaccatctctgtgctgtcacgtgaaaataacggtgtcgcatccgaagacctgctggccgtggtgcgtaacgcccttaatggtgaggacgtcaggccggtggctgaccgtgtgaccgtgcagtctgccgccattgttgaataccagataaacgccacgctttacctttaccctggtcccgaaagcgaacccatccgcgcggccgccgtgaaaaagctggaagcgtacatcacggcacagcaccggctggggcgcgacatccgtctgtctgccatttatgccgctttgcatgtggaaggcgtgcagcgtgtcgagctggcggcaccactggccgacatcgtgctcaacagtacgcaggcgtctttctgtaccgaataccgcgtcgtgaccggaggctcggatgagtga

SEQ ID NO: 2220 - protein, 302 aa, Escherichia coli
MPIIDLNQLPAPDVVEELDFETILAERKATLISLYPEDQQEAVARTLTLESEPLVKLLEENAYRELIWRQRVNEAARAVMLACAAGNDLDVIGANYNTTRLTITPADDSTIPPTPAVMESDTDYRLRIQQAFEGLSVAGSVGAYQYHGRSADGRVADISVTSPSPACVTISVLSRENNGVASEDLLAVVRNALNGEDVRPVADRVTVQSAAIVEYQINATLYLYPGPESEPIRAAAVKKLEAYITAQHRLGRDIRLSAIYAALHVEGVQRVELAAPLADIVLNSTQASFCTEYRVVTGGSDE

SEQ ID NO: 2221 - DNA, 531 bp, Escherichia coli
atgagtgattcgcgactgctgccgaccggctcatcaccgcttgaagtcgccgctgcaaaagcctgtgcggaaattgaaaaaacgccggtcagtattcgtgagctgtggaacccggacacctgcccggcaaatctgctgccgtggctggcgtgggcgttttcggtcgacagatgggatgaaaagtggccggaagcgaccaaacgcgccgttatacgcgatgcctatttcatccactgtcataaaggcactataggtgcaatccggcgtgtggtggagccgctgggctatctcatcaacgtgacggagtggtgggaaaccagtgacccgcccggcaccttccggcttgatattggtgtactggaaagcggtatcacagaggcaatgtatcaggaaatggaacggctgattgctgatgccaaacctgcaagccgtcaccttattggcctgaacattatccaggacattcccggctgtctgtatacaggcggtgtggtctgtgatggtgatgttattactgtttatcccggataa

SEQ ID NO: 2222 - protein, 176 aa, Escherichia coli
MSDSRLLPTGSSPLEVAAAKACAEIEKTPVSIRELWNPDTCPANLLPWLAWAFSVDRWDEKWPEATKRAVIRDAYFIHCHKGTIGAIRRVVEPLGYLINVTEWWETSDPPGTFRLDIGVLESGITEAMYQEMERLIADAKPASRHLIGLNIIQDIPGCLYTGGVVCDGDVITVYPG

SEQ ID NO: 2223 - DNA, 2742 bp, Escherichia coli
atgagcacgaaatttaaaaccgttatcactactgccggagccgcaaagctggcagccgccactgtccccggcgggaaaaaagtaaacctgtctgcaatggccgtgggtgacggtaatggcaaattgccggtgccggatgccggtcagacgaaactggtgcatgaggtctggcgtcacgctctgaataaagtcagcgtggataacaagaataaaaactatatcgtggctgaactggttgtaccgccagaagtgggcggcttctggatgcgtgaacttggtctgtatgacgatgccggaacactgattgcggtatccaacatggcagaaagctataagccagaactggctgaaggctccggacgtgcgcagacctgccgcatggttattattctcagcaacgtggcgtccgttgagctgagtattgatgccagcacggtgatggcgacgcaggattacgtcgatgacaaaatcgcagagcatgagcagtcccgccgccatcctgacgccacgctgacagaaaaaggttttactcagttaagcagtgcaacaaacagcaccagtgaaaagctggcggcaacgccaaaagcggtcaaggcagcaaatgacaacgcaaattcacgtctggcgaaaaatcagaacggtgcagatatccaggataaatcagcttttctggacaatattggcgttaccagcctgacgtttatgaaacacaatggaatgattccaaccactgacaatcttgactcctatggcccagaagaaaaatatcttggaacgtggtcatgtccgtcacaatccactgcaaaaccagagtctggttaccctgaagataaaggcaatggggttctggaagtattcaatgctggtcgctttcactgcacacaacgctacaccacccgaaccggtaatatttacattcggatgcttgatgcagaatggaacccagccagtccaacatggagtgcatggagagttattacaagcgggactcgaccattaagcacgtcaattgacctgaattctttaggtggcgcggaacacctgggaatatggcgcaatagcagtacatcaatagcctcatttgaacgtcatttcccggaggacgggagctttggtcagggtattctggaagtctttgaaggcggtctgtatgggagaatgcaacgttacaccacccgtagtgggactatgtacattcgcggactgactgcctcatgggatgcagagaatccacaatgggaggactggattgctgttgggtatcagtccacgggatggacttattcaggggatcttgatgaccttttaaagcctggtatttatagcgtcacgaaacaggccacaaacgcaccagtcaccgactctaaagatcttgctgttggctcaatagttgaagtgaaaaaacgttgtgatattgaatcgtatatccagacatatacgacagtttctgcaacggatgcctataaaaaccggacatttcaacgaactcgtgccagcggtgaagctgactggggggaatgggcggaagtttacaactcaaaatcattactcactaaattaggtgtcggcggtgttaccgacaggttatccagtctggactggcagacctacgactttgtgccgggcagcatgataactgtcagactctccgatatgaccaatatccccgatgggatggaatggggcgtcattgatactaacctgataaatatcactgttggccccagtgaaggtggaggtgtcgcccgttcaatgcaggtatggcgcagcacctcaaacaaaaccaactatcgtttttttacagtccgcttatatggcaatcctggggagcgtagcttcaatattcgtcggctaccaattatcgacgaagcccagacatgggaggcaaaacagacattcagtgcaggcctctctggtgaactgtccggcaatgcggcgacagcaacaaagctgaaaacagcccgtaaaattaataacgtttcgtttgatggaacatcagatattaacctgacgccgaaaaatattggtgcatttgcttcaggaaaaacaggagacaccgttgcgaatgataaagccgttggatggaactggagtagcggagcctataacgcaactactggtggggcatcaacgttaattcttcattttaatatcggtgaaggaagttgtcccgcagcccagttccgcgttaattataagaacggcggtattttttatcgttctgctcgtgatggttacggattcgaggctgactggtctgagttttataccacaacgcgaaaacctacagcgggagatgtcggtgcactgtcgttatctggtggtcaattgaatggtgcactgggcatcggaacatccagtgctcttggcggtaattcgattgttttgggtgataatgacacgggctttaaacaaaatggtgatggtaatctggatgtttatgctaatagcgtccatgttatgcgctttgtctccggaagcattcaaagtaataaaaccataaatattacggggcgtgttaatccttcggattacggtaactttgattcccgctatgtgagagatgtcagacttggcactcgtgttgttcagaccatgcagaaaggggtgatgtatgagaaagcagggcacgtaattacagggcttggtattgtcggtgaagtcgatggtgatgaccccgcagtattcagaccaatacaaaaatacatcaatggcacatggtataacgttgcacaggtgtaa

SEQ ID NO: 2224 - protein, 913 aa, Escherichia coli
MSTKFKTVITTAGAAKLAAATVPGGKKVNLSAMAVGDGNGKLPVPDAGQTKLVHEVWRHALNKVSVDNKNKNYIVAELVVPPEVGGFWMRELGLYDDAGTLIAVSNMAESYKPELAEGSGRAQTCRMVIILSNVASVELSIDASTVMATQDYVDDKIAEHEQSRRHPDATLTEKGFTQLSSATNSTSEKLAATPKAVKAANDNANSRLAKNQNGADIQDKSAFLDNIGVTSLTFMKHNGMIPTTDNLDSYGPEEKYLGTWSCPSQSTAKPESGYPEDKGNGVLEVFNAGRFHCTQRYTTRTGNIYIRMLDAEWNPASPTWSAWRVITSGTRPLSTSIDLNSLGGAEHLGIWRNSSTSIASFERHFPEDGSFGQGILEVFEGGLYGRMQRYTTRSGTMYIRGLTASWDAENPQWEDWIAVGYQSTGWTYSGDLDDLLKPGIYSVTKQATNAPVTDSKDLAVGSIVEVKKRCDIESYIQTYTTVSATDAYKNRTFQRTRASGEADWGEWAEVYNSKSLLTKLGVGGVTDRLSSLDWQTYDFVPGSMITVRLSDMTNIPDGMEWGVIDTNLINITVGPSEGGGVARSMQVWRSTSNKTNYRFFTVRLYGNPGERSFNIRRLPIIDEAQTWEAKQTFSAGLSGELSGNAATATKLKTARKINNVSFDGTSDINLTPKNIGAFASGKTGDTVANDKAVGWNWSSGAYNATTGGASTLILHFNIGEGSCPAAQFRVNYKNGGIFYRSARDGYGFEADWSEFYTTTRKPTAGDVGALSLSGGQLNGALGIGTSSALGGNSIVLGDNDTGFKQNGDGNLDVYANSVHVMRFVSGSIQSNKTINITGRVNPSDYGNFDSRYVRDVRLGTRVVQTMQKGVMYEKAGHVITGLGIVGEVDGDDPAVFRPIQKYINGTWYNVAQV

SEQ ID NO: 2225 - DNA, 528 bp, Escherichia coli
atgcagcatttaaaaaatattactgcgggtaatccaaaaactgttgcccaatatcaactgacaaaaaattttgatgttatctggttatggtccgaagagggaaaaaactggtatgaggaagtaagtaattttcaggaagacacgataaagattgtttacgacgagaataatataattgtcggcatcaccagagatgcttcaacgcttaaccctgaaggttttagcgttgtcgaggttcctgatattaccgccaaccgacgtgctgatgactcaggtaaatggatgtttaaggatggtgctgtgattaagcggatttatacggcagacgaacagctgcaactggcggaattacagaagtcagctttgctttccgaagctgaaactatcattcagccactggaacgctctgtcagactgaatatggcaacagatgaggagcgtagccgactggaagcatgggaacgctacagtgttctggtcagccgtgtggatcctgcaaatcctgaatggccggaaatgccgcaataa

SEQ ID NO: 2226 - protein, 175 aa, Escherichia coli
MQHLKNITAGNPKTVAQYQLTKNFDVIWLWSEEGKNWYEEVSNFQEDTIKIVYDENNIIVGITRDASTLNPEGFSVVEVPDITANRRADDSGKWMFKDGAVIKRIYTADEQLQLAELQKSALLSEAETIIQPLERSVRLNMATDEERSRLEAWERYSVLVSRVDPANPEWPEMPQ

SEQ ID NO: 2227 - DNA, 843 bp, Escherichia coli
atgaaaaaagaattgtttggacgttgcccgtttgatcttgacgaagatgtaaaaaaaatagccgcgataaataaatatatccatgcaaaatttgaggagcataaaaataaaatagacaacctaaagggtgtggaacaaaaattgatggtcttacagtactttaatgtactgaatgaacttagtaatcaggctatctcttctttgaatataggagccttttcagcatcggaagtattagctagggttataatagaacaggctgccaatcaattttatatagcaatagatgatggcgaaaatgcacaagcattactcaaggctagtaagaaattagttcatagtaatggaaaacggtggctggagtgtttaaaatccaaaggaatgactaatccagcagcaaatgaaaggattcgcatgggaaaagaactaactgatctatttaatagattgtggccaaatacacctgaatatccaggaaccagaaaactttttgaattaattggctgggaaacacactatcatgcccattacgttcccctttgtgattcaatacatacattctctgatgatatggtaaatatagtatctctatataatgcaatccaaagtgatgaaactactgctatcgaattcattcttgcagttaaacaagaaaataaacggctggcaatttataattttgtaattgctacggcccttcggtgtgaggccttagtaaatgtatttaactctttaggttatcaggatattataacagaaatgacaccaacaatagatacagtcaaccagactataattcgatatgatgattttgatcattccagaattgatgattgtcaataa

SEQ ID NO: 2228 - protein, 280 aa, Escherichia coli
MKKELFGRCPFDLDEDVKKIAAINKYIHAKFEEHKNKIDNLKGVEQKLMVLQYFNVLNELSNQAISSLNIGAFSASEVLARVIIEQAANQFYIAIDDGENAQALLKASKKLVHSNGKRWLECLKSKGMTNPAANERIRMGKELTDLFNRLWPNTPEYPGTRKLFELIGWETHYHAHYVPLCDSIHTFSDDMVNIVSLYNAIQSDETTAIEFILAVKQENKRLAIYNFVIATALRCEALVNVFNSLGYQDIITEMTPTIDTVNQTIIRYDDFDHSRIDDCQ

SEQ ID NO: 2229 - DNA, 1191 bp, Escherichia coli
atgagcgactatcatcatggcgtgcaggtgctggagattaacgacggcacccgcgtcatttccaccgtatccaccgccattgtcggcatggtctgcacggccagcgatgcggatgcggaaatcttccccctcaataaaccggtgctgatcaccaatgtgcagagcgcaattgcaaaggccggtaaaaaaggcacgctggcggcatcgttgcaggccatcgctgaccagtcaaaaccggtcaccgttgtcgtgcgcgtggaagacggaaccggcgacgacgaagaaacgaaactcgcgcagaccgtttccaatattatcggcaccactgacgaaaacggtcagtacaccggactgaaagccctgctggcggcggagtcggtaaccggtgttaaaccgcgcattctcggtgtgccgggactggacaccaaagaggtggctgttgcactggcatcagtctgtcagaagctgcgcgctttcgggtatatcagcgcatggggctgtaaaaccatttccgaggtgaaagcctaccgtcagaatttcagccagcgtgagctgatggtcatctggccggatttcctcgcatgggatacggtcaccagtaccaccgccaccgcgtatgctaccgcccgtgcactgggcttgcgcgctaaaatcgaccaggagcagggctggcataaaacactgtccaacgtcggggtgaacggtgttaccggcatcagcgcatctgtattctgggatttgcaggagtccggcactgatgctgacctgcttaacgagtcaggcgtcacaacgctgattcgccgtgatggtttccgcttctggggtaaccgtacctgctctgatgacccgctgttcctctttgaaaactacacccgcaccgcgcaggtgctggccgacacgatggctgaggcgcacatgtgggcggtggacaagcccatcaccgcaacgctgattcgcgacatcgttgacggcatcaatgccaaattccgtgagctgaaaacaaacggctatatcgtggatgcgacctgctggttcagcgaagaatccaacgatgcggaaaccctcaaggccggaaaactgtatatcgactacgactatacaccggtgcctcctctcgaaaacctgaccctgcgccagcgtattaccgataaatacctggcaaatctggtcacctcggttaacagcaattaa

SEQ ID NO: 2230 - protein, 396 aa, Escherichia coli
MSDYHHGVQVLEINDGTRVISTVSTAIVGMVCTASDADAEIFPLNKPVLITNVQSAIAKAGKKGTLAASLQAIADQSKPVTVVVRVEDGTGDDEETKLAQTVSNIIGTTDENGQYTGLKALLAAESVTGVKPRILGVPGLDTKEVAVALASVCQKLRAFGYISAWGCKTISEVKAYRQNFSQRELMVIWPDFLAWDTVTSTTATAYATARALGLRAKIDQEQGWHKTLSNVGVNGVTGISASVFWDLQESGTDADLLNESGVTTLIRRDGFRFWGNRTCSDDPLFLFENYTRTAQVLADTMAEAHMWAVDKPITATLIRDIVDGINAKFRELKTNGYIVDATCWFSEESNDAETLKAGKLYIDYDYTPVPPLENLTLRQRITDKYLANLVTSVNSN

SEQ ID NO: 2231 - DNA, 519 bp, Escherichia coli
atggcaatgccgcgcaaactcaagttaatgaacgtctttctgaacggctacagctatcagggcgttgcaaagtccgtcacgctgccaaaactgacccgtaagctcgaaaactatcgcggtgcggggatgaacggcagcgcaccggtagacctcggccttgatgacgatgcgctgtcaatggagtggtctctcgggggcttcccggattcggttatctgggagctttacgccgcaaccggtgtggatgccgtgccgattcgttttgccggttcttaccagcgcgacgataccggcgaaacggtggccgtcgaggtggtcatgcgtggacgtcagaaagaaatcgacaccggcgaggggaaacagggagaagacaccgagtcgaaaatctccgtggtctgtacctatttccggctgacgatggacggtaaggagttggtcgaaattgacaccatcaacatgattgagaaggtgaacggcgtcgaccggctggagcaacaccgccgcaatatcggcctgtga

SEQ ID NO: 2232 - protein, 172 aa, Escherichia coli
MAMPRKLKLMNVFLNGYSYQGVAKSVTLPKLTRKLENYRGAGMNGSAPVDLGLDDDALSMEWSLGGFPDSVIWELYAATGVDAVPIRFAGSYQRDDTGETVAVEVVMRGRQKEIDTGEGKQGEDTESKISVVCTYFRLTMDGKELVEIDTINMIEKVNGVDRLEQHRRNIGL

SEQ ID NO: 2233 - DNA, 276 bp, Escherichia coli
atgaacaaagaaaatgtgattaccctggacaatccggtcaagcgtggtgagcaggttatcgaacaggtcacgctgatgaaacccaatgccgggacgctgcgcggtgtcagtctggctgcggtcgcaaattccgaagtcgatgcactgattaaagtgctgccgcgcatgacggcaccgatgctgaccgagcaggaggtcgccgcgctggaactgcctgaccttgtggcgctggccggtaaggtggtcggttttttgtcgccgaactcggtgcagtaa

SEQ ID NO: 2234 - protein, 91 aa, Escherichia coli
MNKENVITLDNPVKRGEQVIEQVTLMKPNAGTLRGVSLAAVANSEVDALIKVLPRMTAPMLTEQEVAALELPDLVALAGKVVGFLSPNSVQ

SEQ ID NO: 2235 - DNA, 2448 bp, Escherichia coli
atgagtaacaatgtaaaattacaggtattgctcagggctgttgaccaggcatcccgcccgtttaaatccatccgcacagcgagcaaatcgctgtcgggggatatccgggacacacaaaaatcactgcgcgagctgaacggtcacgcatcccgtattgagggatttcgcaagaccagtgcacagctcgccgtgactggtcaggaactgaaaaaagccagacaggaagccgcagctctggctgtccagtttaaaaatactgaacgaccgacaaatgcacaggcaaaggcaatggaagccgcgcgtaaaaatgcgtctgagttacaggcgaaatataacagcctgagattgtcggtacagcgccagcgtcaggaattgagtcaggcgggtattaatacccgtaatctggcgcatgatgaacgagggctgaaaaaccgtatcagtgaaaccaccgcacagcttaaccgtcagcgtgacgcgctggcacgtgtcagtgcacaacaggcaaaacttaacgcagtcaaacagcgttatcaggccggaaaggaactggccggaaatatggcctcggtgggcgctgccggtgtggggattgcggcggcgggaacgatggccggagttaagttgctgatgcccggttatgagtttgcgcagaaaaactcagaattgcaggccgtgctcggagtggcaaaagactccgccgaaatggccgcgctccgcaagcaggcgcgccagctcggcgataataccgccgcctcggcggatgatgcggccggtgcgcagattatcattgcgaaagcgggtggagatgctgcggctattcaggcggcaacgccggtcacgctgaatatggcactggcgaatcagcggtcgatggaagaaaacgcgcaactgttactggggactaaggcatcctttcaactgtcaaatgatgatgtcagccatgtgggcgacgtgttgtcggcaacgatgaataagtcggcggctgattttcagggactcagtgatgcactgacttacctcgggccggttgcgaggacggcaggtgtaagtcttgagcaggcagcggccatgacaggtgtgctgcatgacaataacatcagggggtcaatggcgggtacgggtagcagtgccgttgtcacccgattacaggcaccgactggaaaagcatgggatgcactcaaagagcttggcgttaaaacctcggacaaaaagggaaatatgcgtccgttgttcaccattctgaaagagattcaggccagctttgataaacacaagctgggaacgtctcagaagggggaataccttaaaaccatttttggtgaggaagccctgaaatcagcgaacgttttactggcagcggcagcaagcggaaaactggatacgctgaccgccacgctgaaagcctcggacggtaaaacggaagagctggttaaaatcatgcaggataacctcggcggtgactttaaggagtttcagtccgcttatgaggcggtggggactgacctgtttgaccagcaagaaggcacactgcgtaagctcacgcagacggccacaaagtatgtgttaaaactcgacggctggatacagaaaaacaaatcactggcgtcaaccattggcctcattgccggtggcgcactggcgctgactggtgtcatcggtgccattggccttgtagcctggccggttatcaccggcatcaatgccattatcgcggcagcaggcgcaatgggggcaatcttcacgacggttggtagtgccgttatgacggccatcggtgtgattagctggccggttgtggccgtggtggctgccattgtcgccggggcgttgcttatccgtaaatactgggagcctgtcagcgcattctttggcggtgtggttgaagggctgaaagcggcatttgcgccggtgggggagctgttcacgccacttaagccggtgtttgactggctgggcgaaaagttacaggccgcgtggcagtggtttaaaaacctgattgcaccggtcaaagccacccaggacaccctgaaccgttgccgtgacacgggcgtcatgttcgggcaggcactggctgacgcgctgatgctgccgcttaatgcgttcaacaaattacgcagcggcattgactgggtactggaaaagctcggggtcatcaacaaagagtcagacacacttgaccagaccgccgccagaactcatgccgccacgtatggcaccggtggttatattccggcgaccagctcttatgcaggctatcaggcttatcagccggtcacggcaccggctggccgctcttatgtggaccagagtaaaaacgaatatcacatcagcctgacgggtggtactgcaccggggacacagcttgaccgccagttacaggatgcgctcgaaaaatacgagcgggataaacgtgcgcgcgcccgtgccagcatgatgcatgacggttaa

SEQ ID NO: 2236 - protein, 815 aa, Escherichia coli
MSNNVKLQVLLRAVDQASRPFKSIRTASKSLSGDIRDTQKSLRELNGHASRIEGFRKTSAQLAVTGQELKKARQEAAALAVQFKNTERPTNAQAKAMEAARKNASELQAKYNSLRLSVQRQRQELSQAGINTRNLAHDERGLKNRISETTAQLNRQRDALARVSAQQAKLNAVKQRYQAGKELAGNMASVGAAGVGIAAAGTMAGVKLLMPGYEFAQKNSELQAVLGVAKDSAEMAALRKQARQLGDNTAASADDAAGAQIIIAKAGGDAAAIQAATPVTLNMALANQRSMEENAQLLLGTKASFQLSNDDVSHVGDVLSATMNKSAADFQGLSDALTYLGPVARTAGVSLEQAAAMTGVLHDNNIRGSMAGTGSSAVVTRLQAPTGKAWDALKELGVKTSDKKGNMRPLFTILKEIQASFDKHKLGTSQKGEYLKTIFGEEALKSANVLLAAAASGKLDTLTATLKASDGKTEELVKIMQDNLGGDFKEFQSAYEAVGTDLFDQQEGTLRKLTQTATKYVLKLDGWIQKNKSLASTIGLIAGGALALTGVIGAIGLVAWPVITGINAIIAAAGAMGAIFTTVGSAVMTAIGVISWPVVAVVAAIVAGALLIRKYWEPVSAFFGGVVEGLKAAFAPVGELFTPLKPVFDWLGEKLQAAWQWFKNLIAPVKATQDTLNRCRDTGVMFGQALADALMLPLNAFNKLRSGIDWVLEKLGVINKESDTLDQTAARTHAATYGTGGYIPATSSYAGYQAYQPVTAPAGRSYVDQSKNEYHISLTGGTAPGTQLDRQLQDALEKYERDKRARARASMMHDG

SEQ ID NO: 2237 - DNA, 480 bp, Escherichia coli
atgatgctcgcgttaggtatgtttgtttttatgcgccagacgctgccacaccagaccatgcagcgtgaatcagattatcgctggccgtcaaattcccgtatcggtaaacgggatgcctaccagtttctcggcgttggtgaggaaaacatgacgcttgccggtgtgctttatcccgaactgaccggcggcaagctgacgatgaccacgctcagactgatggcagaggaaggccgggcgtggccgttgctggatggtaccggcatgatttacggcatgtatgtcatcagcagggtgagtgaaacagggagtattttctttgcagacggcacaccccggaaaattgattttacgctgtcgctcacccgcgttgatgaatcactggccgcgctttatggcgatatcagtaaacaggcggagtcgctcatcggtaaggctggcagtatggcgaccagattcacaggtatgacgggggcgggataa

SEQ ID NO: 2238 - protein, 159 aa, Escherichia coli
MMLALGMFVFMRQTLPHQTMQRESDYRWPSNSRIGKRDAYQFLGVGEENMTLAGVLYPELTGGKLTMTTLRLMAEEGRAWPLLDGTGMIYGMYVISRVSETGSIFFADGTPRKIDFTLSLTRVDESLAALYGDISKQAESLIGKAGSMATRFTGMTGAG

SEQ ID NO: 2239 - DNA, 1164 bp, Escherichia coli
atgctggatacgctgacatttgatgcaggcagtacgctgacgccggattacatgctgatgctcgacagcagggatattaccggcaatatcagcgaccgtctgatgagtatgaccctgacggataaccggggctttgaggctgaccagcttgatattgaactgaacgatgccgacgggcaggtcgggctgccggttcgtggcgctgtcctgacggtgtatatcggctggaaaggttttgccctggtatgcaaagggaaatttaccgttgatgaggttgaacaccggggcgcaccggatgtggtcaccatccgcgcacggagtgcagattttcgcgggacgctcaattcccgccgtgaaggctcctggcatgacaccacgctcggtgcaattgttgaggcgatagccacccgtaacaggctggaagccagtgtcgctccgtcactggccggaattaaaattccgcacatcgaccagtcgcaggagtctgatgcgaaattcctgacccgtcttgcagaacgcaacggcggtgaggtctcggtaaaaatgggaaaactgttgtttctcaaagcggggcagggggtgacggccagcggtaaaaaaatcccgcaggtcaccataacccgcagcgacggcgaccgccaccattttgcgattgctgaccgtggagcctataccggcgtaacggcaaagtggcttcacaccaaagacccgaagccgcaaaagcagaaggtaaaactgaaacgcaaaaagaaagaaaaacacctgcgcgcactggagcacccgaaagcgaaaccagtcacgcagaagaaagcgccaaaagcgccggaagcgcgcgaaggtgaatacatggccggtgaggctgacaatgtttttgccctgaccacggtatatgccacgaaagcgcaggccatgcgcgccgctcaggcgaagtgggataaactgcaacggggcgttgcggagttctccatcagcctggctaccggtcgggcagatatttacacggaaacaccggttaaggtgtcaggctttaagcgcgtcatagacgagcaggactggacaatcactaaggtgacacattttctgaataatagcggcttcacgacgtccttagagcttgaggtcaggctttctgatgtggagtacgaaacagaagatgatgagtga

SEQ ID NO: 2240 - protein, 387 aa, Escherichia coli
MLDTLTFDAGSTLTPDYMLMLDSRDITGNISDRLMSMTLTDNRGFEADQLDIELNDADGQVGLPVRGAVLTVYIGWKGFALVCKGKFTVDEVEHRGAPDVVTIRARSADFRGTLNSRREGSWHDTTLGAIVEAIATRNRLEASVAPSLAGIKIPHIDQSQESDAKFLTRLAERNGGEVSVKMGKLLFLKAGQGVTASGKKIPQVTITRSDGDRHHFAIADRGAYTGVTAKWLHTKDPKPQKQKVKLKRKKKEKHLRALEHPKAKPVTQKKAPKAPEAREGEYMAGEADNVFALTTVYATKAQAMRAAQAKWDKLQRGVAEFSISLATGRADIYTETPVKVSGFKRVIDEQDWTITKVTHFLNNSGFTTSLELEVRLSDVEYETEDDE

SEQ ID NO: 2241 - DNA, 282 bp, Escherichia coli
ttgttttataaggataaattaactaaaatggcaccatcaacaaaaccggaagaggtgctcgcgatgtttcattgtcctttatgccagcatgccgcacatgcgcgtacaagccgctatatcactgacacgacaaaagagcgttatcaccagtgtcagaacgtgaattgcagcgccacgttcatcacttatgagtcggtacagcgatacattgtgaagccgggagaagtccatgccgtgaggccgcacccgttgccgtcagggcagcaaattatgtggatgtaa

SEQ ID NO: 2242 - protein, 93 aa, Escherichia coli
MFYKDKLTKMAPSTKPEEVLAMFHCPLCQHAAHARTSRYITDTTKERYHQCQNVNCSATFITYESVQRYIVKPGEVHAVRPHPLPSGQQIMWM

SEQ ID NO: 2243 - DNA, 2283 bp, Escherichia coli
atgtccgagcttaatgaaaagttagccacagcctgggaaggttttaccaaaggtgactggcagaatgaagtaaacgtccgtgacttcattcagaaaaactacactccgtacgagggtgacgagtccttcctggctggcgctactgaagcgaccaccaccctgtgggacaaagtaatggaaggcgttaaactggaaaaccgcactcacgcgccagttgactttgacaccgctgttgcttccaccatcacctctcacgacgctggttacatcaacaagcagcttgagaaaatcgttggtctgcagactgaagctccgctgaaacgtgctcttatcccgttcggtggtatcaaaatgatcgaaggttcctgcaaagcgtacaaccgcgaactggacccgatgatcaaaaaaatcttcactgaataccgtaaaactcacaaccagggcgtgttcgacgtttacactccggacatcctgcgttgccgtaaatccggtgttctgaccggtctgccagatgcttatggccgtggtcgtatcatcggtgactaccgtcgcgttgcgctgtacggtatcgactacctgatgaaagacaaacttgcacagttcacctctctgcaggctgatctggaaaacggcgtaaacctggaacagactatccgtctgcgcgaagaaatcgctgaacagcaccgcgctctgggtcagatgaaagaaatggctgcgaaatacggctacgacatctctggtccggctaccaacgctcaggaagctatccagtggacttacttcggctacctggctgctgttaagtctcagaacggtgctgcaatgtccttcggtcgtacctccaccttcctggatgtgtacatcgaacgtgacctgaaagctggcaagatcaccgaacaagaagcgcaggaaatggttgaccacctggtcatgaaactgcgtatggttcgcttcctgcgtactccggaatacgatgaactgttctctggcgacccgatctgggcaaccgaatctatcggtggtatgggcctcgacggtcgtaccctggttaccaaaaacagcttccgtttcctgaacaccctgtacaccatgggtccgtctccggaaccgaacatgaccattctgtggtctgaaaaactgccgctgaacttcaagaaattcgccgctaaagtgtccatcgacacctcttctctgcagtatgagaacgatgacctgatgcgtccggacttcaacaacgatgactacgctattgcttgctgcgtaagcccgatgatcgttggtaaacaaatgcagttcttcggtgcgcgtgcaaacctggcgaaaaccatgctgtacgcaatcaacggcggcgttgacgaaaaactgaaaatgcaggttggtccgaagtctgaaccgatcaaaggcgatgtcctgaactatgatgaagtgatggagcgcatggatcacttcatggactggctggctaaacagtacatcactgcactgaacatcatccactacatgcacgacaagtacagctacgaagcctctctgatggcgctgcacgaccgtgacgttatccgcaccatggcgtgtggtatcgctggtctgtccgttgctgctgactccctgtctgcaatcaaatatgcgaaagttaaaccgattcgtgacgaagacggtctggctatcgacttcgaaatcgaaggcgaatacccgcagtttggtaacaacgatccgcgtgtagatgacctggctgttgacctggtagaacgtttcatgaagaaaattcagaaactgcacacctaccgtgacgctatcccgactcagtctgttctgaccatcacttctaacgttgtgtatggtaagaaaactggtaacaccccagacggtcgtcgtgctggcgcgccgttcggaccgggtgctaacccgatgcacggtcgtgaccagaaaggtgctgtagcgtctctgacttccgttgctaaactgccgtttgcttacgctaaagatggtatctcctacaccttctctatcgttccgaacgcactgggtaaagacgacgaagttcgtaagaccaacctggctggtctgatggatggttacttccaccacgaagcatccatcgaaggtggtcagcacctgaacgttaacgtgatgaaccgtgaaatgctgctcgacgcgatggaaaacccggaaaaatatccgcagctgaccatccgtgtatctggctacgcagtacgtttcaactcgctgactaaagaacagcagcaggacgttattactcgtaccttcactcaatctatgtaa

SEQ ID NO: 2244 - protein, 760 aa, Escherichia coli
MSELNEKLATAWEGFTKGDWQNEVNVRDFIQKNYTPYEGDESFLAGATEATTTLWDKVMEGVKLENRTHAPVDFDTAVASTITSHDAGYINKQLEKIVGLQTEAPLKRALIPFGGIKMIEGSCKAYNRELDPMIKKIFTEYRKTHNQGVFDVYTPDILRCRKSGVLTGLPDAYGRGRIIGDYRRVALYGIDYLMKDKLAQFTSLQADLENGVNLEQTIRLREEIAEQHRALGQMKEMAAKYGYDISGPATNAQEAIQWTYFGYLAAVKSQNGAAMSFGRTSTFLDVYIERDLKAGKITEQEAQEMVDHLVMKLRMVRFLRTPEYDELFSGDPIWATESIGGMGLDGRTLVTKNSFRFLNTLYTMGPSPEPNMTILWSEKLPLNFKKFAAKVSIDTSSLQYENDDLMRPDFNNDDYAIACCVSPMIVGKQMQFFGARANLAKTMLYAINGGVDEKLKMQVGPKSEPIKGDVLNYDEVMERMDHFMDWLAKQYITALNIIHYMHDKYSYEASLMALHDRDVIRTMACGIAGLSVAADSLSAIKYAKVKPIRDEDGLAIDFEIEGEYPQFGNNDPRVDDLAVDLVERFMKKIQKLHTYRDAIPTQSVLTITSNVVYGKKTGNTPDGRRAGAPFGPGANPMHGRDQKGAVASLTSVAKLPFAYAKDGISYTFSIVPNALGKDDEVRKTNLAGLMDGYFHHEASIEGGQHLNVNVMNREMLLDAMENPEKYPQLTIRVSGYAVRFNSLTKEQQQDVITRTFTQSM

SEQ ID NO: 2245 - DNA, 1197 bp, Escherichia coli
atgccccgctttacatatatttgcattaataaaataattgtaattataaggttaaatatcggtaatttgtatttaataaatacgatcgatattgttactttattcgccaggtgctcccttttaattaactgttttagcggaggatgcggaaaaaattcaactcatttgttaatttttaaaatttatttttatttggataatcaaatatttactccgtatttgcataaaaaccatgcgagttacgggcctataagccaggcgagatatgatctatatcaatttctcatctataatgctttgttagtatctcgtcgccgacttaataaagagagagttagtgtgaaagctgacaacccttttgatcttttacttcctgctgcaatggccaaagtggccgaagaggcaggtgtctataaagcaacgaaacatccgcttaagactttctatctggcgattaccgccggtgttttcatctcaatcgcattcgtcttctatatcacagcaaccactggcacaggtacaatgcccttcggcatggcaaaactggttggcggcatttgcttctctctggggttgattctttgtgttgtctgcggagccgatctctttacttccacagtgttgattgttgttgccaaggcgagtgggcgcatcacctggggtcagttggcgaaaaactggctaaatgtttattttggcaacctggtcggcgcactgctgtttgtacttttaatgtggctttccggcgagtatatgaccgcaaatggtcaatggggactaaacgtcctacaaaccgccgaccacaaagtgcaccatacttttattgaggccgtctgtcttggtatcctggcgaacctgatggtatgtctggcagtatggatgagttattctggccgcagcctgatggacaaagcgttcattatggtgctgccggtcgcgatgtttgttgccagcggttttgagcacagtatcgcaaacatgtttatgatcccgatgggtattgtaatccgcgacttcgcatctccggaattctggaccgctgtcggttctgcaccggaaaatttttctcacctgaccgtgatgaatttcatcactgataacctgattccggttacgatcggtaatattatcggcggtggtttgttggttgggttgacatactgggtcatttacctgcgtgaaaacgatcaccattaa

SEQ ID NO: 2246 - protein, 398 aa, Escherichia coli
MPRFTYICINKIIVIIRLNIGNLYLINTIDIVTLFARCSLLINCFSGGCGKNSTHLLIFKIYFYLDNQIFTPYLHKNHASYGPISQARYDLYQFLIYNALLVSRRRLNKERVSVKADNPFDLLLPAAMAKVAEEAGVYKATKHPLKTFYLAITAGVFISIAFVFYITATTGTGTMPFGMAKLVGGICFSLGLILCVVCGADLFTSTVLIVVAKASGRITWGQLAKNWLNVYFGNLVGALLFVLLMWLSGEYMTANGQWGLNVLQTADHKVHHTFIEAVCLGILANLMVCLAVWMSYSGRSLMDKAFIMVLPVAMFVASGFEHSIANMFMIPMGIVIRDFASPEFWTAVGSAPENFSHLTVMNFITDNLIPVTIGNIIGGGLLVGLTYWVIYLRENDHH

SEQ ID NO: 2247 - DNA, 1794 bp, Escherichia coli
ttgcgcgctttccgtacgactaaagtgattttcatgacgcaaacatttatccccggcaaagatgccgctctggaagattccatcgcacgcttccagcaaaaactttcagacctcggttttcagattgaagaggcctcctggctgaatcccgtgcctaacgtctggtctgtacatattcgcgacaaagagtgcgcactgtgttttaccaacggtaaaggcgcaaccaaaaaagcggcgctggcttctgccctcggtgaatatttcgagcgtctctcaaccaactacttttttgcggacttctggctgggcgaaaccatcgccaacggcccattcgtgcattatcccaacgaaaaatggttcccactgaccgaaaatgacgatgtaccagaagggctgctcgatgaccgtctgcgcgcattttacgatccggagaatgaactgaccggtagtatgctgattgacctgcaatccggtaacgaagatcgtggtatttgcggtctaccgtttacgcgccagtccgacaatcagaccatttatattccgatgaatatcattggtaacttgtacgtttctaacggtatgtctgctggcaatacccgtaacgaagcacgcgttcagggattgtctgaagttttcgaacgttacgtgaaaaaccgcattattgctgaaagcatcagcttgccggaaatcccggcagacgtgctggcacgttatccagcagtagttgaagcgatcgaaacgctggaagcggaagatttcccgatcttcgcttatgacggttcgcttggcggccagtatccggtgatttgcgtggtactgttcaatcctgctaacggtacctgctttgcctcattcggtgcgcatcctgattttggcgttgcactggaacgtaccgtgaccgagctgctgcaaggtcgtggcctaaaagatctggatgtgtttactccaccaaccttcgatgatgaagaagtcgctgaacataccaacctcgaaacgcactttatcgattccagcggtttaatctcctgggacctgttcaagcaggatgccgattatccgtttgttgactggagcttctccggcaccacggaagaagagttcgccacgctgatggctatcttcaaaaaggaagataaagaagtttatattgccgattacgagcatctgggtgtctacgcttgccgtattatcgtgcctggcatgtccgatatttatccggctgaagatctgtggctggcgaataacagtatgggcagccatttacgtgaaacgattctttcgctaccaggtagcgagtgggaaaaggaagattacctgaacctcatcgagcaactggatgaagaaggttttgatgactttacccgcgtgcgtgaactgttgggtctggcgaccgggtcggataacggctggtacactctgcgtatcggtgaattaaaagccatgctggcgctggctggtggcgatctggaacaggctctggtctgggccgaatggacgatggagtttaactcatcagtattcagcccggaacgcgccaattattatcgctgcctgcaaacgttgttattactggcgcaggaagaagatcgccagccgctgcaatatctgaatgcgtttgttcgcatgtacggcgcagatgccgtggaagccgccagtgcggcaatgagcggcgaagcggcgttttatggcttgcaaccagtagatagcgatctgcacgcgtttgctgcacatcagtcgttgttgaaggcctacgaaaagctgcagcgcgccaaagcagcattctgggcaaaataa

SEQ ID NO: 2248 - protein, 597 aa, Escherichia coli
MRAFRTTKVIFMTQTFIPGKDAALEDSIARFQQKLSDLGFQIEEASWLNPVPNVWSVHIRDKECALCFTNGKGATKKAALASALGEYFERLSTNYFFADFWLGETIANGPFVHYPNEKWFPLTENDDVPEGLLDDRLRAFYDPENELTGSMLIDLQSGNEDRGICGLPFTRQSDNQTIYIPMNIIGNLYVSNGMSAGNTRNEARVQGLSEVFERYVKNRIIAESISLPEIPADVLARYPAVVEAIETLEAEDFPIFAYDGSLGGQYPVICVVLFNPANGTCFASFGAHPDFGVALERTVTELLQGRGLKDLDVFTPPTFDDEEVAEHTNLETHFIDSSGLISWDLFKQDADYPFVDWSFSGTTEEEFATLMAIFKKEDKEVYIADYEHLGVYACRIIVPGMSDIYPAEDLWLANNSMGSHLRETILSLPGSEWEKEDYLNLIEQLDEEGFDDFTRVRELLGLATGSDNGWYTLRIGELKAMLALAGGDLEQALVWAEWTMEFNSSVFSPERANYYRCLQTLLLLAQEEDRQPLQYLNAFVRMYGADAVEAASAAMSGEAAFYGLQPVDSDLHAFAAHQSLLKAYEKLQRAKAAFWAK

SEQ ID NO: 2249 - DNA, 693 bp, Escherichia coli
atgaaggcgtttgatctccaccgtatagcattcgataaagtgccttttgatttccttggcgaagttgcactacgtagtctttatacctttgtactggtctttttgttcctcaaaatgaccggaagacgcggtgtgcggcagatgtcgctgtttgaagtgttaatcattctgacactgggttcagcggcgggagatgtggcgttttatgatgatgtgccgatggtcccggtacttatcgtctttattactctggcgttgttataccgcctggtaatgtggttgatggcgcacagtgaaaaactggaagatcttctggaaggcaagccggttgtcattattgaagatggcgagctggcctggtcgaaactcaataactccaacatgacggaatttgagttctttatggagctacgattgcgcggtgtagagcagttggggcaggtacgtctggcgattctcgaaaccaacgggcaaatcagtgtttatttctttgaagatgacaaggtgaaaccgggattacttattttacccagtgactgtactcagcgttacaaagtggtgccggagtcggcggactatgcctgcatccgttgcagtgaaatcattcatatgaacgcgggggaaaaacaattatgtccgcgctgtgcaaatccagaatggacgaaggcaagtcgagctaaacgggtgacctga

SEQ ID NO: 2250 - protein, 230 aa, Escherichia coli
MKAFDLHRIAFDKVPFDFLGEVALRSLYTFVLVFLFLKMTGRRGVRQMSLFEVLIILTLGSAAGDVAFYDDVPMVPVLIVFITLALLYRLVMWLMAHSEKLEDLLEGKPVVIIEDGELAWSKLNNSNMTEFEFFMELRLRGVEQLGQVRLAILETNGQISVYFFEDDKVKPGLLILPSDCTQRYKVVPESADYACIRCSEIIHMNAGEKQLCPRCANPEWTKASRAKRVT

SEQ ID NO: 2251 - DNA, 1089 bp, Escherichia coli
atggctcaaatcttcaattttagttctggtccggcaatgctaccggcagaggtgcttgaacaggctcaacaggaactgcgcgactggaacggtcttggtacgtcggtgatggaagtgagtcaccgtggcaaagagttcattcaggttgcagaggaagccgagaaggattttcgcgatcttcttaacgtcccctccaactacaaggtattgttctgccatggcggtggtcgcggtcaatttgctgctgtaccgctgaatattcttggtgataaaaccactgcagattatgttgatgcgggttactgggcagcaagtgctatcaaagaagcgaaaaaatactgcacaccaaatgtgtttgatgcgaaagtgaccgttgatggtcttcgcgcagttaagccaatgagtgaatggcaactctctgataatgctgcttatatgcattactgcccgaacgaaaccattgacggtatcgctatcgatgaaacaccagacttcggtaaagacgtggtggtcgccgctgacttctcttcaaccattctttcccgtccgattgatgtcagccgttatggtgtaatttacgctggcgcgcagaaaaatatcggcccggctggcctgacaatcgtcatcgttcgtgaagatttgctgggcaaagcgaatatcgcctgcccatcgattctggattactccatcctcaacgataacgattccatgttcaacacgccgccgacatttgcctggtacttatctggcctggtcttcaaatggctgaaagcgaacggcggtgtggctgcaatggataagatcaatcagcaaaaagcagaactgctgtatggggtgattgataacagcgatttctaccgcaatgatgtggcgaaagctaaccgttcgcggatgaacgtgccgttccagttggcggatagcgcgcttgataaattgttcctcgaagagtctttcgctgcgggcttacatgcgctgaaaggtcaccgagtggtcggcggaatgcgtgcgtctatttataacgccatgccgctggaaggtgttaaagcactgacagacttcatggttgagttcgaacgtcgtcacggctaa

SEQ ID NO: 2252 - protein, 362 aa, Escherichia coli
MAQIFNFSSGPAMLPAEVLEQAQQELRDWNGLGTSVMEVSHRGKEFIQVAEEAEKDFRDLLNVPSNYKVLFCHGGGRGQFAAVPLNILGDKTTADYVDAGYWAASAIKEAKKYCTPNVFDAKVTVDGLRAVKPMSEWQLSDNAAYMHYCPNETIDGIAIDETPDFGKDVVVAADFSSTILSRPIDVSRYGVIYAGAQKNIGPAGLTIVIVREDLLGKANIACPSILDYSILNDNDSMFNTPPTFAWYLSGLVFKWLKANGGVAAMDKINQQKAELLYGVIDNSDFYRNDVAKANRSRMNVPFQLADSALDKLFLEESFAAGLHALKGHRVVGGMRASIYNAMPLEGVKALTDFMVEFERRHG

SEQ ID NO: 2253 - DNA, 1284 bp, Escherichia coli
atggaatccctaacgttacaacccatcgctcgtgtcgatggcactattaatctgcccggttccaagagcgtttctaaccgcgctttattgctggcggcattagcacacggcaaaacagtattaaccaatctgctggatagcgatgacgtgcgccatatgctgaatgcattaacagcgttaggggtaagctatacgctttcagccgatcgtacgcgttgcgaaattatcggtaacggtggtccattacacgcagaaagtgcccgggagttgttcctcggtaacgccggaacggcaatgcgtccgctggcggcagcactttgcctgggtagcaatgatattgtactgaccggtgaaccgcgaatgaaagaacgcccgattggtcatctggtggatgcgctgcgccagggcggggcgaagatcacttacctggaacaagaaaattatccgccattgcgtttacagggcggctttactggcggcaacgttgatgttgatggctccgtttccagccagttcctcaccgcactgttaatgactgcgcctcttgcgccggaagatacggtgattcgtattaaaggcgatctggtttctaaaccttatatcgatatcaccctcaatctgatgaagacgtttggtgttgaaattgaaaatcagcactatcaacaatttgtcgtaaaaggggggcagtcttaccagtctccgggcacttatttggttgaaggcgatgcatcttcggcttcttatttcctggcagcagcagcaatcagaggcggcactgtaaaagtgaccggcattggacgcaacagtatgcagggtgatattcgctttgctgatgttctggaaaaaatgggcgcgaccatttgctggggcgatgattatatttcctgcacgcgtggtgaactgaacgccattgatatggatatgaaccatattcccgatgcggcgatgaccattgccaccgcggcgttatttgcaaaaggcaccaccacgctgcgcaatatctataactggcgtgttaaagagaccgatcgcctgtttgcgatggcaacagaactgcgtaaagtcggtgcggaagtcgaagaggggcatgatttcattcgcattacgccaccggaaaaactgaaatttgctgagatcgccacttataatgatcaccggatggcgatgtgtttctcgctggtcgcattatcagatacgcctgtgacgattcttgatccaaaatgtaccgctaaaacttttccagactatttcgagcaattggcgcggataagtcaacccggctga

SEQ ID NO: 2254 - protein, 427 aa, Escherichia coli
MESLTLQPIARVDGTINLPGSKSVSNRALLLAALAHGKTVLTNLLDSDDVRHMLNALTALGVSYTLSADRTRCEIIGNGGPLHAESARELFLGNAGTAMRPLAAALCLGSNDIVLTGEPRMKERPIGHLVDALRQGGAKITYLEQENYPPLRLQGGFTGGNVDVDGSVSSQFLTALLMTAPLAPEDTVIRIKGDLVSKPYIDITLNLMKTFGVEIENQHYQQFVVKGGQSYQSPGTYLVEGDASSASYFLAAAAIRGGTVKVTGIGRNSMQGDIRFADVLEKMGATICWGDDYISCTRGELNAIDMDMNHIPDAAMTIATAALFAKGTTTLRNIYNWRVKETDRLFAMATELRKVGAEVEEGHDFIRITPPEKLKFAEIATYNDHRMAMCFSLVALSDTPVTILDPKCTAKTFPDYFEQLARISQPG

SEQ ID NO: 2255 - DNA, 774 bp, Escherichia coli
atgattcacatgaagaatactaaattattgctggcgattgcgacctctgcagccttactgacaggatgtcagaatacgcacggtattaataccgatttggctatcagctcaggtctgaatgcttataaagccgcaacattaagcgatgctgatgctaaagcaatcgccaatcagggctgtgtcgaaatggacagcggcaataaagtggcaagcaaatccagcaagtacgggaaacgtctggcaaaaatcgccaaagcattgggtaacaatattaatggcacgccagtcaactataaggtttatatgaccagcgacgtcaacgcatgggcgatggcgaacggttgtgttcgtgtctacagtggcctgatggacatgatgaacgacaacgaaattgaaggcgttctgggccatgaactgggccacgtcgcgttgggtcactcgctggctgaaatgaaagcttcttatgcgatcgtggccgcacgcgatgccatttcagctaccagcggtgtggcttcccagctttcccgttcacaattaggtgatatcgcagaaggcgctatcaatgctaaatactcccgtgataaagaatccgaagcagatgatttctcttttgatctgttgaagaaacgtggcatcagtacccaggggctggttggtagctttgaaaaactggccagcctggatggcggtcgcactcagtccatgtttgattctcacccaccatcaacagagcgtgcgcaacacatccgtgatcgtatcgcctctggtaagtaa

SEQ ID NO: 2256 - protein, 257 aa, Escherichia coli
MIHMKNTKLLLAIATSAALLTGCQNTHGINTDLAISSGLNAYKAATLSDADAKAIANQGCVEMDSGNKVASKSSKYGKRLAKIAKALGNNINGTPVNYKVYMTSDVNAWAMANGCVRVYSGLMDMMNDNEIEGVLGHELGHVALGHSLAEMKASYAIVAARDAISATSGVASQLSRSQLGDIAEGAINAKYSRDKESEADDFSFDLLKKRGISTQGLVGSFEKLASLDGGRTQSMFDSHPPSTERAQHIRDRIASGK

SEQ ID NO: 2257 - DNA, 684 bp, Escherichia coli
atgacggcaattgccccggttattaccattgatggcccaagcggtgcagggaaaggcaccttgtgtaaggctatggcggaagcgttgcaatggcatctgctggattcgggtgcaatttatcgcgtactggcactagcggcattacatcaccatgttgatgttgcatcggaagatgcgctggtgccgctggcatcccatctggatgtacgttttgtgtcaaccaacggtaatctggaagtgatcctcgaaggggaagatgtcagcggcgaaattcgtactcaggaagtggcgaatgctgcttcacaagtcgcggcattcccacgcgttcgtgaagcattattgcgtcgccaacgcgcgtttcgcgaattaccaggcctgattgccgatggccgcgacatgggaacggtggtattccctgatgcgccagtgaaaattttccttgacgcctcctcggaagaacgtgcgcatcgccgcatgctacagttgcaggagaagggctttagtgttaactttgagcgccttttggccgagatcaaagaacgcgacgaccgcgatcgtaaccgagcggtagcgccactggttccggcagccgatgctttagtgttggattccaccaccttaagcattgagcaagtgattgaaaaagcgctacaatacgcgcgccagaaattggctctcgcataa

SEQ ID NO: 2258 - protein, 227 aa, Escherichia coli
MTAIAPVITIDGPSGAGKGTLCKAMAEALQWHLLDSGAIYRVLALAALHHHVDVASEDALVPLASHLDVRFVSTNGNLEVILEGEDVSGEIRTQEVANAASQVAAFPRVREALLRRQRAFRELPGLIADGRDMGTVVFPDAPVKIFLDASSEERAHRRMLQLQEKGFSVNFERLLAEIKERDDRDRNRAVAPLVPAADALVLDSTTLSIEQVIEKALQYARQKLALA

SEQ ID NO: 2259 - DNA, 1674 bp, Escherichia coli
atgactgaatcttttgctcaactctttgaagagtccttaaaagaaatcgaaacccgcccgggttctatcgttcgtggcgttgttgttgctatcgacaaagacgtagtactggttgacgctggtctgaaatctgagtccgccatcccggctgagcagttcaaaaacgcccagggcgagctggaaatccaggtaggtgacgaagttgacgttgctctggacgcagtagaagacggcttcggtgaaactctgctgtcccgtgagaaagctaaacgtcacgaagcctggatcacgctggaaaaagcttacgaagatgctgaaactgttaccggtgttatcaacggcaaagttaagggcggcttcactgttgagctgaacggtattcgtgcgttcctgccaggttctctggtagacgttcgtccggtgcgtgacactctgcacctggaaggcaaagagcttgaattcaaagtaatcaagctggatcagaagcgcaacaacgttgttgtttctcgtcgtgccgttatcgaatccgaaaacagcgcagagcgcgatcagctgctggaaaacctgcaggaaggcatggaagttaaaggtatcgttaagaacctcactgactacggtgcattcgttgatctgggcggcgttgacggcctgctgcacatcactgacatggcctggaaacgcgttaagcatccgagcgaaatcgtcaacgtgggcgacgaaatcactgttaaagtgctgaagttcgaccgcgaacgtacccgtgtatccctgggcctgaaacagctgggcgaagatccgtgggtagctatcgctaaacgttatccggaaggtaccaaactgactggtcgcgtgaccaacctgaccgactacggctgcttcgttgaaatcgaagaaggcgttgaaggcctggtacacgtttccgaaatggattggaccaacaaaaacatccacccgtccaaagttgttaacgttggcgatgtagtggaagttatggttctggatatcgacgaagaacgtcgtcgtatctccctgggtctgaaacagtgcaaagctaacccgtggcagcagttcgcggaaacccacaacaagggcgaccgtgttgaaggtaaaatcaagtctatcactgacttcggtatcttcatcggcctggacggcggcatcgacggcctggttcacctgtctgacatctcctggaacgttgcaggcgaagaagcagttcgtgaatacaaaaaaggcgacgaaatcgctgcagttgttctgcaggttgacgcagaacgtgaacgtatctccctgggcgttaaacagctcgcagaagatccgttcaacaactgggttgctctgaacaagaaaggcgctatcgtaaccggtaaagtaactgcagttgacgctaaaggcgcaaccgtagaactggctgacggcgttgaaggttacctgcgtgcttctgaagcatcccgtgaccgcgttgaagacgctaccctggttctgagcgttggcgacgaagttgaagctaaattcaccggcgttgatcgtaaaaaccgcgcaatcagcctgtctgttcgtgcgaaagacgaagctgacgagaaagatgcaatcgcaactgttaacaaacaggaagatgcaaacttctccaacaacgcaatggctgaagctttcaaagcagctaaaggcgagtaa

SEQ ID NO: 2260 - protein, 557 aa, Escherichia coli
MTESFAQLFEESLKEIETRPGSIVRGVVVAIDKDVVLVDAGLKSESAIPAEQFKNAQGELEIQVGDEVDVALDAVEDGFGETLLSREKAKRHEAWITLEKAYEDAETVTGVINGKVKGGFTVELNGIRAFLPGSLVDVRPVRDTLHLEGKELEFKVIKLDQKRNNVVVSRRAVIESENSAERDQLLENLQEGMEVKGIVKNLTDYGAFVDLGGVDGLLHITDMAWKRVKHPSEIVNVGDEITVKVLKFDRERTRVSLGLKQLGEDPWVAIAKRYPEGTKLTGRVTNLTDYGCFVEIEEGVEGLVHVSEMDWTNKNIHPSKVVNVGDVVEVMVLDIDEERRRISLGLKQCKANPWQQFAETHNKGDRVEGKIKSITDFGIFIGLDGGIDGLVHLSDISWNVAGEEAVREYKKGDEIAAVVLQVDAERERISLGVKQLAEDPFNNWVALNKKGAIVTGKVTAVDAKGATVELADGVEGYLRASEASRDRVEDATLVLSVGDEVEAKFTGVDRKNRAISLSVRAKDEADEKDAIATVNKQEDANFSNNAMAEAFKAAKGE

SEQ ID NO: 2261 - DNA, 285 bp, Escherichia coli
atgaccaagtcagaattgatagaaagacttgccacccagcaatcgcacattcccgccaagacggttgaagatgcagtaaaagagatgctggagcatatggcctcgactcttgcgcagggcgagcgtattgaaatccgcggtttcggcagtttctctttgcactaccgcgcaccacgtaccggacgtaatccgaagactggcgataaagtagaactggaaggaaaatacgttcctcactttaaaccaggtaaagaactgcgcgatcgcgccaatatttacggttaa

SEQ ID NO: 2262 - protein, 94 aa, Escherichia coli
MTKSELIERLATQQSHIPAKTVEDAVKEMLEHMASTLAQGERIEIRGFGSFSLHYRAPRTGRNPKTGDKVELEGKYVPHFKPGKELRDRANIYG

SEQ ID NO: 2263 - DNA, 2265 bp, Escherichia coli
atgaaaataacgacagtcggcgtatgcataatttgcggaatttttccgttgctgattttgccccaattgcctgggacagtaacccttgcgtttctgactctcttcgcctgtgtactggcatttatccctgttaaaaccgtccgttatatcgcgctgacgttgctgtttttcgtttggggcatattagcagcaaagcaaattttgtgggcaggagaaaccttaactggcgcgacgcaggatgcaattgttgagatcattgctactgacggcatgaccactcattacggtcaaattactcatctacaaggtcgacgtatattccctgcgccaggcctcgtactgtatggcgaatatcttccgcaagcggtttgtgccggacaagtatggtcaatgaaactcaaagttcgtgcagttcatggtcaacttaatgatggcggctttgatagccagcgttatgccattgcccagcatcaaccgctcaccggccgttttctgcaggcaagtgtcattgaaccgaattgtagcctgcgtgcacagtatctggcgtcactacaaacaacgctgcaaccctatatgtggaacgcggttattcttggattaggtataggggaacggttatccgtccccaaagaaatcaaaaatatcatgcgtgatactggaacggcgcatttaatggcgatatcaggattgcacatcgcttttgcggcgttgctggctgcaggactcattcgcggtgggcaagtttttctgcctgggtgctggatccactggcaaatgccattaattggtggaatctgctgtgctgctttttatgcctggcttacgggaatgcaacctcctgcattgcgtaccgtggtggcgcttgccatttggggaatgcttaagttaagtggacgacaatggagtggctgggatgtatggatatgttgtctggcggcaattttgctgatggatcctgttgccattctctcgcaaagtttatggctatctgccgctgcggtcgcggcactgattttttggtatcagtggtttccctgtccggagtggcagctgccgccggtattgcgcgcggttgtttccctcatccatctgcaactgggaatcaccctcctgcttatgcccgtgcaaattgtcatatttcatggcattagtctgacctcgtttattgcaaatctttttgcaattcccctggtgacatttatcacggttccgttgattctcgccgcgatggttgtgcatttaagcgggccgtttattctggaacaagggttatggtttcttgccgaccggtctttggctttacttttctgggggttaaagagtttgccggaagggtggatcaacattgctgaacgttggcaatggataacattttccccatggttcttactggtggtatggcgattaaacgcctggcgaacgttgccagcaatgtgtgtggctgtaggcttgctgatgtgcttgccgctgtggcaaaaacctcgacctgacgagtggcaagtgtacatgcttgatgtcgggcaagggctggcaatggtcattgcgcgaaacggcaaagcgattctctatgacacgggactggcctggcccgaaggggatagtgggcaacaactgattatcccctggctccactggcataatcttgaaccggaaggcgttattttgagtcatgaacatctggatcaccggggagggctggactcaatattgcacacatggccgatgttatggatccgaagtccgttaaactgggaacatcatcagccctgtgtgcgtggcgaagcgtggcaatggcaaggattgcgtttcagcgcgcactggcctttacaaggtagcaacgataaaggaaataaccattcctgtgtggttaagattgatgacgggacgaatagcattcttctaaccggtgatattgaagcccccgctgaacaaaagatgctaagccgttactggcagcaaatgcaggcaacattacttcaggtacctcaccatggcagtaatacctcatcatcgttgccattaattcagcgagtgaatggaaaagtggcactcgcatcggcatcgcgctataacgcatggcgactgccctcaagcaaagttaaacatcgctatcaacaacagggctataagtggcttgatactccacatcagggtcaaataacggtcaatttttcagcgcaaggctggcggattagcagcctcagagagcaaattttacctcgttggtatcatcagtggtttggcgtgccagtggataacgggtag

SEQ ID NO: 2264 - protein, 754 aa, Escherichia coli
MKITTVGVCIICGIFPLLILPQLPGTVTLAFLTLFACVLAFIPVKTVRYIALTLLFFVWGILAAKQILWAGETLTGATQDAIVEIIATDGMTTHYGQITHLQGRRIFPAPGLVLYGEYLPQAVCAGQVWSMKLKVRAVHGQLNDGGFDSQRYAIAQHQPLTGRFLQASVIEPNCSLRAQYLASLQTTLQPYMWNAVILGLGIGERLSVPKEIKNIMRDTGTAHLMAISGLHIAFAALLAAGLIRGGQVFLPGCWIHWQMPLIGGICCAAFYAWLTGMQPPALRTVVALAIWGMLKLSGRQWSGWDVWICCLAAILLMDPVAILSQSLWLSAAAVAALIFWYQWFPCPEWQLPPVLRAVVSLIHLQLGITLLLMPVQIVIFHGISLTSFIANLFAIPLVTFITVPLILAAMVVHLSGPFILEQGLWFLADRSLALLFWGLKSLPEGWINIAERWQWITFSPWFLLVVWRLNAWRTLPAMCVAVGLLMCLPLWQKPRPDEWQVYMLDVGQGLAMVIARNGKAILYDTGLAWPEGDSGQQLIIPWLHWHNLEPEGVILSHEHLDHRGGLDSILHTWPMLWIRSPLNWEHHQPCVRGEAWQWQGLRFSAHWPLQGSNDKGNNHSCVVKIDDGTNSILLTGDIEAPAEQKMLSRYWQQMQATLLQVPHHGSNTSSSLPLIQRVNGKVALASASRYNAWRLPSSKVKHRYQQQGYKWLDTPHQGQITVNFSAQGWRISSLREQILPRWYHQWFGVPVDNG

SEQ ID NO: 2265 - DNA, 1749 bp, Escherichia coli
atgcataacgacaaagatctctctacgtggcagacgttccgccgactgtggccaaccattgcgccttttaaagcgggtctgatcgtggcgggcgtagcgttaatcctcaacgcagccagcgataccttcatgttatcgctccttaagccacttcttgatgatggctttggtaaaacagatcgctccgtgctgatgtggatgccgctggtggtgatcgggctgatgattttacgtggtatcaccagctatatctccagctactgtatctcctgggtatcaggaaaggtggtaatgactatgcgtcgccgcctgtttggtcacatgatgggaatgccggtttcattctttgacaaacagtcaacgggtacgctgttgtcacgtatcacctacgattccgaacaggtcgcttcttcttcttccggcgcactgattactgttgtgcgtgaaggtgcgtcgatcatcggcctgttcatcatgatgttctattacagttggcaactgtcgatcattttgattgtgctggcaccgattgtttcgattgcgattcgcgttgtatcgaagcgttttcgcaacatcagtaaaaacatgcagaacaccatggggcaggtgaccaccagcgccgaacaaatgctgaaaggccataaagaagtattgattttcggtggtcaggaagtggaaacgaaacgcttcgataaagtcagcaaccgaatgcgtcttcaggggatgaaaatggtttcagcctcttccatctctgatccgatcattcagctgatcgcctctttggcgctggcgtttgttctgtatgcggcaagcttcccaagtgtcatggatagcctgactgccggtacgattaccgttgttttctcttcaatgattgcacttatgcgtccgctgaaatcgctgaccaacgttaacgcccagttccagcgcggtatggcggcttgtcagacgctgtttaccattctggacagtgagcaggagaaagacgaaggtaagcgcgtgatcgagcgtgcgactggcgacgtggagtttcgcaatgtcacctttacttatccgggacgtgatgtgcccgcattgcgtaacatcaacctgaaaattccggcagggaagacggttgctctggttggacgatctggttcaggtaaatcaaccatcgccagcctaatcacacgtttttacgatattgatgaaggcgaaatcctgatggatggtcacgatctgcgcgagtataccctggcgtcgttacgtaaccaggttgctctggtgtcgcagaatgtccatctgtttaacgatacggttgccaacaacattgcttacgcaaggactgaacagtacagccgtgagcaaattgaagaagctgcgcgtatggcctacgccatggacttcatcaataagatggataacggtctcgatacagtcattggtgaaaacggcgtgttgctctctggcggtcagcgtcagcgtattgctatcgctcgagccttgttgcgtgatagcccgatactgattctggacgaagctacctcggcgttggataccgaatccgaacgtgcgattcaggcggcactggatgagttgcagaaaaaccgtacctctctggtgattgcccaccgcttgtctaccattgaaaaggcagacgaaatcgtggttgtcgaggatggtgtcattgtggaacgcggtacgcataacgatttgcttgagcaccgtggcgtttacgcgcaacttcacaaaatgcagtttggccaatga

SEQ ID NO: 2266 - protein, 582 aa, Escherichia coli
MHNDKDLSTWQTFRRLWPTIAPFKAGLIVAGVALILNAASDTFMLSLLKPLLDDGFGKTDRSVLMWMPLVVIGLMILRGITSYISSYCISWVSGKVVMTMRRRLFGHMMGMPVSFFDKQSTGTLLSRITYDSEQVASSSSGALITVVREGASIIGLFIMMFYYSWQLSIILIVLAPIVSIAIRVVSKRFRNISKNMQNTMGQVTTSAEQMLKGHKEVLIFGGQEVETKRFDKVSNRMRLQGMKMVSASSISDPIIQLIASLALAFVLYAASFPSVMDSLTAGTITVVFSSMIALMRPLKSLTNVNAQFQRGMAACQTLFTILDSEQEKDEGKRVIERATGDVEFRNVTFTYPGRDVPALRNINLKIPAGKTVALVGRSGSGKSTIASLITRFYDIDEGEILMDGHDLREYTLASLRNQVALVSQNVHLFNDTVANNIAYARTEQYSREQIEEAARMAYAMDFINKMDNGLDTVIGENGVLLSGGQRQRIAIARALLRDSPILILDEATSALDTESERAIQAALDELQKNRTSLVIAHRLSTIEKADEIVVVEDGVIVERGTHNDLLEHRGVYAQLHKMQFGQ

SEQ ID NO: 2267 - DNA, 987 bp, Escherichia coli
atgatcgaaaaaatctggtctggtgaatcccctttatggcggctattgctgccactctcctggttgtatggcctggtgagtggcgcgatccgtctttgctataaactaaaactgaagcgcgcctggcgtgcccccgtaccggttgtcgtggttggtaatctcaccgcaggcggcaacggaaaaaccccggtcgttgtctggctggtggaacagctgcaacagcgcggtattcgcgtgggggttgtatcgcggggatatggtggtaaggctgaatcttatccgctgttattgtcggcagataccaccacagcacaggcgggtgatgaacctgtgttgatttatcaacgcactggcgcacctgttgcggtttctcccgtgcgttctgacgcggtaaaagccattctggcgcaacaccctgatgtgcagatcatcgtaaccgacgatggtttacagcattatcgtctggcgcgtgatgtggaaattgtcgttattgatggtgtgcgtcgctttggcaatggctggtggttgccggcggggccaatgcgtgagcgagcggggcgcttaaagtcggttgatgcggtaatcgtcaacggcggtgtcccccgcagcggtgaaatccccatgcatctgctgccgggtcaggcggtgaatttacgtaccggtacgcgttgtgacgttgctcagcttgaacatgtggtggcgattgcggggattgggcatccgccgcgcttttttgccacgctgaagatgtgcggcgtacaaccggaaaaatgtgtaccgctggccgatcatcagtctttgaatcatgcggatgtcagcgcgttggtaagcgccggacaaacgctggtaatgactgaaaaagatgcggtgaaatgccgggcctttgcagaagaaaattggtggtatttgcctgtagacgcacagctttcaggtgatgaaccagcgaaactgcttgcgcaactaacctcgctggcttctggccactag

SEQ ID NO: 2268 - protein, 328 aa, Escherichia coli
MIEKIWSGESPLWRLLLPLSWLYGLVSGAIRLCYKLKLKRAWRAPVPVVVVGNLTAGGNGKTPVVVWLVEQLQQRGIRVGVVSRGYGGKAESYPLLLSADTTTAQAGDEPVLIYQRTGAPVAVSPVRSDAVKAILAQHPDVQIIVTDDGLQHYRLARDVEIVVIDGVRRFGNGWWLPAGPMRERAGRLKSVDAVIVNGGVPRSGEIPMHLLPGQAVNLRTGTRCDVAQLEHVVAIAGIGHPPRFFATLKMCGVQPEKCVPLADHQSLNHADVSALVSAGQTLVMTEKDAVKCRAFAEENWWYLPVDAQLSGDEPAKLLAQLTSLASGH

SEQ ID NO: 2269 - DNA, 1233 bp, Escherichia coli
atgtcgctgccgcacctctcccttgctgatgcgcgtaatcttcaccttgccgcgcaaggcctgttaaacaaaccccgccgtcgagcgtcgttggaggatattccggcaacgatctcccgcatgtccttgctgcaaatcgataccatcaatattgttgtccgtagcccatatctggtgcttttcagccgtctgggagattatcctgcgcagtggctggatgagtctctggcgcgtggagaattaatggaatactgggcgcatgaagcctgctttatgccgcgtagcgattttcgtcttattcgccaccgcatgctggcacctgaaaaaatgggctggaaatataaagacgcctggatgcaggaacatgcggcggaaattgcactgttaattcagcatattcatgataaggggccggtacgttcagccgattttgagcatcctcgtaaaggggcgagcggctggtgggagtggaagccgcataaacgacatctggaaggtttatttactgccggaaaggtgatggtgattgaacggcgcaacttccagcgcgtttatgatttaactcaccgtgtcatgcctgactgggatgatgagcgcgatctcgtttcgcaagcagaagcagaaatcatcatgctggataacagtgcgcgtagcctgggaatatttcgcgaacagtggctggcagattactaccggctaaaacgtccggcactggcggcgtggcgtgaagcgagggctgaacagcagcaaatcattgctgtgcatgttgaaaaattgggcaatctttggctgcatgctgatttgctgccgctactcgagcgtgcgctcgccggaaagctcactgcaacgcacagcgcggtactttcgccttttgatcctgttgtctgggatcgcaaacgcgcggagcagctttttgattttagctaccggctggagtgctatatcccagcgccgaaacgccagtatggatattttgttctgccgttattacatcgtgggcaattagttgggcgaatggatgccaaaatgcatcgccagacaggcatccttgaagttatctctctgtggttacaggaaggcattaaaccaacgacaacgctgcaaaaagggttacgtcaggcgattactgatttcgctaactggcagcaggcaacgcgggtgacattaggacgctgcccgcaaggcctctttactgattgccgcgccggctgggaaatagaccccgtcgcataa

SEQ ID NO: 2270 - protein, 410 aa, Escherichia coli
MSLPHLSLADARNLHLAAQGLLNKPRRRASLEDIPATISRMSLLQIDTINIVVRSPYLVLFSRLGDYPAQWLDESLARGELMEYWAHEACFMPRSDFRLIRHRMLAPEKMGWKYKDAWMQEHAAEIALLIQHIHDKGPVRSADFEHPRKGASGWWEWKPHKRHLEGLFTAGKVMVIERRNFQRVYDLTHRVMPDWDDERDLVSQAEAEIIMLDNSARSLGIFREQWLADYYRLKRPALAAWREARAEQQQIIAVHVEKLGNLWLHADLLPLLERALAGKLTATHSAVLSPFDPVVWDRKRAEQLFDFSYRLECYIPAPKRQYGYFVLPLLHRGQLVGRMDAKMHRQTGILEVISLWLQEGIKPTTTLQKGLRQAITDFANWQQATRVTLGRCPQGLFTDCRAGWEIDPVA

SEQ ID NO: 2271 - DNA, 183 bp, Escherichia coli
atggatcatcgtctgcttgaaatcattgcctgcccggtttgcaacggaaaactttggtataaccaggaaaaacaagagcttatttgcaaactggacaacctggctttcccgctgcgcgatggcattccagtgttgctggaaacggaagcccgcgtgctgactgctgatgagagtaaatcatga

SEQ ID NO: 2272 - protein, 60 aa, Escherichia coli
MDHRLLEIIACPVCNGKLWYNQEKQELICKLDNLAFPLRDGIPVLLETEARVLTADESKS

SEQ ID NO: 2273 - DNA, 747 bp, Escherichia coli
atgagttttgtggtcattattcccgcgcgttacgcgtccacgcgtctgcccggtaaaccattggttgatattaacggcaaacccatgattgttcatgttcttgaacgcgcgcgcgaatcaggtgccgagcgcatcatcgtggcaaccgatcatgaggatgttgcccgcgctgttgaagccgctggcggcgaagtatgtatgacgcgcgccgatcatcagtcaggtacagaacgattggcggaagttgtcgaaaaatgcgcattcagcgacgacactgtgatcgttaatgtgcagggtgatgaaccgatgatccctgcgacaatcattcgtcaggttgctgataacctcgctcagcgtcaggtgggtatggcgactctggcggtgccaatccacaatgcggaagaagcgtttaacccgaatgcggtgaaagtggttctcgacgctgaagggtacgcactgtacttctctcgcgccaccattccgtgggatcgtgatcgttttgcaaaagaccttgaaaccgtaggcgataacttcctgcgtcatcttggtatttatggctaccgagcaggctttatccgtcgttatgttacctggcagccaagtccgttagaacatatcgaaatgttagagcagcttcgtgttctgtggtacggcgaaaaaatccacgttgctgtcgcccaggaagttcctggcacaggtgtggatacccctgaagatctcaagcgcgttcgcgccgaaatgcgctaa

SEQ ID NO: 2274 - protein, 248 aa, Escherichia coli
MSFVVIIPARYASTRLPGKPLVDINGKPMIVHVLERARESGAERIIVATDHEDVARAVEAAGGEVCMTRADHQSGTERLAEVVEKCAFSDDTVIVNVQGDEPMIPATIIRQVADNLAQRQVGMATLAVPIHNAEEAFNPNAVKVVLDAEGYALYFSRATIPWDRDRFAKDLETVGDNFLRHLGIYGYRAGFIRRYVTWQPSPLEHIEMLEQLRVLWYGEKIHVAVAQEVPGTGVDTPEDLKRVRAEMR

SEQ ID NO: 2275 - DNA, 630 bp, Escherichia coli
ttgttattgagtttgcaaccggtagccgaccgcctgctgcgtcccatcgaaagcacctatccgacatggaataattcgcaaaaagtggactatatcgtggtgctcggaggtggttatacctggaacccgcagtgggcaccaagctcgaatttaatcaataacagtctgccccgcctgaatgaaggtattcgcttatggcgcgaaaatccgggatcaaaactgatcttcacgggaggcgtagcaaaaaccaatacggtgagtacagccgaagtaagtgcaagagttgcgcaatcgctgggcgtgccgcgcgagcaaattatcactctggatttgccaaaagataccgaagaagaagctgcggcagtgaaacaggcaattggtgacgcccctttcctgctggtgacctccgcatcacatctgccgcgggcgatgatcttttttcagcaggaagggctaaatccgctgccagccccggcgaatcagttggccatcgactcgccgcttaatccgtgggaacgggcaatcccttctccggtttggttgatgcatagcgatcgtgttggctatgaaacgcttggccgcatctggcagtggctaaaaggttcgtcaggcgagccacggcaagagtga

SEQ ID NO: 2276 - protein, 209 aa, Escherichia coli
MLLSLQPVADRLLRPIESTYPTWNNSQKVDYIVVLGGGYTWNPQWAPSSNLINNSLPRLNEGIRLWRENPGSKLIFTGGVAKTNTVSTAEVSARVAQSLGVPREQIITLDLPKDTEEEAAAVKQAIGDAPFLLVTSASHLPRAMIFFQQEGLNPLPAPANQLAIDSPLNPWERAIPSPVWLMHSDRVGYETLGRIWQWLKGSSGEPRQE

SEQ ID NO: 2277 - DNA, 894 bp, Escherichia coli
atggaacagctgcgtgccgaattaagccatttactgggcgaaaaactcagtcgtattgagtgcgtcaatgaaaaagcggatacggcgttgtgggctttgtatgacagccagggaaacccaatgccgttaatggcaagaagctttagtgcgcccggaaaagcccgacaactggcatggaaaaccaccatgctggcaagaagtgggactgtccgtatgccgactatttatggtgtgatgacgcatgaagaacaccccggccccgatgtcctgctactggagcgaatgcgtggtgtttcggtggaggcaccagcccgaacaccagaacgctgggaacaactcaaagatcaaatcgttgaagccttactggcctggcaccgtcaggacagtcgtggttgcgtcggcgcggtcgacaatactcaggaaaatttctggccctcatggtaccggcaacatgttgaagtgctatggaccacgctcaatcagttcaataacaccggtctaacgatgcaggataagcggatcctgtttcgcactcgcgaatgtctcccggcattatttgaaggctttaacgacaattgtgtactgattcacggtaacttctgtttacgtagcatgctgaaagattcgcgcagcgatcagttactggcgatggtcggaccgggactaatgctttgggcaccgcgagaatacgaactgttccgactaatggataattctctggcggaagatttgctctggagttatctgcaacgcgcgccagtggcggagtcgttcatctggcggcgttggttgtatgtgttatgggatgaagttgcgcaactggtcaacaccggacgatttagtcggcgtaacttcgatctggcatcaaaatcactcttgccgtggctcgcctga

SEQ ID NO: 2278 - protein, 297 aa, Escherichia coli
MEQLRAELSHLLGEKLSRIECVNEKADTALWALYDSQGNPMPLMARSFSAPGKARQLAWKTTMLARSGTVRMPTIYGVMTHEEHPGPDVLLLERMRGVSVEAPARTPERWEQLKDQIVEALLAWHRQDSRGCVGAVDNTQENFWPSWYRQHVEVLWTTLNQFNNTGLTMQDKRILFRTRECLPALFEGFNDNCVLIHGNFCLRSMLKDSRSDQLLAMVGPGLMLWAPREYELFRLMDNSLAEDLLWSYLQRAPVAESFIWRRWLYVLWDEVAQLVNTGRFSRRNFDLASKSLLPWLA

SEQ ID NO: 2279 - DNA, 165 bp, Escherichia coli
atgaacccgtctggtgtaatatcgctggcgatcccttgctatatggtcaaaaaaggaaccagaaaggatgctttttacactgaaaaaagtgattggcaatatgttgctgccacttccgctgatgttgttgattattggcgctggcctggcgctgctgtggtttag

SEQ ID NO: 2280 - protein, 54 aa, Escherichia coli
MNPSGVISLAIPCYMVKKGTRKDAFYTEKSDWQYVAATSADVVDYWRWPGAAVV

SEQ ID NO: 2281 - DNA, 786 bp, Escherichia coli
atgcaggatcgcaattttgatgatattgcggaaaagttttcccgtaacatttacggcaccaccaaagggcagcttcgacaggctattctgtggcaggatctcgatcgcgtgctggcggaaatgggcccgcaaaaactgcgtgtgctggatgctggcggtggagaagggcagaccgcaatcaaaatggccgagcgcgggcatcaggtcattttatgcgatctttctgtgcagatgatcgaccgcgcaaaacaggcggcagaagcaaaaggtgtgagcgacaacatgcaatttatacattgcgccgctcaggatgttgcttcgcatttggaaacgcccgttgatctgatattgttccatgcggtgctcgagtgggtggccgatccccgcagcgtattacagaccctgtggtcagtgttgcgtccaggcggcgtgttgtcgttaatgttctacaatgcgcatggtttgttgatgcataacatggtcgccgggaattttgattacgtgcaggcgggaatgccgaaaaagaaaaaacggatgctttcgccagattatccacgcgacccggcgcaggtttatctgtggctggaagaagctggttggcaaattatgggtaagacaggcgttcgcgtgtttcatgattatctgcgcgagaagcaccagcagcgcgactgctatgaagcattacttgaattagaaacgcgttattgccgtcaggaaccgtatattaccctggggcgttatattcatgtcaccgcgcgcaaaccgcagagcaaggataaagtatga

SEQ ID NO: 2282 - protein, 261 aa, Escherichia coli
MQDRNFDDIAEKFSRNIYGTTKGQLRQAILWQDLDRVLAEMGPQKLRVLDAGGGEGQTAIKMAERGHQVILCDLSVQMIDRAKQAAEAKGVSDNMQFIHCAAQDVASHLETPVDLILFHAVLEWVADPRSVLQTLWSVLRPGGVLSLMFYNAHGLLMHNMVAGNFDYVQAGMPKKKKRMLSPDYPRDPAQVYLWLEEAGWQIMGKTGVRVFHDYLREKHQQRDCYEALLELETRYCRQEPYITLGRYIHVTARKPQSKDKV

SEQ ID NO: 2283 - DNA, 1323 bp, Escherichia coli
atgagtgaattttcccagacagtccccgaactggttgcctgggccagaaaaaatgacttctccatctcgctgccggtagaccgactctcttttctgctggcggttgccacgctgaacggcgagcgtctggatggtgagatgagtgaaggcgagctggtggatgcattccgctatgtgagtgatgcgtttgagcaaaccagcgaaaccatcggcgtgcgcgccaacaacgcgatcaacgacatggtgcgtcaacgtctgctgaaccgctttaccagcgagcaggcggaagggaacgcaatttaccgtctgacgccgctcggcatcggcatcactgactattacattcgtcagcgcgagttttctacgctgcgcctttctatgcaattgtcgattgtggcgggtgagctcaagcgcgcagcagatgccgccgaagagggcggtgatgaatttcactggcaccgtaatgtttatgcgccactgaaatattcggtagcagaaattttcgacagtatcgacctgacgcaacgtctgatggatgaacagcagcagcaggtgaaggatgatatcgcccagttgttgaacaaagactggcgggcggcgatttccagctgtgaattgttgctttcagaaacttccggaacgctgcgtgaattgcaggatacgctggaagcggcaggcgataaattgcaggccaacctgttacgcattcaggatgcgacgatgacccatgacgacctgcattttgtcgatcgtctggtgttcgatcttcagagcaaactcgaccgtattatcagttggggccagcaatccatcgacttgtggattggctacgaccgccacgtacacaaatttattcgtactgcgatcgatatggataaaaaccgcgtctttgctcagcggttacgtcagtcggtacaaacctattttgatgagccgtgggcgctaacttatgccaatgccgatcgtctgctggatatgcgtgacgaagagatggtactgcgcgatgaagaagtgactggggaacttcctgaggatctggagtacgaagagtttaacgagatccgcgaacagctggcggcgatcatcgaagaacaacttgccgtgtacaaaaccagacaagtgccgctggatcttggtctggtggtacgcgaatatctgtcacagtatccgcgtgcacgtcactttgacgttgcgcgcattgttattgatcaggcggtacgtcttggcgtagcgcaagcagatttcaccggactgccagcgaaatggcagccgattaatgattacggagccaaggtacaggcgcatgtcatcgacaaatattga

SEQ ID NO: 2284 - protein, 440 aa, Escherichia coli
MSEFSQTVPELVAWARKNDFSISLPVDRLSFLLAVATLNGERLDGEMSEGELVDAFRYVSDAFEQTSETIGVRANNAINDMVRQRLLNRFTSEQAEGNAIYRLTPLGIGITDYYIRQREFSTLRLSMQLSIVAGELKRAADAAEEGGDEFHWHRNVYAPLKYSVAEIFDSIDLTQRLMDEQQQQVKDDIAQLLNKDWRAAISSCELLLSETSGTLRELQDTLEAAGDKLQANLLRIQDATMTHDDLHFVDRLVFDLQSKLDRIISWGQQSIDLWIGYDRHVHKFIRTAIDMDKNRVFAQRLRQSVQTYFDEPWALTYANADRLLDMRDEEMVLRDEEVTGELPEDLEYEEFNEIREQLAAIIEEQLAVYKTRQVPLDLGLVVREYLSQYPRARHFDVARIVIDQAVRLGVAQADFTGLPAKWQPINDYGAKVQAHVIDKY

SEQ ID NO: 2285 - DNA, 732 bp, Escherichia coli
atgattacggagccaaggtacaggcgcatgtcatcgacaaatattgaacaagtgatgccggttaagctggcgcaggcgctggcgaatccgttatttccggcgctggatagcgccttacgttcaggccgtcatattggcctcgacgaactggataatcatgcattcctgatggattttcaggaatatctggaagagttttacgcgcgttataacgttgagcttattcgcgcaccggaagggttcttctatctacgcccacgttccaccacgctgatccctcgttccgtcttgtcggaactggatatgatggtcgggaaaatcctctgttatctctatctcagcccggaacggctggcgaatgaggggatttttactcaacaggaactgtacgacgaactgctcaccctggccgatgaagcgaaactgctgaaactggtgaacaaccgttcaaccggttcagacgttgaccgtcagaagttgcaggaaaaagtacgttcttcgctcaaccgtctgcgtcgtttaggcatggtgtggtttatgggccacgacagcagcaagttccgcattaccgaatcggtgttccgcttcggcgccgatgtgcgtgctggcgacgatccccgtgaagcacagcgtcgcctgattcgtgatggtgaagcaatgccgattgaaaatcatctgcaactcaacgatgaaaccgaagagagtcagccagatagcggagaggaagaataa

SEQ ID NO: 2286 - protein, 243 aa, Escherichia coli
MITEPRYRRMSSTNIEQVMPVKLAQALANPLFPALDSALRSGRHIGLDELDNHAFLMDFQEYLEEFYARYNVELIRAPEGFFYLRPRSTTLIPRSVLSELDMMVGKILCYLYLSPERLANEGIFTQQELYDELLTLADEAKLLKLVNNRSTGSDVDRQKLQEKVRSSLNRLRRLGMVWFMGHDSSKFRITESVFRFGADVRAGDDPREAQRRLIRDGEAMPIENHLQLNDETEESQPDSGEEE

SEQ ID NO: 2287 - DNA, 4461 bp, Escherichia coli
atgattgaacgcggtaaatttcgctcactgacgctgattaactggaacggcttttttgcccgaacttttgaccttgacgagctggtcacgacgctttctggcggtaacggggcgggtaaatccaccaccatggcggcgttcgttacggcgcttatccccgacctgaccctgctgcatttccgtaacactacggaagccggggccaccagcggttcgcgcgataaaggtctgcacggtaagctgaaagcgggtgtctgttattcgatgctcgacaccattaactcgcaccaccagcgcgtagtggtcggtgtgcgcctgcaacaggttgccggacgcgatcgtaaagtggatatcaaaccatttgccattcagggcctgccgatgtcggtgcagccgacacaactggtgaccgaaactctgaacgaacgccaggcgcgcgtgctgccgcttaatgagctgaaagacaagctcgaggcgatggaaggcgtgcagtttaagcagttcaactccattaccgattaccactcgctgatgttcgatctgggcatcatcgcgcgtcgtctgcgctcagcgtctgaccgtagtaaattctatcgtctgatcgaagcctcgctgtatggcgggatctccagcgccattactcgttctctgcgcgactacctgttgccggaaaacagcggggtgcggaaagcgttccaggacatggaagcggcgctgcgtgaaaaccgcatgacgctggaagcgattcgtgtcacccagtcggaccgtgacctgtttaagcatctgatcagcgaagccaccaactacgtggcggcggactacatgcgtcacgccaacgagcgccgtgttcatctcgataaggccctggagtttcgtcgcgagctacatacttcgcgtaagcaactggcggctgagcagtacaaacacgtcgacatggcgcgagagctggctgagcacaacggtgccgaaggcgatctggaagcggattatcaggcggccagcgatcacctgaacctggtgcaaaccgcactgcgtcagcaggagaagatcgaacgctacgaagcggatctcgatgagctgcagatccgtctggaagagcaaaacgaagtggtggcagaagccatcgaacgccaggaagagaacgaggctcgtgcggaagctgccgaactggaagtggacgagctgaaaagccagcttgctgactaccagcaggcgctggacgtccagcaaacgcgcgcgatccagtataaccaggcgattgctgcgcttaatcgtgccaaagaactgtgccatctgccggacttaaccgccgacagcgctgccgaatggctggaaaccttccaggcgaaagagctggaagcgaccgaaaaaatgctctctcttgagcagaaaatgagcatggcgcaaaccgcgcacagccagtttgagcaggcttatcagctggtggtggcaatcaacggcccgctggcgcgtaacgaggcgtgggatgtcgctcgcgaactattgcgcgaaggggtcgatcagcgtcacctggcagagcaggttcagccgttgcggatgcgcttaagcgaactggaacagcgtctgcgtgagcagcaagaagctgagcgtctgctggcagatttctgcaaacgtcagggcaagaattttgatattgatgaactggaagctctgcatcaggagctggaagcacgcattgcctctctttccgatagcgtctctaacgcccgagaagagcggatggcactgcgccaggagcaggaacagctgcagtctcgcattcagagtttgatgcagcgtgcgccggtttggctggcagcgcaaaacagtctcaaccagttgagcgaacagtgcggcgaagagttcacctccagccaggatgtcaccgaatttctgcaacagttgctggagcgtgagcgcgaggcaattgttgaacgcgatgaagtaggcgcgcgcaaaaacgccgtcgatgaagagatcgaacgtttaagccagccaggtggttctgaagatcagcgtctgaacgcgctggcggagcgttttggtggtgtgctgctgtcagaaatttatgacgacgttagcctggaagatgcgccgtacttctcagcgctgtatggcccgtcacgccacgccatcgtggtgccagatctgtcacaggtaaccgaacacctggaaggcttgaccgattgcccggaagatctctatctgatcgaaggggatccgcagtcattcgatgacagcgtgttcagcgttgatgagctggaaaaagcggtggtggtgaaaatcgccgatcgtcagtggcgttattcacgtttcccggaagtgccgctgtttggtcgtgctgcgcgtgaaagccgtattgaaagcctccatgccgagcgggaagtgctttccgaacgcttcgccacgctctcctttgatgtacagaaaacccagcgtctgcatcaggcgttcagccgctttatcggcagtcatctggcggtggcgtttgagtctgacccggaagcagaaatccgtcaactgaacagccgtcgcgtcgaactggaacgggcgttgagtaatcatgaaaatgataaccagcagcagcgtattcagtttgagcaggcgaaagagggcgttacggcgctgaaccgcattctgccgcgtctcaacctgttggctgatgacagcctggcggatcgcgtcgatgaaatccgcgaacgtctggatgaagcccaggaagccgcgcgttttgttcagcagtttggcaatcaactggcgaaactggaaccgatcgtttcggtattgcagagcgacccggaacagttcgaacagttaaaagaagattacgcgtactctcagcagatgcagcgcgatgcccgtcagcaggcgtttgccctgacggaagtggtgcagcgtcgtgcgcactttagctactctgactcggcagaaatgcttagcggtaacagcgatctcaacgaaaaactgcgtgaacgtctggaacaggcggaagcggagcgtacccgcgctcgtgaagcgttgcgcggacacgcagcgcagttgaatcagtacaaccaggtgctggcttcgctgaaaagttcgtatgacaccaaaaaagagctacttaacgatctgcaacgtgaattgcaggatatcggcgtgcgtgctgatagcggggcagaagagcgggcacgtattcgccgtgacgagttgcacgcgcaactgagcaataaccgttcacgacgcaatcaactggaaaaagcgcttacattctgcgaagcggagatggacaacctgacccgtaaactgcgcaagctggagcgggattactttgagatgcgcgagcaggtagtgaccgccaaagcgggctggtgtgcggtgatgcgcatggtgaaagataatggcgttgagcgtcgcttacaccgtcgtgagctggcttatctctccgctgatgatttgcgttccatgtcggataaggcgttaggtgcgctgcgtctggcggtggcagataacgaacatctgcgcgacgtgctgcggatgtcggaagatccaaaacgtccggaacgtaaaattcagttcttcgtggcggtttatcagcatctgcgtgaacgtattcgtcaggatattattcgtaccgatgatccggtggaagctatcgaacagatggagatcgagcttagccgtctgaccgaagaattaacctcccgtgaacagaaactggcgatcagttcccgcagcgtggcgaacatcattcgcaaaaccattcagcgcgagcagaaccgtatccgtatgctcaaccaggggttgcagaacgtatcgtttggccaggtgaacagcgtacgtctgaacgtgaacgtacgtgaaacgcacgccatgctgctggatgtgctctctgaacagcacgagcagcatcaggatctgtttaacagcaaccgcctgaccttctcagaagcgctggcgaaactgtatcaacgtcttaacccgcagattgatatggggcagcgcacgccgcagaccatcggtgaagaactgctggattaccgcaactatctggaaatggaagttgaggttaaccgtggttccgatggctggttgcgtgcagagtctggtgcattgtcgaccggtgaggcgattggtaccggtatgtcgattctggtgatggtggtacaaagctgggaagatgaatctcgccgcctgcgcggtaaagatatctctccttgccgcctgctgttcctcgatgaagcagcgcgactggacgcccgttccatcgccacgctgtttgaattgtgtgaacgtttgcaaatgcagctcattatcgcagcgccggaaaatatcagcccggagaaaggcaccacctataaactggtgcgtaaagtcttccagaataccgaacacgttcacgtcgtcggcctgcgaggatttgcgccgcaacttcctgaaacgcttccaggaagtgacgaagcgccttctcaggcgagttaa

SEQ ID NO: 2288 - protein, 1486 aa, Escherichia coli
MIERGKFRSLTLINWNGFFARTFDLDELVTTLSGGNGAGKSTTMAAFVTALIPDLTLLHFRNTTEAGATSGSRDKGLHGKLKAGVCYSMLDTINSHHQRVVVGVRLQQVAGRDRKVDIKPFAIQGLPMSVQPTQLVTETLNERQARVLPLNELKDKLEAMEGVQFKQFNSITDYHSLMFDLGIIARRLRSASDRSKFYRLIEASLYGGISSAITRSLRDYLLPENSGVRKAFQDMEAALRENRMTLEAIRVTQSDRDLFKHLISEATNYVAADYMRHANERRVHLDKALEFRRELHTSRKQLAAEQYKHVDMARELAEHNGAEGDLEADYQAASDHLNLVQTALRQQEKIERYEADLDELQIRLEEQNEVVAEAIERQEENEARAEAAELEVDELKSQLADYQQALDVQQTRAIQYNQAIAALNRAKELCHLPDLTADSAAEWLETFQAKELEATEKMLSLEQKMSMAQTAHSQFEQAYQLVVAINGPLARNEAWDVARELLREGVDQRHLAEQVQPLRMRLSELEQRLREQQEAERLLADFCKRQGKNFDIDELEALHQELEARIASLSDSVSNAREERMALRQEQEQLQSRIQSLMQRAPVWLAAQNSLNQLSEQCGEEFTSSQDVTEFLQQLLEREREAIVERDEVGARKNAVDEEIERLSQPGGSEDQRLNALAERFGGVLLSEIYDDVSLEDAPYFSALYGPSRHAIVVPDLSQVTEHLEGLTDCPEDLYLIEGDPQSFDDSVFSVDELEKAVVVKIADRQWRYSRFPEVPLFGRAARESRIESLHAEREVLSERFATLSFDVQKTQRLHQAFSRFIGSHLAVAFESDPEAEIRQLNSRRVELERALSNHENDNQQQRIQFEQAKEGVTALNRILPRLNLLADDSLADRVDEIRERLDEAQEAARFVQQFGNQLAKLEPIVSVLQSDPEQFEQLKEDYAYSQQMQRDARQQAFALTEVVQRRAHFSYSDSAEMLSGNSDLNEKLRERLEQAEAERTRAREALRGHAAQLNQYNQVLASLKSSYDTKKELLNDLQRELQDIGVRADSGAEERARIRRDELHAQLSNNRSRRNQLEKALTFCEAEMDNLTRKLRKLERDYFEMREQVVTAKAGWCAVMRMVKDNGVERRLHRRELAYLSADDLRSMSDKALGALRLAVADNEHLRDVLRMSEDPKRPERKIQFFVAVYQHLRERIRQDIIRTDDPVEAIEQMEIELSRLTEELTSREQKLAISSRSVANIIRKTIQREQNRIRMLNQGLQNVSFGQVNSVRLNVNVRETHAMLLDVLSEQHEQHQDLFNSNRLTFSEALAKLYQRLNPQIDMGQRTPQTIGEELLDYRNYLEMEVEVNRGSDGWLRAESGALSTGEAIGTGMSILVMVVQSWEDESRRLRGKDISPCRLLFLDEAARLDARSIATLFELCERLQMQLIIAAPENISPEKGTTYKLVRKVFQNTEHVHVVGLRGFAPQLPETLPGSDEAPSQAS

SEQ ID NO: 2289 - DNA, 1848 bp, Escherichia coli
atgttgcttaatatgatgtgtggtcgtcggctgtcggcaatcagtttgtgcctggccgtaacattcgctccactgttcaatgcgcaggccgatgagcctgaagtaatccctggcgacagcccggtggctgtcagtgaacagggcgaggcactgccgcaggcgcaagccacggcaataatggcggggatccagccattgcctgaaggtgcggctgaaaaagcccgcacgcaaatcgaatctcaattacccgcaggttataagccggtttatcttaaccagcttcaattgttgtatgccgcacgcgatatgcaacccatgtgggaaaaccgtgatgctgttaaagccttccagcaacagctggcagaggtggcgattgccggtttccagccgcagtttaataaatgggtagagttactgaccgatcctggtgttaacgggatgacacgcgacgtggtgctctctgatgcgatgatgggctatctccatttcattgcaaatattccggtcaaaggcactcgctggctatatagcagtaaaccttatgcgctttcaacgccgccgctttcggtgattaaccaatggcagctggcgctggatcaaggtcaattgcctacgtttgttgcaggactggcaccgcagcatccgcaatatgcggcgatgcatgaatcgttactggccttactcagtgacaccaaaccgtggcctcaactgaccggtaaagcaacgttgcgcccaggacagtggagtaacgacgtaccggcgttgcgcgaaatattgcaacgtacaggcatgttggacgggggaccgaaaattacgctacctggcgatgacacgccaactgacgcggtagtcagcccatccgctgttactgttgaaacagcagaaactaagctgatggacaaacaaactacgtctcgtagtaaacctgcgcctgccgttcgcgccgcctacgataatgaactggtggaagccgttaaacgttttcaggcatggcaaggattgggagcagatggtgctattggcccggcaacgcgtgactggttaaacgtaacgcccgcccagcgtgctggcgtgttggcactcaacatccagcgattgcgcttgctgccaacagagctttctaccgggatcatggttaacattccagcctattcgctggtctactatcagaacggcaatcaggtgctggattcgcgagtcattgtcggtcgccccgatcgcaaaacgccgatgatgagcagtgcccttaacaacgtggtggtaaacccgccgtggaacgtcccaccaactctggcacgcaaagatattctgccgaaagtgcgcaatgatcctgggtatctcgaaagccatggctatacggtgatgcgcggctggaacagcagagaagcgattgacccatggcaggttgactggtctacaatcacggcctcgaatttaccgttccgcttccagcaggctccaggcccacggaactcgctggggcgctataaattcaatatgccgagttcagaggccatttatttgcatgacacgccgaaccacaatctgttcaagcgtgatacacgcgcattgagctcaggctgtgtacgagtgaataaagcttccgatctggcgaatatgctgttgcaggatgcaggctggaatgacaaacgtatttctgatgcgctgaagcagggcgatacgcgttacgtcaatattcggcagtcgattccggtgaatctctactatctgacggcctttgttggtgcagatggtcgtacccagtatcgtacagatatttacaattatgatctgcctgcgcgatccagctcgcaaatcgtatcgaaagcggaacaattaatcaggtaa

SEQ ID NO: 2290 - protein, 615 aa, Escherichia coli
MLLNMMCGRRLSAISLCLAVTFAPLFNAQADEPEVIPGDSPVAVSEQGEALPQAQATAIMAGIQPLPEGAAEKARTQIESQLPAGYKPVYLNQLQLLYAARDMQPMWENRDAVKAFQQQLAEVAIAGFQPQFNKWVELLTDPGVNGMTRDVVLSDAMMGYLHFIANIPVKGTRWLYSSKPYALSTPPLSVINQWQLALDQGQLPTFVAGLAPQHPQYAAMHESLLALLSDTKPWPQLTGKATLRPGQWSNDVPALREILQRTGMLDGGPKITLPGDDTPTDAVVSPSAVTVETAETKLMDKQTTSRSKPAPAVRAAYDNELVEAVKRFQAWQGLGADGAIGPATRDWLNVTPAQRAGVLALNIQRLRLLPTELSTGIMVNIPAYSLVYYQNGNQVLDSRVIVGRPDRKTPMMSSALNNVVVNPPWNVPPTLARKDILPKVRNDPGYLESHGYTVMRGWNSREAIDPWQVDWSTITASNLPFRFQQAPGPRNSLGRYKFNMPSSEAIYLHDTPNHNLFKRDTRALSSGCVRVNKASDLANMLLQDAGWNDKRISDALKQGDTRYVNIRQSIPVNLYYLTAFVGADGRTQYRTDIYNYDLPARSSSQIVSKAEQLIR

SEQ ID NO: 2291 - DNA, 558 bp, Escherichia coli
ttgattatcatggacaaattcgacgctaatcgccgcaaactgctggcgcttggtggcgttgcactcggtgccgccatcctgccgaccccggcgtttgcaacactctctaccccacgcccgcgcattttgacactcaataatcttcataccggagagtcaatcaaagcggagtttttcgatggcagaggctatattcaggaagaattggcaaaacttaaccattttttccgcgattaccgcgcgaacaaaataaagtccatcgacccaggattattcgaccagttgtatcgcctgcaagggttgttaggcacccgcaaaccggtgcaactcatttccggttatcgttccattgataccaacaatgaactacgcgcccgcagccgtggagtagcgaagaaaagctatcacactaaaggccaggcgatggatttccacattgaaggtatcgcgttaagcaatattcgcaaagccgcgttatctatgcgcgcaggtggtgtaggatattacccacgtagtaactttgtgcatattgataccgggccagcacggcactggtag

SEQ ID NO: 2292 - protein, 185 aa, Escherichia coli
MIIMDKFDANRRKLLALGGVALGAAILPTPAFATLSTPRPRILTLNNLHTGESIKAEFFDGRGYIQEELAKLNHFFRDYRANKIKSIDPGLFDQLYRLQGLLGTRKPVQLISGYRSIDTNNELRARSRGVAKKSYHTKGQAMDFHIEGIALSNIRKAALSMRAGGVGYYPRSNFVHIDTGPARHW

SEQ ID NO: 2293 - DNA, 648 bp, Escherichia coli
atgaactatcgtattattccggtcaccgcattctcccagaactgttcattgatctggtgtgaacaaacccgtctggccgcactggtcgatcctggcggcgatgcggaaaaaatcaaacaggaagttgatgccagcggcctgacactgatgcagatcctgctgactcatggtcatctggaccacgttggcgcagcggcggaactggcgcaacattacggcgtgccggtttttggcccggaaaaagaagatgagttctggctgcaaggcttgcctgcgcaaagtcgtatgtttggtctggaagagtgccagccgctgacgccagatcgttggctgaacgaaggcgataccatcagcatagggaatgtgactttacaggtgttacattgccctgggcatacgccgggtcatgtcgtgttttttgatgatcgggcaaagctgctgatttctggcgacgttattttcaaaggtggagtagggcgcagtgacttcccgcgtggcgatcataatcaactgatttcttcaatcaaagataaattgctgccactgggggatgacgtgacatttattccgggtcacggaccattatccacacttggttatgagcgcctgcataatcccttcctgcaagacgaaatgcccgtctggtaa

SEQ ID NO: 2294 - protein, 215 aa, Escherichia coli
MNYRIIPVTAFSQNCSLIWCEQTRLAALVDPGGDAEKIKQEVDASGLTLMQILLTHGHLDHVGAAAELAQHYGVPVFGPEKEDEFWLQGLPAQSRMFGLEECQPLTPDRWLNEGDTISIGNVTLQVLHCPGHTPGHVVFFDDRAKLLISGDVIFKGGVGRSDFPRGDHNQLISSIKDKLLPLGDDVTFIPGHGPLSTLGYERLHNPFLQDEMPVW

SEQ ID NO: 2295 - DNA, 1191 bp, Escherichia coli
atgtttgagaacattaccgccgctcctgccgacccgattctgggcctggccgatctgtttcgtgccgatgaacgtcccggcaaaattaacctcgggattggtgtctataaagatgagacgggtaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccgggtggcactggcgcactacgcgtggctgccgatttcctggcaaaaaataccagcgttaagcgtgtgtgggtgagcaacccaagctggccgaaccataagagcgtctttaactctgcaggtctggaagttcgtgaatacgcttattatgatgcggaaaatcacactcttgacttcgatgcactgattaacagcctgaacgaagcccaggctggcgacgtagtgctgttccatggctgctgccataacccaaccggcatcgaccctacgctggaacaatggcagacactggcacaactctccgttgagaaaggctggttaccgctgtttgacttcgcttaccagggttttgcccgtggcctggaagaagatgctgaaggactgcgcgctttcgcggctctgcataaggagctgattgttgccagttcctactctaaaaactttggcctgtacaacgagcgtgttggcgcttgtactctggttgctgctgacagtgaaactgttgaacgcgcattcagccaaatgaaagcggcgattcgtgctaactactctaacccaccagcacacggcgcttctgttgttgccaccatcctgagcaacgatgcgttacgtgcgatttgggaacaagaactgactgatatgcgccagcgtattcagcgtatgcgtcagttgttcgtcaatacgctgcaggaaaaaggcgcaaatcgcgacttcagctttatcatcaaacagaacggcatgttctccttcagtggcctgacaaaagaacaagtgctgcgtctgcgcgaagagtttggcgtatatgctgttgcttctggtcgcgtaaacgtggccgggatgacaccagataacatggcgccgctgtgcgaagcgattgtggcagtgctgtaa

SEQ ID NO: 2296 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAALHKELIVASSYSKNFGLYNERVGACTLVAADSETVERAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 2297 - DNA, 1089 bp, Escherichia coli
atgatgaagcgcaatattctggcagtgatcgtccctgctctgttagtagcaggtactgcaaacgctgcagaaatctataacaaagatggcaacaaagtagatctgtacggtaaagctgtcggtctgcattatttctccaagggtaacggtgaaaacagttacggtggcaatggtgacatgacctatgcccgtcttggttttaaaggggaaactcaaatcaattccgatctgaccggttatggtcagtgggaatataacttccagggtaacaactctgagggcgctgacgctcaaactggtaacaaaacgcgtctggcattcgcgggtcttaaatacgctgacgttggttctttcgattacggccgtaactacggtgtggtttatgatgcactgggttacaccgatatgctgccagaatttggtggtgatactgcatacagcgatgatttcttcgttggtcgtgttggcggcgttgctacctatcgtaactccaacttctttggtctggttgatggtctgaacttcgctgttcagtacctgggtaaaaacgagcgtgacactgcacgccgctctaacggcgacggtgttggcggttctatcagctacgaatacgaaggctttggtatcgttggtgcttatggtgccgctgaccgtaccaacctgcaggaagagtcttcccttggcaaaggcaaaaaagctgaacagtgggctactggtctgaagtatgacgcgaacaacatctacctggcagcgaactacggtgaaacccgtaacgctacgccgatcactaataaatttacaaacaccagcggcttcgccaacaaaacgcaagacgttctgttagttgcgcaataccagtttgatttcggtctgcgtccgtccatcgcttacaccaaatctaaagcgaaagacgtagaaggtatcggtgatgttgatctggtgaactactttgaagtgggcgcaacctactatttcaacaaaaacatgtccacctatgttgactacatcatcaaccagatcgattctgacaacaaactgggcgtaggttctgacgacaccgttgctgtgggtatcgtttaccagttctaa

SEQ ID NO: 2298 - protein, 362 aa, Escherichia coli
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEESSLGKGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 2299 - DNA, 1401 bp, Escherichia coli
atgagcgttgtgcctgtagccgacgtactccagggccgcgtagccgttgacagcgaagtcaccgtgcgcggatgggtacgtacccgccgagattcaaaagctggcatctccttcctcgccgtttatgacggttcctgctttgatcctgtacaggctgtcatcaataattctctgcccaattacaatgaagacgtcttgcgtctgaccaccggctgctcggtcattgtgacgggtaaagtcgtggcgtcgccgggccaggggcaacaatttgaaattcaggccagcaaggttgaagttgctggttgggttgaagatccagacacttacccgatggcggcaaaacgccacagcattgagtatctgcgtgaagtcgctcacctgcgtccgcgcacaaacctgattggtgccgtcgcgcgcgttcgccatacgctggcgcaggcgctgcatcgcttctttaacgagcagggattcttctgggtttcaacgccactgattaccgcatctgataccgaaggtgctggcgaaatgttccgtgtttcaacgctggatctggaaaacctgccgcgtaacgatcagggcaaagtagatttcgacaaagacttctttggtaaagagtctttcctgaccgtatctggccagttgaacggcgaaacctacgcttgcgcattatccaaaatttataccttcggcccgactttccgtgctgaaaactccaacaccagccgtcacctggcggaattctggatgctggagccagaagtggcgtttgctaacctgaacgatatcgcgggtctggctgaagccatgctgaaatatgtcttcaaagcggttctcgaagaacgcgctgacgacatgaaattcttcgctgaacgcgtagataaagatgccgtttcacgcctggaacgcttcattgaggccgatttcgcgcaggtggattacaccgacgcagtgaccattctcgaaaactgcggcaggaagtttgaaaacccggtttactggggcgtcgatctctcttctgagcatgagcgttatctggcggaagaacactttaaagcaccggtagtggttaaaaactatccgaaagatattaaagcgttctatatgcgccttaacgaagacggtaaaaccgttgcggctatggacgttctggctccgggcatcggtgagatcattggtggctcccagcgtgaagaacgtctggacgtgctggacgagcgtatgcttgaaatgggcctgaacaaagaagattactggtggtatcgcgatctgcgtcgctacggtactgttccgcattcaggtttcggtcttggttttgaacgcctgattgcttacgtaactggcgtgcaaaacgtacgtgatgttattccgttcccacgtactccgcgtaacgccagcttctaa

SEQ ID NO: 2300 - protein, 466 aa, Escherichia coli
MSVVPVADVLQGRVAVDSEVTVRGWVRTRRDSKAGISFLAVYDGSCFDPVQAVINNSLPNYNEDVLRLTTGCSVIVTGKVVASPGQGQQFEIQASKVEVAGWVEDPDTYPMAAKRHSIEYLREVAHLRPRTNLIGAVARVRHTLAQALHRFFNEQGFFWVSTPLITASDTEGAGEMFRVSTLDLENLPRNDQGKVDFDKDFFGKESFLTVSGQLNGETYACALSKIYTFGPTFRAENSNTSRHLAEFWMLEPEVAFANLNDIAGLAEAMLKYVFKAVLEERADDMKFFAERVDKDAVSRLERFIEADFAQVDYTDAVTILENCGRKFENPVYWGVDLSSEHERYLAEEHFKAPVVVKNYPKDIKAFYMRLNEDGKTVAAMDVLAPGIGEIIGGSQREERLDVLDERMLEMGLNKEDYWWYRDLRRYGTVPHSGFGLGFERLIAYVTGVQNVRDVIPFPRTPRNASF

SEQ ID NO: 2301 - DNA, 1251 bp, Escherichia coli
atgtttattgtactaaacgctcctgtacgaggacgctactgcgcacctatgacacaattcgcttctcctgttctgcactcgttgctggatacagatgcttataagttgcatatgcagcaagccgtgtttcatcactattacgatgtgcatgtcgcggcggagtttcgttgccgaggtgacgatctgctgggtatttatgccgatgctattcgtgaacaggttcaggcgatgcagcacctgcgcctgcaggatgatgaatatcagtggctctctgccctgcctttctttaaggctgactatcttaactggctacgcgagttccgctttaacccggaacaagtcaccgtgtccaacgataatggcaagctggatattcgtttaagcggcccgtggcgtgaagtcatcctctgggaagttcctttgctggcggttatcagtgaaatggtacatcgctatcgctcaccgcaggccgacgttgcgcaagccctcgacacgctggaaaacaaattagtcgacttctcggcattaaccgccggtcttgatatgtcgcgcttccatctgatggattttggcacccgccgccgtttttctcgcgaagtacaagaaaccatcgtgaaacgtctgcaacaggaatcctggttcgtgggcaccagcaactacgatctggcgcgtcggctttccctcacgccgatgggaacacaggcacacgaatggttccaggcgcatcagcaaatcagcccggatctagccaacagccagcgagctgcacttgctgcctggctggaagagtatcccgaccaacttggcattgcgttaaccgactgcatcactatggatgctttcctgcgtgatttcggtgtcgagttcgccagtcgctatcagggcctgcgccatgactctggcgacccggttgaatggggtgaaaaagccattgcacattatgaaaagctgggaattgatccacagagtaaaacgctggttttctctgacaatctggatttacgcaaagcggttgagctataccgccacttctcttcccgcgtgcaattaagttttggtattgggactcgcctgacctgcgatatcccccaggtaaaacccctgaatattgtcattaagttggtagagtgtaacggtaaaccggtggcgaaactttctgacagccctggcaaaactatctgccacgataaagcgtttgttcgggcgctgcgcaaagcgttcgaccttccgcatattaaaaaagccagttaa

SEQ ID NO: 2302 - protein, 416 aa, Escherichia coli
MFIVLNAPVRGRYCAPMTQFASPVLHSLLDTDAYKLHMQQAVFHHYYDVHVAAEFRCRGDDLLGIYADAIREQVQAMQHLRLQDDEYQWLSALPFFKADYLNWLREFRFNPEQVTVSNDNGKLDIRLSGPWREVILWEVPLLAVISEMVHRYRSPQADVAQALDTLENKLVDFSALTAGLDMSRFHLMDFGTRRRFSREVQETIVKRLQQESWFVGTSNYDLARRLSLTPMGTQAHEWFQAHQQISPDLANSQRAALAAWLEEYPDQLGIALTDCITMDAFLRDFGVEFASRYQGLRHDSGDPVEWGEKAIAHYEKLGIDPQSKTLVFSDNLDLRKAVELYRHFSSRVQLSFGIGTRLTCDIPQVKPLNIVIKLVECNGKPVAKLSDSPGKTICHDKAFVRALRKAFDLPHIKKAS

SEQ ID NO: 2303 - DNA, 2613 bp, Escherichia coli
atgactcaacagccacaagccaaataccgtcacgattatcgtgcgccggattaccagattactgatattgacttgacctttgacctggacgcgcaaaagacggtcgttaccgcggtcagccaggctgtccgtcatggtgcatcagatgttccgcttcgtctcaacggcgaagacctcaaactggtttctgtttatattaatgatgagccgtggaccgcctggaaagaagaagagggcgcactggtcatcagtaatttgccggagcgttttacgcttaagatcgttaatgaaattagcccggcggcgaatactgcgctggaagggctttatcagtcaggcgatgcgctttgcacccagtgtgaagccgaaggtttccgccatattacgtattatctcgaccgcccggatgtgctggcgcgttttaccaccaaaattattgccgataaaaccaaatatcccttcctgctttccaacggtaaccgcgttgcgcaaggtgaactggaaaatggacgtcattgggtacggtggcaggacccgttcccgaaaccgtgctacctgtttgcgctggtggcaggcgactttgatgtgctgcgcgacactttcaccacgcgttctggtcgcgaagtagcgctggagctgtatgtcgatcgtggcaaccttgatcgtgcgccgtgggcaatgacctcgctgaaaaactccatgaaatgggatgaagaacgcttcggcctggagtatgacctcgacatctatatgatcgtcgcggtggatttcttcaatatgggcgcaatggagaataaggggctgaatatctttaactccaaatatgtgctggcccgcaccgacaccgccaccgacaaagattacctcgatattgaacgcgttatcggccatgaatatttccataactggaccggcaaccgtgtcacctgtcgcgactggttccagctcagtctgaaagaaggtttaaccgtcttccgcgatcaggaattcagctctgaccttggttcccgcgcggtaaaccgtatcaataatgtgcgcaccatgcgcggattgcagtttgcagaagacgccagcccgatggcgcacccaattcgcccggatatggtcattgaaatgaacaacttctacaccctgaccgtttacgagaagggcgcggaagtgattcgtatgatccacactctgcttggcgaagaaaacttccagaaagggatgcagctctatttcgagcgtcatgatggtagcgcagcgacctgtgacgactttgtgcaggcgatggaagatgcgtcgaatgtcgatctttcccatttccgccgttggtacagccaatccggcacgccggttgtgactgtcaaagacgactacaatccggaaactgagcagtacaccctgaccatcagccagcgcacgccagctacgccggatcaggcagaaaaacaaccgctgcatattccgtttgccgtcgaactgtatgacaacgaaggcaaagtgatcccgttgcagaaaggcggtcatccggtgaattccgtgctgaacgtcacccaggcggaacaaacctttgtttttgataatgtctacttccagccggtgcctgcgctgctgtgcgaattctctgcgccagtgaaactggaatataagtggagcgatcagcaactgaccttcctgatgcgtcatgcgcgtaatgatttctctcgctgggacgcggcgcaaagtttgctggcaacctacatcaagctgaacgtcgcccgtcatcagcaagggcagccgttgtctctgccggtgcatgtggctgacgctttccgcgcggtgctgctcgatgagaagattgatccggcgctggcggcagaaatcctgacgctgccttccgtcaatgaaatggcagaactgttcgatatcatcgacccgattgctattgccgaagtacgcgaagcactcactcgtactctggcgactgaactggcagatgagctgctggctatttacaacgcgaattaccagagcgagtaccgtgttgagcatgaagatattgcaaaacgcactctgcgtaatgcctgcctgcgcttcctcgcttttggtgaaacgcatctggctgacgtgctggtgagcaaacagttccacgaagcgaacaatatgaccgatgcgctggcggcgctttctgcggcggttgctgcacaactgccatgccgtgacgcgctgatgcaggagtacgacgacaagtggcatcaggatggtctggtgatggataaatggtttattctgcaagccaccagcccggcggcgaatgtgctggagacggtacgtggtctgttgcagcatcgctcatttaccatgagcaacccgaaccgcattcgttcattgattggcgcatttgcgggcagcaacccggcagcgttccatgccgaagatggcagcggttatcagttcctggtggaaatgcttaccgacctcaacagccgtaacccgcaggtggcttcacgcctgattgagccgctgattcgcctgaaacgttacgatgccaaacgtcaggagaaaatgcgcgcggcgctggaacagttgaaagggctggaaaatctctctggcgatctgtacgagaagatcaccaaagcactggcttga

SEQ ID NO: 2304 - protein, 870 aa, Escherichia coli
MTQQPQAKYRHDYRAPDYQITDIDLTFDLDAQKTVVTAVSQAVRHGASDVPLRLNGEDLKLVSVYINDEPWTAWKEEEGALVISNLPERFTLKIVNEISPAANTALEGLYQSGDALCTQCEAEGFRHITYYLDRPDVLARFTTKIIADKTKYPFLLSNGNRVAQGELENGRHWVRWQDPFPKPCYLFALVAGDFDVLRDTFTTRSGREVALELYVDRGNLDRAPWAMTSLKNSMKWDEERFGLEYDLDIYMIVAVDFFNMGAMENKGLNIFNSKYVLARTDTATDKDYLDIERVIGHEYFHNWTGNRVTCRDWFQLSLKEGLTVFRDQEFSSDLGSRAVNRINNVRTMRGLQFAEDASPMAHPIRPDMVIEMNNFYTLTVYEKGAEVIRMIHTLLGEENFQKGMQLYFERHDGSAATCDDFVQAMEDASNVDLSHFRRWYSQSGTPVVTVKDDYNPETEQYTLTISQRTPATPDQAEKQPLHIPFAVELYDNEGKVIPLQKGGHPVNSVLNVTQAEQTFVFDNVYFQPVPALLCEFSAPVKLEYKWSDQQLTFLMRHARNDFSRWDAAQSLLATYIKLNVARHQQGQPLSLPVHVADAFRAVLLDEKIDPALAAEILTLPSVNEMAELFDIIDPIAIAEVREALTRTLATELADELLAIYNANYQSEYRVEHEDIAKRTLRNACLRFLAFGETHLADVLVSKQFHEANNMTDALAALSAAVAAQLPCRDALMQEYDDKWHQDGLVMDKWFILQATSPAANVLETVRGLLQHRSFTMSNPNRIRSLIGAFAGSNPAAFHAEDGSGYQFLVEMLTDLNSRNPQVASRLIEPLIRLKRYDAKRQEKMRAALEQLKGLENLSGDLYEKITKALA

SEQ ID NO: 2305 - DNA, 768 bp, Escherichia coli
atgaatacggctcgtctgaaccagggcacaccattgttgctcaatgcagtaagcaaacattacgcggaaaatatcgtcctgaaccaactggatttacatattccggcaggtcagtttgtggcggtggtgggccgcagcggcggtggcaaaagtactctgctgcgcctgctggcaggtctggaaacgccaaccgcaggcgacgtgttagcgggcaccacaccgctggctgagattcaggatgatacgcgaatgatgtttcaggacgcgcgtctgctgccgtggaaatcggtgattgataacgttgggttaggccttaaaggccagtggcgcgatgcggcgcgtcaggctctggctgcggtagggctggagaatcgcgcgggggaatggcctgccgcactttctggcggacagaaacaacgtgtggcgctggcaagggcgctgattcatcgaccgggtttattgttgcttgatgaaccactcggtgcgctggacgctttaacgcgactcgagatgcaggatttgattgtgtcactctggcaggagcacggctttaccgtcttgctggtgacgcatgatgtgagcgaagcggtggcgatggctgaccgggtgttgttaattgaagagggaaaaattggtctggatttgacggtggatatcccccgtccgcgccggttagggtcggtacgattagcagagctggaagcggaagtgttgcagcgggtgatgcaacgtgggcactctgaacaaccgattcgacgtcatggttaa

SEQ ID NO: 2306 - protein, 255 aa, Escherichia coli
MNTARLNQGTPLLLNAVSKHYAENIVLNQLDLHIPAGQFVAVVGRSGGGKSTLLRLLAGLETPTAGDVLAGTTPLAEIQDDTRMMFQDARLLPWKSVIDNVGLGLKGQWRDAARQALAAVGLENRAGEWPAALSGGQKQRVALARALIHRPGLLLLDEPLGALDALTRLEMQDLIVSLWQEHGFTVLLVTHDVSEAVAMADRVLLIEEGKIGLDLTVDIPRPRRLGSVRLAELEAEVLQRVMQRGHSEQPIRRHG

SEQ ID NO: 2307 - DNA, 654 bp, Escherichia coli
atggcgttctggacgctctctgccagcggcgaattgtggcagcatctggcgatcagctcctggcgtgcgctgattggtttttcaattggcggatcgctgggattaattctggggctgattagcgggctgtcacgctggggtgagcgactgctggatacctccattcagatgttgcgcaacgtgccgcatctggcgctgatcccgctggtgattttgtggtttggcattgatgaatccgcaaaaatctttctggtggcgctcggtacgctattccccatttatatcaacacctggcatggcatccgtaatatcgaccgtgggctggtggagatggcacgtagctatggattatccggcataccgctgtttatccatgtgatcctgcctggtgccctgccctcaattatggtcggtgtgcgttttgcgttgggcctgatgtggctgacgctgatcgttgccgaaactatttctgccaattccggcattggttatctggcgatgaatgcgcgggagtttctgcaaacggacgtggtggtagtcgctattattctttacgccctgctcggcaaacttgctgacgtcagcgcgcagctgttagaacgtctctggttgcgctggaacccggcttatcatttgaaggaggccacggtatga

SEQ ID NO: 2308 - protein, 217 aa, Escherichia coli
MAFWTLSASGELWQHLAISSWRALIGFSIGGSLGLILGLISGLSRWGERLLDTSIQMLRNVPHLALIPLVILWFGIDESAKIFLVALGTLFPIYINTWHGIRNIDRGLVEMARSYGLSGIPLFIHVILPGALPSIMVGVRFALGLMWLTLIVAETISANSGIGYLAMNAREFLQTDVVVVAIILYALLGKLADVSAQLLERLWLRWNPAYHLKEATV

SEQ ID NO: 2309 - DNA, 1146 bp, Escherichia coli
atgagtctgaatatgttctggtttttaccgacccacggtgacgggcattatctgggaacggaagaaggttcacgtccggttgatcacggttatctgcaacaaattgcgcaagcggcggatcgtctgggctataccggtgtgctgatcccgacggggcgatcgtgtgaagatgcgtggctggtggcggcgtcgatgatcccggtgacacaacggctgaagtttcttgtcgccctgcgccccagcgtaacctcacctaccgttgccgcccgtcaggccgccacgcttgaccgtctctctaacggacgtgcgttgtttaacctggtcacaggcagcgatccacaagaactggcaggcgacggcgtgttccttgatcatagcgagcgttacgaagcctcggcagaatttacccaggtctggcggcggttgttgcttggcgagactgtggatttcaacggcaaacatattcatgtacgcggagccaaactgctcttcccgccgattcaacagccttatcctccgctttactttggcggatcgtcagatgtcgcccaggagctggcggcagaacaagttgatctctaccttacctggggcgaaccaccggaactggtaaaagagaaaatcgaacacgtgcgggcgaaagctgccgcgcatggacgcaaaattcgtttcggtgttcgtctgcatgtgattgttcgtgaaaccaacgacgaagcgtggcaggccgccgagcggttaatctcgcgtcttgatgatgaaactatcgccaaagcacaggccgcattcgcccgaacggattccgtaggacaacagcgaatggcggcgctacataacggcaagcgcgacaatctggagatcagccccaatttatgggcgggtgttggcttagtgcgcggcggtgccgggacggcgctggtgggcgatggtcctacggtcgccgcgcgaatcaacgaatacgctgcacttggcatcgacagttttgtgctttcgggctacccgcatctggaagaagcgtatcgggtcggcgagttactgttcccacatctggatgtcgccatcccggaaattccccagccacaaccgctgaatccacaaggcgaagcggtggcgaatgattttatcccccgtaacgtcgcgcaaagctaa

SEQ ID NO: 2310 - protein, 381 aa, Escherichia coli
MSLNMFWFLPTHGDGHYLGTEEGSRPVDHGYLQQIAQAADRLGYTGVLIPTGRSCEDAWLVAASMIPVTQRLKFLVALRPSVTSPTVAARQAATLDRLSNGRALFNLVTGSDPQELAGDGVFLDHSERYEASAEFTQVWRRLLLGETVDFNGKHIHVRGAKLLFPPIQQPYPPLYFGGSSDVAQELAAEQVDLYLTWGEPPELVKEKIEHVRAKAAAHGRKIRFGVRLHVIVRETNDEAWQAAERLISRLDDETIAKAQAAFARTDSVGQQRMAALHNGKRDNLEISPNLWAGVGLVRGGAGTALVGDGPTVAARINEYAALGIDSFVLSGYPHLEEAYRVGELLFPHLDVAIPEIPQPQPLNPQGEAVANDFIPRNVAQS

SEQ ID NO: 2311 - DNA, 102 bp, Escherichia coli
atgcccaccggtaaaaaccagggggcaacgcgcaataaccacttcttcactggcgttgccatcatcgtgttccttagctttgcgcgacgttacgggggataa

SEQ ID NO: 2312 - protein, 33 aa, Escherichia coli
MPTGKNQGATRNNHFFTGVAIIVFLSFARRYGG

SEQ ID NO: 2313 - DNA, 1002 bp, Escherichia coli
atgttcaggttcctgaccttctgtctctgcgaggtaatgcccatgcgtaagatcattaaactggcgctggcgggtttacttagcgtctctacacttgctgttgccgcggagtcttcgccagaggcgttacgtataggctatcaaaaaggcagtattggtatggtgctggcaaaaagccaccagttactggaaaaacgctatccgcaaacaaaaatctcctgggtggagttccccgctggcccacagatgctggaggcgttaaacgttggcagtatcgatctcggcagtaccggggatattccgccaatctttgcccaggctgccggggctgatttggtatacgtgggcgtcgagccaccgaaacccaaagccgaagtgattctggtggcagaaaacagcccgatcaaaaccgtagccgatcttaaaggtcacaaagttgcctttcagaaaggttccagttcgcacaatcttttactgcgagcccttcgccaggccgggcttaaattcacggatattcagcccacttacctgacgcctgccgatgcccgcgccgcgttccagcaaggtaacgttgacgcctgggctatctgggatccctactactccgctgcattattacagggcggcgtgcgggtgctgaaagacggcaccgatctcaatcaaactggatcgttttatctggcagctcgtccgtatgcagaaaaaaacggcgcttttattcagggtgtgctgacaacctttagtgaggccgatgcgttaacccgcagccagcgcgaacaaagcatcgctttactggcaaaaacgatgggcttaccggcaccggttattgcctcatatctggatcatcgtcctcccaccaccatcaaaccgttgagcgctgaagttgccgccttacagcagcaaacggcagatctgttttatgaaaaccgtctggtgccgaaaaaagtcgatattcgccagcgcatctggcagcccactcaactggaaggaaaacaattatga

SEQ ID NO: 2314 - protein, 333 aa, Escherichia coli
MFRFLTFCLCEVMPMRKIIKLALAGLLSVSTLAVAAESSPEALRIGYQKGSIGMVLAKSHQLLEKRYPQTKISWVEFPAGPQMLEALNVGSIDLGSTGDIPPIFAQAAGADLVYVGVEPPKPKAEVILVAENSPIKTVADLKGHKVAFQKGSSSHNLLLRALRQAGLKFTDIQPTYLTPADARAAFQQGNVDAWAIWDPYYSAALLQGGVRVLKDGTDLNQTGSFYLAARPYAEKNGAFIQGVLTTFSEADALTRSQREQSIALLAKTMGLPAPVIASYLDHRPPTTIKPLSAEVAALQQQTADLFYENRLVPKKVDIRQRIWQPTQLEGKQL

SEQ ID NO: 2315 - DNA, 576 bp, Escherichia coli
atgcgtgtcatcaccctggcgggtagtcctcgctttccttctcgctccagctccttgctggaatatgcgcgggaaaaactaaatggcctggatgtagaggtttatcactggaatttgcaaaacttcgtcccggaagatctgctttatgctcgtttcgatagtccggcactcaagaccttcaccgaacagctgcaacaggccgatgggctgattgtcgccacgcctgtgtataaagccgcctattccggtgcactgaaaaccctgctcgacctgctgccagaacgtgcgttgcaaggcaaagtggtgctgccgctggcgacaggcggcaccgtggcccatctgctggcggtcgattatgcccttaagccagttttaagtacgctgaaagcccaggagatcctgcacggcgtgtttgccgatgactcgcaagtaattgattaccaacacaaaccccagttcacgccaaatctgcaaactcgtcttgataccgcgctagaaactttctggcaggcgttgcaccgccgcgatgttcaggttcctgaccttctgtctctgcgaggtaatgcccatgcgtaa

SEQ ID NO: 2316 - protein, 191 aa, Escherichia coli
MRVITLAGSPRFPSRSSSLLEYAREKLNGLDVEVYHWNLQNFVPEDLLYARFDSPALKTFTEQLQQADGLIVATPVYKAAYSGALKTLLDLLPERALQGKVVLPLATGGTVAHLLAVDYALKPVLSTLKAQEILHGVFADDSQVIDYQHKPQFTPNLQTRLDTALETFWQALHRRDVQVPDLLSLRGNAHA

SEQ ID NO: 2317 - DNA, 1011 bp, Escherichia coli
atgtactaccccttcgttcgtaaagcccttttccagctcgatccagagcgcgctcatgagtttacttttcagcaattacgccgtattacaggaacgccgtttgaagcactggtgcggcagaaagtgcctgcgaaacctgttaactgcatgggcctgacgtttaaaaatccgcttggtctggcagccggtcttgataaagacggggagtgcattgacgcgttaggcgcgatgggatttggatccatcgagatcggtaccgtcacgccacgtccccagccaggtaatgacaagccgcgtctctttcgtctggtagatgccgaaggtttgatcaaccgtatgggctttaataatcttggcgttgataacctcgtagagaacgtaaaaaaagcccattatgacggcgttctgggtattaacatcggcaaaaataaagatacgccggtggagcagggtaaagatgactatctgatttgtatggaaaaaatctatgcctatgcgggatatatcgccatcaatatttcatcgccaaataccccaggattacgcacactgcaatatggtgaagcgctggatgatctcttaactgcgattaaaaataaacaaaatgatttgcaagtgatgcaccataaatatgtgccgatcgcagtgaagatcgcgccggatctttctgaagaagaattgatccaggttgccgatagtttagttcgccataatattgatggcgttattgcaaccaataccacactcgatcgttctctggttcagggaatgaaaaattgtgatcaaaccggtggcttaagtggtcgtccgcttcagttaaaaagcaccgaaattattcgccgcttgtcacaggaattaaacggacgcttgccgattattggtgttggcggcattgactcggttatcgctgcgcgtgaaaagattgctgcgggtgcctcactggtgcaaatttattctggttttatttttaaaggcccgccgctgattaaagaaatcgttacccatatctaa

SEQ ID NO: 2318 - protein, 336 aa, Escherichia coli
MYYPFVRKALFQLDPERAHEFTFQQLRRITGTPFEALVRQKVPAKPVNCMGLTFKNPLGLAAGLDKDGECIDALGAMGFGSIEIGTVTPRPQPGNDKPRLFRLVDAEGLINRMGFNNLGVDNLVENVKKAHYDGVLGINIGKNKDTPVEQGKDDYLICMEKIYAYAGYIAINISSPNTPGLRTLQYGEALDDLLTAIKNKQNDLQVMHHKYVPIAVKIAPDLSEEELIQVADSLVRHNIDGVIATNTTLDRSLVQGMKNCDQTGGLSGRPLQLKSTEIIRRLSQELNGRLPIIGVGGIDSVIAAREKIAAGASLVQIYSGFIFKGPPLIKEIVTHI

SEQ ID NO: 2319 - DNA, 543 bp, Escherichia coli
atgcgaattaaaccagacgataactggcgttggtattacgatgaagagcacgatcgaatgatgctcgatttagccaatggtatgctatttcgctcacgttttgcgcgcaaaatgttgactccagatgccttttctcccgcaggtttttgcgttgatgacgccgcgctctatttctcttttgaagaaaagtgccgcgattttaatttatctaaagaacaaaaagccgaactggtgctgaatgcactggtagcaattcgttatctcaaaccgcaaatgccgaaaagctggcattttgtatctcatggtgaaatgtggatgcccatgccgggcgatgcggcctacgtttggttgagcgacactcatgagcaagtgaatttactggtcgttgaatctggcgagaatgccgcgctatgtctactggcacaaccctgcgttgttattgcgggtcgcgcgatgcagttgggcgacgccattaaaatcatgaacgacaggctgaaaccgcaggttaatgttgacagcttcagcctcgaacaggcagtctaa

SEQ ID NO: 2320 - protein, 180 aa, Escherichia coli
MRIKPDDNWRWYYDEEHDRMMLDLANGMLFRSRFARKMLTPDAFSPAGFCVDDAALYFSFEEKCRDFNLSKEQKAELVLNALVAIRYLKPQMPKSWHFVSHGEMWMPMPGDAAYVWLSDTHEQVNLLVVESGENAALCLLAQPCVVIAGRAMQLGDAIKIMNDRLKPQVNVDSFSLEQAV

SEQ ID NO: 2321 - DNA, 1110 bp, Escherichia coli
gtggcgacattaacccggctttttattcatcctgttaaatcgatgcgcggcattggtcttacacataccctggcagatgtcagtggtctggccttcgatcgcatctttatgatcactgaaactgacggtacgtttattaccgctcgccagtttccgctaatggtacggtttactccttcacccgtgcatgatggcttgcatctcaccgcaccagatggcagtagtgcatatgttcgttttgctgatttcgccacacaagacgcaccaaccgaagtttggggcacacattttaccgcgcgaattgcgccagacgcgatcaacaaatggctaagtggatttttctcccgcgaagtgcaattacgctgggtggggccacaaatgacccggcgcgtgaaacgccacaacactgtacccctgtcatttgctgatggctatccttaccttcttgctaacgaggcctcgttacgtgatctccaacaacgttgtccggccagtgtaaaaatggagcaattccgccccaatctggtggtttccggtgcatcggcctgggaagaagatagctggaaagtgattcgcattggtgatgtcgtgtttgatgtggttaagccttgtagccgctgtattttcaccaccgtcagcccagaaaaagggcaaaaacatccggcaggcgaaccattaaaaacgctgcaatctttccgtactgcccaggataacggcgatgtcgattttggtcagaatttaattgtccgtaatagcggcgtgattcgcgttggcgatgaggtggaaattctggcaacggctccggctaaaatttacggcgcaggtgccgctgatgatactgccaacatcacgcaacaaccggacgcaaacgtagatattgactggcagggacaggcatttcgtggaaataaccaacaggtgctgctggagcaattagaaaatcagggaattcgtatcccttattcttgccacgcgggcatttgtggaagttgccgtgttcagcttttagaaggcgaagtcacgccgctaaaaaaatcagcaataggcgatgatggcactattctttgctgtagttgtgtaccgaagactgcgcttaagctggcgcgttag

SEQ ID NO: 2322 - protein, 369 aa, Escherichia coli
MATLTRLFIHPVKSMRGIGLTHTLADVSGLAFDRIFMITETDGTFITARQFPLMVRFTPSPVHDGLHLTAPDGSSAYVRFADFATQDAPTEVWGTHFTARIAPDAINKWLSGFFSREVQLRWVGPQMTRRVKRHNTVPLSFADGYPYLLANEASLRDLQQRCPASVKMEQFRPNLVVSGASAWEEDSWKVIRIGDVVFDVVKPCSRCIFTTVSPEKGQKHPAGEPLKTLQSFRTAQDNGDVDFGQNLIVRNSGVIRVGDEVEILATAPAKIYGAGAADDTANITQQPDANVDIDWQGQAFRGNNQQVLLEQLENQGIRIPYSCHAGICGSCRVQLLEGEVTPLKKSAIGDDGTILCCSCVPKTALKLAR

SEQ ID NO: 2323 - DNA, 2109 bp, Escherichia coli
atgaattctctgtttgccagtacggcccgtgggctggaagagctgttaaaaactgaactggaaaacctgggggccgttgaatgccaggtggttcagggtggggtccatttcaagggcgacacacggcttgtttaccagagcctgatgtggagccgcctggcctcgcgtattatgttgccgctgggcgagtgtaaggtttacagcgatttagacctctatctcggtgttcaggcgatcaactggacagagatgtttaatcctggcgcgaccttcgctgtccacttcagtggtttgaatgacaccatacgcaacagtcagtacggtgcgatgaaagtgaaagacgcgatcgtcgatgctttcacgcggaaaaatctgccgcgtccaaatgttgatcgcgatgcgccggatatccgcgttaacgtctggctgcataaagaaaccgccagtatcgcccttgatctcagtggtgatggtttacatctgcgtggctatcgcgatcgtgctggcatggcgccgatcaaagaaaccctggcagccgctattgtgatgcgatccggctggcagccaggaacaccgctgctcgatccaatgtgtggttcaggtacgttgctgattgaagcggctatgttggcgaccgaccgcgcaccgggcttgcaccgtgggcgttggggctttagcggctggacgcagcatgatgaagctatctggcaggaagtgaaagcggaagcgcaaactcgtgcccgtaaaggcctggcggagtatagctcccatttcttcggttcggacagtgacgcacgggtgattcaacgtgcgcgcactaacgcccgtcttgcggggattggtgaactgatcacctttgaggtgaacgatgtcgcgcaactggccaatccgctgccgaaagggccgtacggtacagtgttgagcaacccgccatacggtgaacgtctggacagcgaaccggcgctgattgcgctgcatagtctgctgggccgaatcatgaaaaaccagttcggtggctggaatctctctttgtttagtgcctcgccggatctgctaagctgcctgcagctgcgtgcagacaaacagtacaaggcgaaaaacggcccgctggactgcgtacagaaaaactaccatgttgccgaaagcacaccagacagcaaaccggtaatggcagcggaagactacgccaaccgtctgcgtaagaacctcaaaaaattcgagaagtgggctcgccaggaaggaattgaatgttaccgcctgtatgacgccgatctgccggaatataacgttgccgttgaccgttatgccgactgggtggtggtgcaggagtatgcgccgccaaaaactattgatgcgcacaaagcgcgtcagcgtctgttcgatattatcgctgcaaccatttcggtactggggattgcgccaaacaaactggtgctgaaaacccgtgaacgccagaagggcaaaaatcaataccagaaactgggcgagaagggcgagtttctggaagttaccgaatataacgctcacttgtgggtgaacctgacggattacctcgataccggtctgttcctcgatcaccgtatcgcccgtcgtatgctcggtcagatgagcaaaggcaaagatttcctcaacctgttctcttataccggcagcgccaccgtgcatgcgggattaggcggtgcacgcagcaccaccaccgtggatatgtcgcgtacttatctggagtgggcagaacgcaacctgcgtctgaatggcctaaccgggcgtgcgcatcgcctgattcaggccgatkgcctggcgtggctgcgtgaggcaaatgaacagtttgatctgatctttatcgatccgccaaccttctctaactcaaaacgaatggaagatgcgtttgatgttcagcgcgatcatctggcgctgatgaaagatttgaaacgtctgctgcgtgcaggtgggacgatcatgttctcgaacaacaaacgcggcttccgtatggatctcgacggcctggcgaaactgggactgaaagcacaagaaattacgcaaaaaacgctctcccaggatttcgcccgtaaccgccagatccacaactgctggctgattaccgcagcctga

SEQ ID NO: 2324 - protein, 702 aa, Escherichia coli
  Xaa 598: Xaa is any amino acid
MNSLFASTARGLEELLKTELENLGAVECQVVQGGVHFKGDTRLVYQSLMWSRLASRIMLPLGECKVYSDLDLYLGVQAINWTEMFNPGATFAVHFSGLNDTIRNSQYGAMKVKDAIVDAFTRKNLPRPNVDRDAPDIRVNVWLHKETASIALDLSGDGLHLRGYRDRAGMAPIKETLAAAIVMRSGWQPGTPLLDPMCGSGTLLIEAAMLATDRAPGLHRGRWGFSGWTQHDEAIWQEVKAEAQTRARKGLAEYSSHFFGSDSDARVIQRARTNARLAGIGELITFEVNDVAQLANPLPKGPYGTVLSNPPYGERLDSEPALIALHSLLGRIMKNQFGGWNLSLFSASPDLLSCLQLRADKQYKAKNGPLDCVQKNYHVAESTPDSKPVMAAEDYANRLRKNLKKFEKWARQEGIECYRLYDADLPEYNVAVDRYADWVVVQEYAPPKTIDAHKARQRLFDIIAATISVLGIAPNKLVLKTRERQKGKNQYQKLGEKGEFLEVTEYNAHLWVNLTDYLDTGLFLDHRIARRMLGQMSKGKDFLNLFSYTGSATVHAGLGGARSTTTVDMSRTYLEWAERNLRLNGLTGRAHRLIQADXLAWLREANEQFDLIFIDPPTFSNSKRMEDAFDVQRDHLALMKDLKRLLRAGGTIMFSNNKRGFRMDLDGLAKLGLKAQEITQKTLSQDFARNRQIHNCWLITAA

SEQ ID NO: 2325 - DNA, 1908 bp, Escherichia coli
atgtcattaatcagtatgcatggcgcatggctgtcgttcagcgacgcgccgcttctcgataacgcagaactgcatatcgaagataacgaacgtgtttgtctggtggggcgtaacggtgcaggcaaatcaacgttaatgaagatcctcaaccgtgaacaggggctggatgacggtcgcattatttatgagcaagatttgattgtagctcgtctgcaacaggatccgccgcgtaacgttgagggtagcgtttatgatttcgttgccgaaggcattgaagaacaagcggaatacctgaaacgctatcacgatatttcgcgcctggtgatgaacgacccgagcgagaaaaatctcaacgaactggcgaaggttcaggaacagctggatcaccacaacctgtggcagctggaaaaccgcatcaacgaagtgctggcgcaactgggattagatcctaatgttgcgctgtcgtcgctttccggcggctggttgcgtaaagcggcattaggacgcgcgctggtgagcaatccgcgcgtattgctgctcgacgaaccgactaaccacctggatattgaaaccatcgactggctggaagggttcctcaaaaccttcaatgggacaattattttcatttcccacgaccgttcgtttatccgcaatatggcgacgcgcattgttgatctcgatcgcggcaagctggtgacctatccagggaattacgaccagtacctgctggaaaaagaagaagccctgcgcgtggaagaattacaaaatgccgagttcgatcgcaaactggcgcaggaagaggtgtggatccgccaggggatcaaagcacgtcgtacccgtaatgaaggccgcgtacgcgccctgaaagcaatgcgtcgcgagcgtggtgaacgtcgcgaagtaatgggtaccgcaaagatgcaggtggaagaagccagccgctccggtaagatcgttttcgaaatggaggacgtttgctaccaggttgacggtaagcaactggtgaaagatttttctgcccaggttctacgcggcgacaaaattgccctgattggtccgaatgggtgcggcaaaaccacgctgctgaaactaatgctcggtcagcttcaagcagacagcgggcgtattcacgttggcaccaaactggaagtagcttatttcgatcagcaccgcgcggaactggatcccgataaaacggtgatggataaccttgccgaaggtaagcaagaggtgatggttaacggcaagccacgccacgtattgggctatttgcaggacttcctgttccatccgaaacgcgcgatgacgccagtacgtgcactttctggcggagagcggaaccgcttgctgttggcgcgtttgttcctcaaaccaagcaacttattgattcttgacgaaccgaccaacgatcttgatgtcgaaacgctggaactgctggaagaactgatcgacagctatcagggcacggtattgctggttagccacgatcgtcagtttgtcgataacaccgttacagaatgctggatcttcgaaggcggcggtaaaattggtcgttatgtcggcggttatcatgatgcccgtggtcagcaagaacagtatgtggcgctcaaacagcctgcggtgaaaaaaatcgaagaagccgccgcgccaaaagcagaaactgtaaaacgcagcagtagcaaactaagctataaattgcagcgcgaactggagcagctaccgcaattgctcgaagatctggaggcgaagctggaagccctacagacgcaagtggcggatgcttccttcttcagtcagccccatgagcagacacaaaaagtgctcgccgatatggctgctgcagagcaggagctggagcaagcctttgaacgctgggagtatcttgaagcgttaaaaaatggtggctga

SEQ ID NO: 2326 - protein, 635 aa, Escherichia coli
MSLISMHGAWLSFSDAPLLDNAELHIEDNERVCLVGRNGAGKSTLMKILNREQGLDDGRIIYEQDLIVARLQQDPPRNVEGSVYDFVAEGIEEQAEYLKRYHDISRLVMNDPSEKNLNELAKVQEQLDHHNLWQLENRINEVLAQLGLDPNVALSSLSGGWLRKAALGRALVSNPRVLLLDEPTNHLDIETIDWLEGFLKTFNGTIIFISHDRSFIRNMATRIVDLDRGKLVTYPGNYDQYLLEKEEALRVEELQNAEFDRKLAQEEVWIRQGIKARRTRNEGRVRALKAMRRERGERREVMGTAKMQVEEASRSGKIVFEMEDVCYQVDGKQLVKDFSAQVLRGDKIALIGPNGCGKTTLLKLMLGQLQADSGRIHVGTKLEVAYFDQHRAELDPDKTVMDNLAEGKQEVMVNGKPRHVLGYLQDFLFHPKRAMTPVRALSGGERNRLLLARLFLKPSNLLILDEPTNDLDVETLELLEELIDSYQGTVLLVSHDRQFVDNTVTECWIFEGGGKIGRYVGGYHDARGQQEQYVALKQPAVKKIEEAAAPKAETVKRSSSKLSYKLQRELEQLPQLLEDLEAKLEALQTQVADASFFSQPHEQTQKVLADMAAAEQELEQAFERWEYLEALKNGG

SEQ ID NO: 2327 - DNA, 93 bp, Escherichia coli
gtgcttcgcggcatgatgatgttcgcacattggtactccttaatgatgcgctattttacagatgacgaacaaagtgttggttttcatgcctga

SEQ ID NO: 2328 - protein, 30 aa, Escherichia coli
MLRGMMMFAHWYSLMMRYFTDDEQSVGFHA

SEQ ID NO: 2329 - DNA, 1203 bp, Escherichia coli
atgctggtggcgttaccgcgccttgagcatggtcagaaagcggcatgtccccggtgtggcacaacgttaaccgtggcgtgggatgcccctcggcagcgtcccaccgcctatgcgttggctgcactgttcatgctgttgctgtccaacttgtttccttttgtgaatatgaacgttgcaggagttaccagtgaaattacattactggaaattcccggcgtgcttttttctgaggactacgccagcctcggcacctttttcctgttgtttgtgcaactggttcccgcgttttgtctgataaccattctgttactggtgaatcgcgcggaattaccggtccgtttaaaagagcaactggcacgggtgctttttcaactcaaaacctggggaatggcggagattttcctcgcgggtgtgctggtcagtttcgtgaaactgatggcttacggcagcattggggtaggcagcagctttctcccctggtgtttattttgtgtcctgcaactgcgcgcttttcagtgtgttgatcgtcgctggttatgggacgacatcgccccgatgccagaactgcgccagccgctaaaaccaggtgtcacggggatacgtcaggggctgcgttcgtgctcctgttgtacggcaatccttcctgctgatgaatccgtgtgcccgcgttgtagtaccaaagggtacgttcggcgtagaaacagcctgcagtggacactcgcgctgcttgtaacgtccatcatgctgtatcttccggctaatattttgcccatcatggtgacggatttattaggctcgaagatgccgtcgacgattctcgctggggtcattctgttatggagcgaaggctcttatcccgtcgctgcggtgatttttctggccagtattatggtgccaacgttaaagatgatcgccattgcgtggctgtgttgggatgccaaaggacacggcaagcgcgacagtgaaagaatgcatttgatttatgaagttgttgagtttgtaggccgctggtcgatgattgacgttttcgttatcgcggtgctctcggcgctggtgcgtatgggaggtttaatgagtatttatccggcaatgggtgcattaatgtttgctttagtcgtcataatgacaatgttttctgctatgacgtttgacccgcgtttgtcgtgggatcgtcaacctgaatcagagcatgaggagtcctga

SEQ ID NO: 2330 - protein, 400 aa, Escherichia coli
MLVALPRLEHGQKAACPRCGTTLTVAWDAPRQRPTAYALAALFMLLLSNLFPFVNMNVAGVTSEITLLEIPGVLFSEDYASLGTFFLLFVQLVPAFCLITILLLVNRAELPVRLKEQLARVLFQLKTWGMAEIFLAGVLVSFVKLMAYGSIGVGSSFLPWCLFCVLQLRAFQCVDRRWLWDDIAPMPELRQPLKPGVTGIRQGLRSCSCCTAILPADESVCPRCSTKGYVRRRNSLQWTLALLVTSIMLYLPANILPIMVTDLLGSKMPSTILAGVILLWSEGSYPVAAVIFLASIMVPTLKMIAIAWLCWDAKGHGKRDSERMHLIYEVVEFVGRWSMIDVFVIAVLSALVRMGGLMSIYPAMGALMFALVVIMTMFSAMTFDPRLSWDRQPESEHEES

SEQ ID NO: 2331 - DNA, 1641 bp, Escherichia coli
atggaatctaataatggggaagccaaaatccagaaagtgaagaactggtctcccgtgtggatatttcctatcgtcacggcgctcattggggcctgggttcttttttatcattacagccatcagggaccggaagtgaccctgatcaccgcgaatgcggaaggaattgaaggtggcaaaaccaccattaaaagccgtagcgttgacgtcggcgtggttgaaagcgccacactggctgatgatttgacgcacgttgaaatcaaagcgcggctgaattccggtatggaaaagttgctgcataaagataccgtcttttgggtggtgaaaccgcagattggtcgagaagggattagcggcctgggaacactgctgtctggggtttatatcgaactgcagccaggcgcgaaaggcagcaaaatggataaatacgatttgctggactcgccaccgttggccccacctgatgcgaaaggtatccgtgtgcttctcgatagcaaaaaagccgggcagctctcgccaggagatccggtgctgttccgtggctatcgggtaggttcggttgaaaccagcactttcgatacgcaaaaacgcaatatcagttatcaactgttcatcaatgcaccttatgaccgactggtgaccagcaatgttcgtttctggaaagatagtggcattgcggttgatctgacgtcagcgggaatgcgtgtggagatgggctcattgacaacgctgcttagtggcggtgtcagctttgatgtgccggaaggtctggatttagggcagccagtggcaccgaaaacagctttcgttttgtatgatgatcagaagagcattcaggattcgttgtacaccgatcacattgattatctgatgttctttaaagattcggtacgcggtctgcaaccgggagctccggtagaattccggggtattcgcctgggtaccgtaagcaaagtgccattctttgcgccgaatatgcgtcagacatttaacgatgattaccgtattccggtactgattcgtatcgagccagagcggctgaaaatgcagcttggcgaaaatgcggatgttgttgagcaccttggcgaattgttgaaacgtggtttacgcggatcgctgaaaaccggaaacctggtcactggcgcactgtatgttgatctcgatttctatccaaatacgcctgcaataaccggtattcgtgaatttaatggttatcagattatcccgaccgtcagcggcggcctggcgcaaatccagcaacgactgatggaagcgttggataagatcaacaaactgccactgaatccgatgattgaacaggcaaccagtacgctttctgaaagtcagcgcacaatgaaaaacctgcaaacgacgctggatagcatgaacaagatccttgccagccagtcgatgcagcagttaccgacggatatgcagtcaacgttgcgtgaattgaatcgcagcatgcagggcttccagcctggttccgcagcctacaacaagatggtggcggatatgcagcgccttgatcaggtgttgcgagaactgcaaccggtgctgaaaacgctcaacgagaagagtaacgcgctggtatttgaagcgaaggacaaaaaagatccagagccgaagagggcgaaacaatga

SEQ ID NO: 2332 - protein, 546 aa, Escherichia coli
MESNNGEAKIQKVKNWSPVWIFPIVTALIGAWVLFYHYSHQGPEVTLITANAEGIEGGKTTIKSRSVDVGVVESATLADDLTHVEIKARLNSGMEKLLHKDTVFWVVKPQIGREGISGLGTLLSGVYIELQPGAKGSKMDKYDLLDSPPLAPPDAKGIRVLLDSKKAGQLSPGDPVLFRGYRVGSVETSTFDTQKRNISYQLFINAPYDRLVTSNVRFWKDSGIAVDLTSAGMRVEMGSLTTLLSGGVSFDVPEGLDLGQPVAPKTAFVLYDDQKSIQDSLYTDHIDYLMFFKDSVRGLQPGAPVEFRGIRLGTVSKVPFFAPNMRQTFNDDYRIPVLIRIEPERLKMQLGENADVVEHLGELLKRGLRGSLKTGNLVTGALYVDLDFYPNTPAITGIREFNGYQIIPTVSGGLAQIQQRLMEALDKINKLPLNPMIEQATSTLSESQRTMKNLQTTLDSMNKILASQSMQQLPTDMQSTLRELNRSMQGFQPGSAAYNKMVADMQRLDQVLRELQPVLKTLNEKSNALVFEAKDKKDPEPKRAKQ

SEQ ID NO: 2333 - DNA, 564 bp, Escherichia coli
atgaaaaagtggctagtgacgattgcggcactgtggctggccggatgcagctccggcgaaattaataaaaactattaccagttacctgtggtgcagagcggtacacaaagcaccgccagccagggtaatcgcctgttatgggttgagcaggtcgctgttcctgactatctggcggggaatggtgtggtttatcaaaccagtgatgtgaagtatgtgattgccaacaacaacctgtgggccagcccgttggatcaacagttgcgcaacaccctggttgccaacctgagtacgcaactacccggctgggtggttgcctcccagcctctgggaagcgcccaggacacgctcaatgttaccgtcacggagtttaacggtcgctatgatggcaaggtcattgtcagtggtgagtggctgttgaaccaccagggacaactgatcaaacgtccgttccgtctggaaggagtgcaaactcaggatggttacgatgagatggttaaagtgctggccagtgtctggagtcaggaagccgcttctattgcgcaagagataaagcgtctaccttaa

SEQ ID NO: 2334 - protein, 187 aa, Escherichia coli
MKKWLVTIAALWLAGCSSGEINKNYYQLPVVQSGTQSTASQGNRLLWVEQVAVPDYLAGNGVVYQTSDVKYVIANNNLWASPLDQQLRNTLVANLSTQLPGWVVASQPLGSAQDTLNVTVTEFNGRYDGKVIVSGEWLLNHQGQLIKRPFRLEGVQTQDGYDEMVKVLASVWSQEAASIAQEIKRLP

SEQ ID NO: 2335 - DNA, 168 bp, Escherichia coli
atgaagagacaaaaacgagatcgcctggaacgggcacatcaacgtggttatcaggccggcatcgccggacgctcaaaagaaatgtgtccctatcagacgctgaatcaaaggtcacaatggctgggaggctggcgagaagccatggcggacagggtagtaatggcctga

SEQ ID NO: 2336 - protein, 55 aa, Escherichia coli
MKRQKRDRLERAHQRGYQAGIAGRSKEMCPYQTLNQRSQWLGGWREAMADRVVMA

SEQ ID NO: 2337 - DNA, 627 bp, Escherichia coli
atggccattacgttggctgaactggtttattccgaactgatcggacttgttcagcgtacacgtgttagctatcctgcgtgcttcaataaaataaggcttacagagaacatggtagataaacgcgaatcctatacaaaagaagaccttcttgcctctggtcgcggtgaactgtttggcgctaaaggcccgcaattgccagcaccaaacatgctgatgatggaccgtgtggtcaaaatgaccgaaacgggtggtaacttcgacaaagggtatgttgaagcagagctggatatcaatccggatctgtggttcttcggatgccactttatcggcgatccggttatgccgggatgcctgggcctggacgcaatgtggcagctggtagggttctacctcggctggctgggcggcgaaggtaaaggtcgcgcgctgggcgtaggtgaagtgaaattcacaggccaggtgctgccgacggcgaaaaaagtgacctatcgtattcactttaaacgcatagttaaccgtcgtctgattatgggcctggctgatggcgaagtgctggttgatggtcgtttgatctataccgccaacgacctgaaagtaggtctgttccaggatacgtctgcattctga

SEQ ID NO: 2338 - protein, 208 aa, Escherichia coli
MAITLAELVYSELIGLVQRTRVSYPACFNKIRLTENMVDKRESYTKEDLLASGRGELFGAKGPQLPAPNMLMMDRVVKMTETGGNFDKGYVEAELDINPDLWFFGCHFIGDPVMPGCLGLDAMWQLVGFYLGWLGGEGKGRALGVGEVKFTGQVLPTAKKVTYRIHFKRIVNRRLIMGLADGEVLVDGRLIYTANDLKVGLFQDTSAF

SEQ ID NO: 2339 - DNA, 669 bp, Escherichia coli
  n 9, 10, 11, 12, 13: n is any nucleotide
atggaatgnnnnngaacttctcgcattagctgcgttgtgcatattggcgatggtgaattcaccgacatcgaacgcaaagcggagcttggcggcaatatccatgcgaaagggatgatgatcatgcaagcgttcctgatgtcggaactacagcttgagcaacagatccccttctcagcatcgctgacatttgagcagtcatacagtgaagtggatggcgatagtgcctcgatggctgaactctgcgccctgataagcgccctcgccgatgtgccggtgaatcagagtatcgctatcacaggttcagtcgatcagttcggtcgcgcccagccagtcggtggtttaaatgagaaaatcgaaggcttctttgctatttgccagcaacgtgagttaacggggaaacaaggtgtcattatccccacagctaacgttcgccatttaagtcttcacagtgaactggtgaaagcggtagaagaagacaaattcaccatctgggcagtagacgatgtgactgacgcactgccgttattattaaatctggtgtgggatggcgaaggccaaacgacgctgatgcaaaccatccaggaacgtatcgcacaagcatcgcaacaggaaggacgtcaccgttttccatggccattacgttggctgaactggtttattccgaactga

SEQ ID NO: 2340 - protein, 222 aa, Escherichia coli
  Xaa 3, 4, 5: Xaa is any amino acid
MEXXXTSRISCVVHIGDGEFTDIERKAELGGNIHAKGMMIMQAFLMSELQLEQQIPFSASLTFEQSYSEVDGDSASMAELCALISALADVPVNQSIAITGSVDQFGRAQPVGGLNEKIEGFFAICQQRELTGKQGVIIPTANVRHLSLHSELVKAVEEDKFTIWAVDDVTDALPLLLNLVWDGEGQTTLMQTIQERIAQASQQEGRHRFPWPLRWLNWFIPN

SEQ ID NO: 2341 - DNA, 972 bp, Escherichia coli
  n 954, 955, 956, 957, 958: n is any nucleotide
atgaaaaagacagctatcgcgattgcagtggcactggctggtttcgctaccgtagcgcaggccgctccgaaagataacacctggtacactggtgctaaactgggctggtcccagtaccatgacactggtttcatcaacaacaatggtccgacccatgaaaaccaactgggcgctggtgcttttggtggttaccaggttaacccgtatgttggctttgaaatgggttatgactggttaggtcgtatgccatacaaaggcagcgttgaaaacggtgcatataaagctcagggcgttcagctgaccgctaaactgggttacccaatcactgacgatctggacgtatacactcgtctgggtggtatggtatggcgtgcagacactaaatccaacgtttatggtaaaaaccacgacaccggcgtttctccggtcttcgctggcggtgttgagtatgcgatcactcctgaaatcgctacccgtctggaataccagtggaccaacaacatcggtgacgcacacaccatcggcactcgtccggacaacggcatgctgagcctgggtgtttcctaccgtttcggtcagggcgaagcagctccagtagttgctccggctccagctccggcaccggaagtacagaccaagcacttcactctgaagtctgacgttctgttcaccttcaacaaagcaaccctgaaaccggaaggtcaggctgctctggatcagctgtacagccagctgagcaacctggatccgaaagacggttccgtagttgttctgggttacactgaccgcatcggttctgacgcttataaccaggctctgtccgagcgtcgtgctcagtccgttgttgattacctgatctctaaaggtatcccggcagacaaaatctccgcacgtggtatgggcgaatccaacccggttactggcaacacctgtgacaacgtgaaacagcgtgcnnnnncattcattcattaa

SEQ ID NO: 2342 - protein, 323 aa, Escherichia coli
  Xaa 319, 320: Xaa is any amino acid
MKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDVYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFTFNKATLKPEGQAALDQLYSQLSNLDPKDGSVVVLGYTDRIGSDAYNQALSERRAQSVVDYLISKGIPADKISARGMGESNPVTGNTCDNVKQRAXXFIH

SEQ ID NO: 2343 - DNA, 510 bp, Escherichia coli
atgtacactgcaggctatgcacatcgtgattcgtcgttctcatccacagcaagtaaaattgcgcgtgtctctacggaaaacactacagccgggcttatcagtgaagttgtctatcgcgaagatcagcccatgatgacgcaacttctactgttgccattgttacagcaactcggtcagcaatcgcgctggcaactctggttaacaccgcaacaaaaactgagtcgcgaatgggttcaggcatctgggctacccttaacgaaagtaatgcagattagccagctctccccttgccacaccgtggagtcaatggttcgcgctttacgcacgggcaattacagcgtggtgatcggttggttggcagatgatttgactgaagaagagcatgctgaacttgttgatgcggcaaatgaaggtaacgctatggggtttattatgcgtccggtaagcgcatcctctcacgcaacgagacaactttccgggctaaaaattcactctaatttgtatcattaa

SEQ ID NO: 2344 - protein, 169 aa, Escherichia coli
MYTAGYAHRDSSFSSTASKIARVSTENTTAGLISEVVYREDQPMMTQLLLLPLLQQLGQQSRWQLWLTPQQKLSREWVQASGLPLTKVMQISQLSPCHTVESMVRALRTGNYSVVIGWLADDLTEEEHAELVDAANEGNAMGFIMRPVSASSHATRQLSGLKIHSNLYH

SEQ ID NO: 2345 - DNA, 2163 bp, Escherichia coli
atggcctttatgctaagtcctttgctcaaacgctatacctggaacagcgcctggctgtattacgcgcgtatttttattgcgctttgtggaaccacagcgtttccgtggtggctgggtgatgtaaaactgacgattccgctgacgcttgggatggtggcagcggcgctgaccgatctcgatgaccgactggcgggacgtttgcgtaacctcatcattacgctgttctgcttttttatcgcctcggcctcagtagaattgctgtttccctggccctggctatttgcgattggcttaacgctctctaccagcggcttcattttgctcggcggtctgggtcaacgctatgcaacaattgccttcggtgcattgctgatcgccatttacactatgttgggaacatcactgtatgagcactggtatcagcagccgatgtatcttctggccggtgccgtctggtacaacgtcctgacacttattggtcatctgctgttcccggtccgcccgctgcaggacaacctggcgcgttgctatgaacaactggcgcgttatcttgagctcaagtcgcgcatgtttgatcctgatattgaagatgaaagccaggcaccgctgtacgatttggctctcgccaacggtcagctgatggcgacattgaatcagacgaaactctcgctgctgacccgcttacgtggcgatcgtggtcaacgaggaacgcgtcgcacactgcattattactttgtcgcacaggatattcacgagcgtgccagctcttctcatattcaatatcaaacattgcgtgagcattttcgccacagcgacgtgctgttccgttttcagcggctgatgtcgatgcagggccaggcgtgccagcaactgtcacgctgtattttgctgcgtcagccttatcaacatgatccgcattttgagcgcgcttttacgcatattgatgctgcgctggagcggatgcgcgataacggcgctcctgctgatttactcaaaacactgggatttttactgaacaatttacgtgccattgatgcccaactggcaacaattgaatcagaacaggcccaggcactgccccataataatgacgaaaatgagctcgctgatgacagcccgcacggattgagtgatatctggctgcgtcttagccgtcacttcacgccggaatccgccctcttccgtcatgcggtaagaatgtcgctggtgttgtgcttcggctacgccatcattcagataaccggaatgcatcacgggtattggatcttgctgacaagtttgtttgtctgccagccaaactataacgccacgcgccaccgcctgaagttaaggattattggtacgctggtaggtatcgcaattggtattcctgtgctgtggtttgtgccatcactggaagggcagttggtgctgctggttattaccggcgtgctcttttttgccttccgtaacgtgcaatacgcccatgcaacgatgttcatcacacttttggtgctactgtgtttcaacttgctgggtgaaggttttgaagtggcgttacctcgcgtaatcgatacgctgattggttgtgccattgcgtgggcggcagtgagctacatctggcctgactggaagtttcgcaatctgccgcgaatgctcgaacgcgccacagaggccaactgccggtatctcgatgccatactggaacaataccatcaggggcgtgataaccgtctggcgtatcgtattgcccgccgcgatgcacacaaccgtgatgctgaactggcgtcggtggtatcaaatatgtccagcgaaccgaacgttaccccgcaaattcgcgaagccgcgtttcggttgctgtgccttaaccatacgtttaccagctatatctcagccctcggtgctcaccgggagcagttaactaatcctgaaattctggcgtttcttgatgacgcagtttgctatgttgatgacgcgctacatcatcaacctgctgatgaagaacgcgtcaatcaggcattagctggcctgaaacagcggatgcagcaacttgaaccacgggcagacagcaaagaacctctggtcgtacaacaagttgggttattgattgcattactgccagagattggtcgtctgcaacgccagattactcaagttccgcaggaaactcctgtttcggcgtaa

SEQ ID NO: 2346 - protein, 720 aa, Escherichia coli
MAFMLSPLLKRYTWNSAWLYYARIFIALCGTTAFPWWLGDVKLTIPLTLGMVAAALTDLDDRLAGRLRNLIITLFCFFIASASVELLFPWPWLFAIGLTLSTSGFILLGGLGQRYATIAFGALLIAIYTMLGTSLYEHWYQQPMYLLAGAVWYNVLTLIGHLLFPVRPLQDNLARCYEQLARYLELKSRMFDPDIEDESQAPLYDLALANGQLMATLNQTKLSLLTRLRGDRGQRGTRRTLHYYFVAQDIHERASSSHIQYQTLREHFRHSDVLFRFQRLMSMQGQACQQLSRCILLRQPYQHDPHFERAFTHIDAALERMRDNGAPADLLKTLGFLLNNLRAIDAQLATIESEQAQALPHNNDENELADDSPHGLSDIWLRLSRHFTPESALFRHAVRMSLVLCFGYAIIQITGMHHGYWILLTSLFVCQPNYNATRHRLKLRIIGTLVGIAIGIPVLWFVPSLEGQLVLLVITGVLFFAFRNVQYAHATMFITLLVLLCFNLLGEGFEVALPRVIDTLIGCAIAWAAVSYIWPDWKFRNLPRMLERATEANCRYLDAILEQYHQGRDNRLAYRIARRDAHNRDAELASVVSNMSSEPNVTPQIREAAFRLLCLNHTFTSYISALGAHREQLTNPEILAFLDDAVCYVDDALHHQPADEERVNQALAGLKQRMQQLEPRADSKEPLVVQQVGLLIALLPEIGRLQRQITQVPQETPVSA

SEQ ID NO: 2347 - DNA, 630 bp, Escherichia coli
atgaaaagcctctcctataagcggatctataaatcacaagaatacctggcaacgttgggcacaattgaataccgatcattgtttggtagttacagcctgaccgttgacgacacggtgtttgcgatggtttctgatggtgagttgtatcttcgggcttgtgagcaaagtgcaccgtactgtgtaaaacatccgcctgtctggctgacatataaaaagtgtggccgatccgttaccctcaattactatcgggttgatgaaagtctatggcgaaatcaactgaagctggtgcgtctgtcgaaatattctctcgatgcagcgctgaaagagaaaagtacgcgcaatattcgggaaagactgaaagatttgctcaatatgtcttttcatctggaagcgattctcggggaggtggggattaaggatgtacgggcgttacgtatacttggggcaaaaatgtgttggttgcgactgcggcagcaaaacagtctggtgacagaaaagattctgtttatgcttgaaggggccattatcggcattcatgaagctgcgctcccggtggcacgccgccaggagcttgcagaatgggctgactctcttacgccgaaacaggagtttcctgcggaacttgagtaa

SEQ ID NO: 2348 - protein, 209 aa, Escherichia coli
MKSLSYKRIYKSQEYLATLGTIEYRSLFGSYSLTVDDTVFAMVSDGELYLRACEQSAPYCVKHPPVWLTYKKCGRSVTLNYYRVDESLWRNQLKLVRLSKYSLDAALKEKSTRNIRERLKDLLNMSFHLEAILGEVGIKDVRALRILGAKMCWLRLRQQNSLVTEKILFMLEGAIIGIHEAALPVARRQELAEWADSLTPKQEFPAELE

SEQ ID NO: 2349 - DNA, 447 bp, Escherichia coli
atgcgtaccgttttgaacattctgaactttgtgcttggcggatttgccaccactctgggctggctgttggcgactctggtcagtattgtgctgatttttaccttaccactgacacgatcctgctgggagatcaccaaactgtctctggtgccttatggcaatgaagctattcatgtcgatgaactgaacccggctggcaaaaatgtgctgctaaatactggcggtacggtattgaatattttctggctgattttctttggctggtggttatgcctgatgcacattgcaacgggcatcgcacaatgtatttccatcattggcattcctgtcggtattgcgaactttaaaattgccgctattgcactatggccggtcggtcgtcgcgtggtatcggtagaaacagcgcaagctgcgcgcgaagccaatgcacgtcgtcgtttccaataa

SEQ ID NO: 2350 - protein, 148 aa, Escherichia coli
MRTVLNILNFVLGGFATTLGWLLATLVSIVLIFTLPLTRSCWEITKLSLVPYGNEAIHVDELNPAGKNVLLNTGGTVLNIFWLIFFGWWLCLMHIATGIAQCISIIGIPVGIANFKIAAIALWPVGRRVVSVETAQAAREANARRRFQ

SEQ ID NO: 2351 - DNA, 2148 bp, Escherichia coli
atgggcggcaattgtaacgtttttttgggctggagcacgttttctctgacggttacactgataagaaataatttcgtgtggatctacagagtcatggaactgaaagcgacaacgcttggaaaacgtctggcacagcacccttacgatcgggcggtgatcctcaatgccgggattaaagtctccggcgatcgccacgaataccttattcctttcaatcaattactggcgattcactgtaagcgcggtctggtatggggcgagctggaatttgtactgccggacgaaaaagtggtgcgtctgcacggcaccgaatggggcgagacgcagcgtttttaccatcatcttgatgctcactggcggcggtggagtggcgagatgagcgaaattgcgtctggcgttttacgtcagcaactggatttgattgccacgcgcaccggagaaaataaatggctgacgcgtgagcaaacctctggcgtgcagcaacaaatccgccaggctttgtcggcgttaccattgccggttaaccgactggaagaattcgataactgccgtgaggtgtggcgtaaatgtcaggcctggttgaaggacattgaaggcgctcggttgcagcataatcaggcgtataccgaagccatgcttaccgagtatgcggattttttccgccaggtcgagtcttcaccgctgaatccggcgcaggcccgggcagtcgttaatggcgagcattctctgttagtgctggcaggtgcaggaagcggaaaaacgtcggtgctggtggcccgtgctggctggttactggcgcgtggtgaagcgtcccctgagcaaattttattgctggcgtttggtcgcaaagccgctgaagagatgcacgagcgtattcgagaacgactacataccgaagacattaccgcacgcacgtttcatgcgctggcgctgcatattattcagcagggcagcaaaaaagttccgatagtcagcaaactggaaaatgataccgctgcccgtcatgaactttttattgctgagtggcgcaagcaatgcagcgaaaagaaagcgcaggcgaagggctggcggcaatggctgacggaagaaatgcagtggtcagtgccagaaggtaatttctgggatgatgaaaaattacagcgtcgtcttgcctctcgcctcgatcgctgggtaagtctgatgcggatgcacggtggtgcacaggcagaaatgattgccagtgcacccgaagagattcgcgatctgttcagtaaacgtatcaagttgatggccccgttattaaaagcctggaaaggtgcgctgaaggcagaaaacgctgtcgatttttcgggccttattcaccaggcgattgtgattctggagaaaggtcgctttatcagcccgtggaagcatattctggttgatgaatttcaggatatctcgccgcagcgtgcagcgttgttagcggcattacgcaagcaaaatagtcaaacgacgttgttcgctgttggtgatgactggcaggcgatttaccgattcagcggtgcgcaaatgtcgcttaccacggctttccatgaaaactttggtgaaggtgatcgctgtgatttagacacgacctaccgttttaacagtcgtatcggtgaggtggcaaacaggtttattcagcagaacccaggccagcttaaaaagccgctaaacagcttaaccaatggagacaaaaaagccgtcacgttattggatgagggtcaacttgacgctttgctggataaactctctggttatgccaaaccggaagagcgcattctgatcctggcgcgttaccatcacatgaggcctgccagcctggaaaaagcagcaacacgctggccgaagttgcaaatcgactttatgaccattcatgccagcaaagggcaacaggcggattacgtcatcatcgttggcttgcaggaggggagtgatggttttccggctgcggcgcgggagtcgattatggaagaggcgctactgccaccggttgaggatttcccggacgctgaagaacggcggttaatgtacgtggcgctgacccgggcacgtcatcgggtatgggcactgtttaacaaagagaatccctctccctttgtggatatactgaaaaatctggatgtgccggtggcgagaaaaccgtaa

SEQ ID NO: 2352 - protein, 715 aa, Escherichia coli
MGGNCNVFLGWSTFSLTVTLIRNNFVWIYRVMELKATTLGKRLAQHPYDRAVILNAGIKVSGDRHEYLIPFNQLLAIHCKRGLVWGELEFVLPDEKVVRLHGTEWGETQRFYHHLDAHWRRWSGEMSEIASGVLRQQLDLIATRTGENKWLTREQTSGVQQQIRQALSALPLPVNRLEEFDNCREVWRKCQAWLKDIEGARLQHNQAYTEAMLTEYADFFRQVESSPLNPAQARAVVNGEHSLLVLAGAGSGKTSVLVARAGWLLARGEASPEQILLLAFGRKAAEEMHERIRERLHTEDITARTFHALALHIIQQGSKKVPIVSKLENDTAARHELFIAEWRKQCSEKKAQAKGWRQWLTEEMQWSVPEGNFWDDEKLQRRLASRLDRWVSLMRMHGGAQAEMIASAPEEIRDLFSKRIKLMAPLLKAWKGALKAENAVDFSGLIHQAIVILEKGRFISPWKHILVDEFQDISPQRAALLAALRKQNSQTTLFAVGDDWQAIYRFSGAQMSLTTAFHENFGEGDRCDLDTTYRFNSRIGEVANRFIQQNPGQLKKPLNSLTNGDKKAVTLLDEGQLDALLDKLSGYAKPEERILILARYHHMRPASLEKAATRWPKLQIDFMTIHASKGQQADYVIIVGLQEGSDGFPAAARESIMEEALLPPVEDFPDAEERRLMYVALTRARHRVWALFNKENPSPFVDILKNLDVPVARKP

SEQ ID NO: 2353 - DNA, 468 bp, Escherichia coli
atgtacattatggaactgacgactcgcactttaccttcgcggaaacatattgcgctggtggcacacgatcactgcaaacaaatgctgatgagctgggtggaacggcatcaaccgttactggaacaacacgtactgtatgcaacaggcactaccggtaacttaatttcccgcgcgaccggcatgaacgtcaacgcgatgttgagtggcccaatggggggtgaccagcaggttggcgcattgatctcagaagggaaaattgatgtattgattttcttctgggacccactaaatgccgtgccgcacgatcctgacgtgaaagccttgctgcgtctggcaacggtatggaacattccggtcgccaccaacgtggcaacggcagacttcattatccagtcaccgcattttaacgacgcggtcgatattctgatccccgattatcagcgttatctcgcagaccgtctgaagtaa

SEQ ID NO: 2354 - protein, 155 aa, Escherichia coli
MYIMELTTRTLPSRKHIALVAHDHCKQMLMSWVERHQPLLEQHVLYATGTTGNLISRATGMNVNAMLSGPMGGDQQVGALISEGKIDVLIFFWDPLNAVPHDPDVKALLRLATVWNIPVATNVATADFIIQSPHFNDAVDILIPDYQRYLADRLK

SEQ ID NO: 2355 - DNA, 663 bp, Escherichia coli
atgaaaaccggcatcgtgaccaccttgattgcattatgtttgccggtatccgtttttgccaccacgctgcggctttctactgatgtcgatcttctggtactcgacggtaagaaggtttccagctctctgctgcgcggtgcggacagcattgaactggacaatggaccgcatcagttagtgtttcgcgttgagaagacgattcatctttccaatagtgaagaacggctctatatctcccctccactggtggttagttttaatacccagctcatcaaccaggtcaattttcgcctgcctcgcctggagaatgagcgggaagctaaccattttgatgccgcgccgcgccttgaattgttggatggcgatgcgacgccgattccggtaaagctggatattctcgccattacctcaactgcaaaaacgattgattatgaggtcgaggttgaacgctataacaaatccgcgaaacgcgcttcactaccgcaatttgccacgatgatggcagatgacagtacgctgctttcgggtgtttccgagctggatgctattccgccgcagtctcaggtgctcacagaacaacggctgaagtattggtttaaactggctgacccacaaacgcgaaatactttcctgcaatgggcggaaaaacaaccatcctcctga

SEQ ID NO: 2356 - protein, 220 aa, Escherichia coli
MKTGIVTTLIALCLPVSVFATTLRLSTDVDLLVLDGKKVSSSLLRGADSIELDNGPHQLVFRVEKTIHLSNSEERLYISPPLVVSFNTQLINQVNFRLPRLENEREANHFDAAPRLELLDGDATPIPVKLDILAITSTAKTIDYEVEVERYNKSAKRASLPQFATMMADDSTLLSGVSELDAIPPQSQVLTEQRLKYWFKLADPQTRNTFLQWAEKQPSS

SEQ ID NO: 2357 - DNA, 495 bp, Escherichia coli
ttgctctcattcattcgtattagctgcatggttggcatgtcggctttgtcgtacactttgttaaacagtctggaggaaataatgaaagaaaccgatattgcaggcattttaacgtccactcacaccattgcgctggtgggggcaagcgacaaacccgatcgtcccagctatcgcgtgatgaaatatctactcgaccaggggtatcacgtcattcctgtttcgccaaaagttgccggcaaaacactgctgggccagcaggggtatggcacgctggcagacgttccggaaaaagtcgatatggtcgatgttttccgtaattcagaagcggcgtggggcgtggcgcaggaagctatcgccattggcgcgaaaaccctctggatgcaactgggggtgattaatgagcaagcggcagtgctggcgcgtgatgcagggctaaacgtggtgatggatcgctgcccggcgattgagatccctcgcctgggcctggccaaataa

SEQ ID NO: 2358 - protein, 164 aa, Escherichia coli
MLSFIRISCMVGMSALSYTLLNSLEEIMKETDIAGILTSTHTIALVGASDKPDRPSYRVMKYLLDQGYHVIPVSPKVAGKTLLGQQGYGTLADVPEKVDMVDVFRNSEAAWGVAQEAIAIGAKTLWMQLGVINEQAAVLARDAGLNVVMDRCPAIEIPRLGLAK

SEQ ID NO: 2359 - DNA, 318 bp, Escherichia coli
atgattgccagcaaattcggtatcggccagcaggtccgccattccctgttaggttatctcggagtggtcgtggatatcgacccggtttattcgctctctgaaccgtcgcctgatgagctggcggtgaatgacgagcttcgcgccgctccgtggtatcacgtggtgatggaggatgataacggcctaccggttcatacctacctggctgaagcccagctaagtagcgaattgcaggatgaacatcctgaacagccatccatggatgagctggcgcagaccatccgcaaacaactccaggccccgcgtctgcgtaactaa

SEQ ID NO: 2360 - protein, 105 aa, Escherichia coli
MIASKFGIGQQVRHSLLGYLGVVVDIDPVYSLSEPSPDELAVNDELRAAPWYHVVMEDDNGLPVHTYLAEAQLSSELQDEHPEQPSMDELAQTIRKQLQAPRLRN

SEQ ID NO: 2361 - DNA, 1176 bp, Escherichia coli
gtgttagccaaagggcgcgaaaaatcattacttcgtcgccatccgtgggtcttttccggggccgttgcccgcatggaaggtaaagccagcctcggtgaaaccatcgatattgttgatcatcagggaaaatggttagcacgcggcgcttattcgccagcttcgcaaatccgggcgcgcgtctggacgtttgacccgtctgagtctatcgacattgctttttttacccgccgtttacagcaagcacaaaaatggcgtgactggctggcgcaaaaagatggcctcgacagctatcgtttaatcgccggagaatctgatggcctgccgggtattactatcgatcgtttcggtaattttctggtgctgcaactgctgagtgctggcgcagagtatcagcgcgcggcattaattagtgccctgcaaacgctgtacccggaatgtgctatttacgatcgcagcgacgtcgcggtacgtaaaaaagaagggatggagctgactcagggccccatcaccggcgagttgccgcctgccctgctgccgattgaagaacacggcatgaaactgctggtggatattcagcacggacacaaaacgggctactacctggaccagcgtgacagccgcctggctacccgccgctacgtcgaaaataaacgcgtacttaactgtttttcctataccggtggtttcgccgtatcggcattgatgggcggttgcagccaggttgtcagcgttgatacctcccacgaagcgctggatattgcacggcagaacgttgagctgaacaaactggatctgagcaaggcagagtttgtccgtgatgatgtctttaaattgctgcgtacttatcgcgatcgcggtgaaaaatttgatgttatcgtgatggacccgccgaagtttgttgagaataaaagccagttgatgggcgcgtgtcgtggttataaagacatcaacatgctggcgattcagttgctgaatgaaggcggtattctcctgactttctcctgttccggtctgatgaccagcgatttatttcagaaaatcatcgcggatgccgcaattgatgccggtcgtgatgtacaatttatagagcagttccgtcaggcagccgatcatccggtgatcgctacctacccggaagggctatatctgaaagggtttgcctgtcgcgtcatgtaa

SEQ ID NO: 2362 - protein, 391 aa, Escherichia coli
MLAKGREKSLLRRHPWVFSGAVARMEGKASLGETIDIVDHQGKWLARGAYSPASQIRARVWTFDPSESIDIAFFTRRLQQAQKWRDWLAQKDGLDSYRLIAGESDGLPGITIDRFGNFLVLQLLSAGAEYQRAALISALQTLYPECAIYDRSDVAVRKKEGMELTQGPITGELPPALLPIEEHGMKLLVDIQHGHKTGYYLDQRDSRLATRRYVENKRVLNCFSYTGGFAVSALMGGCSQVVSVDTSHEALDIARQNVELNKLDLSKAEFVRDDVFKLLRTYRDRGEKFDVIVMDPPKFVENKSQLMGACRGYKDINMLAIQLLNEGGILLTFSCSGLMTSDLFQKIIADAAIDAGRDVQFIEQFRQAADHPVIATYPEGLYLKGFACRVM

SEQ ID NO: 2363 - DNA, 279 bp, Escherichia coli
atgtcgaaagtctgcataattgcctggatttacgggcgagttcagggcgtaggattccgctacaccacgcagtacgaagcgaaaaaactgggactaaccgggtacgccaaaaatcttgacgatggcagcgtggaagtggttgcctgcggtgacgaagggcaggtggaaaaattaatacagtggttaaaaagtggcggcccgcgttcagcgcgtgtggaacgggtgcttagcgagccgcatcatccctccggggagttaacggattttcgtatccgttaa

SEQ ID NO: 2364 - protein, 92 aa, Escherichia coli
MSKVCIIAWIYGRVQGVGFRYTTQYEAKKLGLTGYAKNLDDGSVEVVACGDEGQVEKLIQWLKSGGPRSARVERVLSEPHHPSGELTDFRIR

SEQ ID NO: 2365 - DNA, 330 bp, Escherichia coli
atgctgatcttcgaaggtaaagagatagaaacggataccgaaggctatctcaaagaaagcagccagtggagtgaaccactggcggtggtgattgcagagaacgaagggattgcgctgtcgccagaacactgggaagtggtgcgttttgtgcgtgatttctatctggaattcaatacttctccggcgattcgtatgctggtaaaagcgatggcgaataaatttggcgaagaaaaaggtaacagccgctatttataccgactgtttccgaaaggtccggcaaagcaagccaccaaaattgctggcctgcctaaaccggtaaaatgcatttaa

SEQ ID NO: 2366 - protein, 109 aa, Escherichia coli
MLIFEGKEIETDTEGYLKESSQWSEPLAVVIAENEGIALSPEHWEVVRFVRDFYLEFNTSPAIRMLVKAMANKFGEEKGNSRYLYRLFPKGPAKQATKIAGLPKPVKCI

SEQ ID NO: 2367 - DNA, 660 bp, Escherichia coli
atggatcgtatagttagttcttcacatgaccgtacatcgctgcttagcacccataaggtgctgcgtaatacctattttctgctgagcctgacgctggccttttcggcgattaccgcaactgccagtacggtgctgatgctgccatctccgggtctgattctgacgctggtgggtatgtatggtttgatgttcctgacctacaaaacggcgaataagccgaccgggattatctccgcattcgcctttaccggttttctgggatatatcctcggaccaattctgaacacctacctgtctgctggaatgggtgacgtaatcgctatggcactgggcggaacggcgttggtgttcttctgctgctctgcgtatgtgctgaccacccgcaaagatatgtcgttccttggcggtatgctgatggcgggtattgtggtggtgctgattggtatggttgctaatatcttcctgcagctgcctgccctgcatctggcgatcagcgcggtcttcattctgatctcctctggcgctattttgtttgaaaccagcaacatcattcatggcggtgaaacgaactatattcgtgccacggttagcctgtatgtttcgctgtacaacatcttcgtcagcctgctgagcattctgggcttcgccagccgcgattaa

SEQ ID NO: 2368 - protein, 219 aa, Escherichia coli
MDRIVSSSHDRTSLLSTHKVLRNTYFLLSLTLAFSAITATASTVLMLPSPGLILTLVGMYGLMFLTYKTANKPTGIISAFAFTGFLGYILGPILNTYLSAGMGDVIAMALGGTALVFFCCSAYVLTTRKDMSFLGGMLMAGIVVVLIGMVANIFLQLPALHLAISAVFILISSGAILFETSNIIHGGETNYIRATVSLYVSLYNIFVSLLSILGFASRD

SEQ ID NO: 2369 - DNA, 516 bp, Escherichia coli
atgaataacgaggaaacattttaccaggccatgcggcgtcagggcgttacccggcgcagctttctcaaatattgtagtctggctgccacgtcgctgggattaggcgcgggaatggcaccaaagattgcctgggcgctggagaataaaccgcgcattccggtggtgtggatccacggtcttgaatgcacctgctgtaccgaatcttttatccgctccgctcacccactggcgaaggacgtcatcctttccctgatttccctcgattacgacgatactttgatggctgccgccggaacccaggcggaagaagtctttgaagacatcatcgcgcaatacaatggcaaatatatcctcgccgttgaaggtaatccgccgctgggcgagcaggggatgttctgtatcagcagcggacgaccgtttattgagaaactcaagcgtgccgccgctggagccagtgcgattatcgcctggggaacctgcgcgtcctgggggctgcgtgcaggccgcgcgacctaa

SEQ ID NO: 2370 - protein, 171 aa, Escherichia coli
MNNEETFYQAMRRQGVTRRSFLKYCSLAATSLGLGAGMAPKIAWALENKPRIPVVWIHGLECTCCTESFIRSAHPLAKDVILSLISLDYDDTLMAAAGTQAEEVFEDIIAQYNGKYILAVEGNPPLGEQGMFCISSGRPFIEKLKRAAAGASAIIAWGTCASWGLRAGRAT

SEQ ID NO: 2371 - DNA, 654 bp, Escherichia coli
atgtcacgacgagtcacgacagataaagatacagataaagatacagatcaagaagatcaaaacactatggtccatggcgtaaaaaacgccacgaaccaggcaggggatgttcagaccgtcaatcttggtcagccagcaggcacgacaccggaagccgattcagcgtatgcgctgaaagccgattcgggcgctgtgcagcaggtgatgaccgcaaggccggagcaatcacaccaactgcagcagcctgaagccgattccgccattcagcgggaagccgatcgggtagtcccggaaaacaccgggcagcctgtgggacgagtggattatccggatgtgttcgaacaggtctggcgggaatacccgttgcgtgctggggcaaacccgaagaaatccgctttcagtgcctggaaggccagattacgcgagggggtgccaccagaggccatgctggatggtgtgaggcgttacgcaagatacctggcggctaccgggaaaacgggaacggaatttgttcagcgagcgacgacgttttttggaccggaccggaattttgaaaacccctggttgctcccggtaagcggcacgaacaaccagcgttgtgtgaatcatatttctgaaccggataacgaaattccgccgggcttcagggggtaa

SEQ ID NO: 2372 - protein, 217 aa, Escherichia coli
MSRRVTTDKDTDKDTDQEDQNTMVHGVKNATNQAGDVQTVNLGQPAGTTPEADSAYALKADSGAVQQVMTARPEQSHQLQQPEADSAIQREADRVVPENTGQPVGRVDYPDVFEQVWREYPLRAGANPKKSAFSAWKARLREGVPPEAMLDGVRRYARYLAATGKTGTEFVQRATTFFGPDRNFENPWLLPVSGTNNQRCVNHISEPDNEIPPGFRG

SEQ ID NO: 2373 - DNA, 426 bp, Escherichia coli
gtggcaaaagtttttacacaagaagagcgggaaaaaattaaagggcaggttcttgaactcgtacgccagagtgggcgcgagacgttacgacaactggaagctaaaactggggcaacaagatatctgatgagcgttctggccagagagctggttgccagtggcgatgtatacaactctggttacgggttattcccgtctgaacaggcgcgtaaggactggcaaaatgcccgtaaaaagctctcaagggcaaagctgaataaaccatctgcggttgatccggaccttatctggtcgttaccagacggcgaaatacgccgctacgacaggcgcctgaatataatctgtcgcgagtgccggaagagcgaagctatgcagcgtgtactggcattttatcaaggaaatgttaggtattttagacgttactag

SEQ ID NO: 2374 - protein, 141 aa, Escherichia coli
MAKVFTQEEREKIKGQVLELVRQSGRETLRQLEAKTGATRYLMSVLARELVASGDVYNSGYGLFPSEQARKDWQNARKKLSRAKLNKPSAVDPDLIWSLPDGEIRRYDRRLNIICRECRKSEAMQRVLAFYQGNVRYFRRY

SEQ ID NO: 2375 - DNA, 687 bp, Escherichia coli
atgaccccaataaaaatatttatgactattgctgatttcaaacggcctaaattggagctcccaaacggggcaaacaaactactactgcactcttgctgtgctccatgttccggtgaagtgatggaggcgcttcaggcctcgggaatcgactacaccatctttttctacaacccgaacattcatcctcagaaagagtatttaattcgtaaggatgaaaatattcgctttgctgaacaacacggcgtgccgtttatcgatgctgattacgacaccgacaactggtttgaacgtgccaaaggaatggaatgggagcctgagagggggatccgttgtaccatgtgttttgacatgcgttttgagcggacagcgttgtacgctgctgaaaatggtttcagtgtgatcagcagttcactgggcatttcacgctggaaaaatatgcagcaggttaacgagtgtgggcggcgagctgttgcgcattatccgggtatggtgtactgggattataactggcgcaagcagggcggctcgtcccgtatgattgaaatcagcaagcgcgaaaaattctatcagcaggaatattgtggctgtgtgtattctctgcgcgataccaatctacaccgcaaatctcaggggcgccctcttatcaaaattggccaactccactacggaaaagaagagaaggagtga

SEQ ID NO: 2376 - protein, 228 aa, Escherichia coli
MTPIKIFMTIADFKRPKLELPNGANKLLLHSCCAPCSGEVMEALQASGIDYTIFFYNPNIHPQKEYLIRKDENIRFAEQHGVPFIDADYDTDNWFERAKGMEWEPERGIRCTMCFDMRFERTALYAAENGFSVISSSLGISRWKNMQQVNECGRRAVAHYPGMVYWDYNWRKQGGSSRMIEISKREKFYQQEYCGCVYSLRDTNLHRKSQGRPLIKIGQLHYGKEEKE

SEQ ID NO: 2377 - DNA, 153 bp, Escherichia coli
aagcagcaaaaggcgatgttaatcgccctgatcgtcatctgtttaaccgtcatagtgacggcactggtaacgaggaaagacctctgcgaggtacgaatccgaaccggccagacggaggtcgctgtcttcacagcttacgaacctgaggagtaa

SEQ ID NO: 2378 - protein, 50 aa, Escherichia coli
KQQKAMLIALIVICLTVIVTALVTRKDLCEVRIRTGQTEVAVFTAYEPEE

SEQ ID NO: 2379 - DNA, 1050 bp, Escherichia coli
gtgcgggtattacttcgacctgttccggtaccggaacttgggctggtggtccttaaaccaggccgtgaatccatgcaggtattccataaccctcgagtgctggtggagccggaaccgaaaagcatgcgtggtctgccgtccggcatcgtccctgccgttcgccagccgctggcggaggataaatcattactgcggtttttcagcaatgagcgtgtgattcgtgctgctggcggcgctggtgcactgtctgactggctgttgcgtcatgtcaaatcctgccagtggcctcatggtgactatcatcacagtgaaaccgtcatacatcgttacggcaccggcgcgatggtgttgtgctggcactgcgataaccagctgcgtgaccagacatccgaatcacttgagcaacttgctcaacaaaacctggcagcatggatgattgacgtcatacgccatgcaatgaatggcacgcaggagcgggagttatcgctggctgaattatcctggtgggcggtctgcaatcaagtggcggacgcgcttccggaggcagtattacgtcgttctctggggttacgtgcggaaaaaatccgcgcggtgtaccgcgaaagcgacatcgtaccgggagagcagaccgccaccagcatactaaagcagcgcacaaaaaatcttgcgccgttgcctcacttccaccagcaacagaacccaccactggaaaaggcggtggtcagcattgccgttgatccggactctccggaatctttcatgaggcgacctaaacgtcgccgttgggtaaatgagaaatatacgcgctgggtgaagacacagccgtgtgcgtgttgtggtcagccagccgacgatccccatcacctgattggtcacggtcagggagggatgggaacaaaggcccacgatattttcacgctaccgttgtgccgggaacatcacaacgaacttcatgcggatccgctggcgttcgaagaaaagcatggttcccaggttgatttaatttttcgttttcttgatcacgcctttgcaaccggcgtgcttgggtaa

SEQ ID NO: 2380 - protein, 349 aa, Escherichia coli
MRVLLRPVPVPELGLVVLKPGRESMQVFHNPRVLVEPEPKSMRGLPSGIVPAVRQPLAEDKSLLRFFSNERVIRAAGGAGALSDWLLRHVKSCQWPHGDYHHSETVIHRYGTGAMVLCWHCDNQLRDQTSESLEQLAQQNLAAWMIDVIRHAMNGTQERELSLAELSWWAVCNQVADALPEAVLRRSLGLRAEKIRAVYRESDIVPGEQTATSILKQRTKNLAPLPHFHQQQNPPLEKAVVSIAVDPDSPESFMRRPKRRRWVNEKYTRWVKTQPCACCGQPADDPHHLIGHGQGGMGTKAHDIFTLPLCREHHNELHADPLAFEEKHGSQVDLIFRFLDHAFATGVLG

SEQ ID NO: 2381 - DNA, 375 bp, Escherichia coli
atgcgtattgagtttgttttgccttatccgccgacggtgaatacttactggcgacgtcgtggcaacacatattttgtatcaaaagtcggtgagcgttatcgccgtgatgtggcgctaattgttcgccggcagcggttaaaatcaaacctgtccggaaggctggcgataaaggtgattgcagagccaccggataagcgccgtcgtgacctggacaatatcctgaaagcaccactggatgcgctgacgcatgccggactacttatagacgacgagcagtttgatgaaatcaatattgtgcgcggtcagctcgttcctggtggtcggttgggcgtgaagatttacgaaataatgcatgacgggcaggtccaaaaatga

SEQ ID NO: 2382 - protein, 124 aa, Escherichia coli
MRIEFVLPYPPTVNTYWRRRGNTYFVSKVGERYRRDVALIVRRQRLKSNLSGRLAIKVIAEPPDKRRRDLDNILKAPLDALTHAGLLIDDEQFDEINIVRGQLVPGGRLGVKIYEIMHDGQVQK

SEQ ID NO: 2383 - DNA, 822 bp, Escherichia coli
atgagactggaagatttaccgaaatactattccccaaaatcgccaggcctgactgatgcatccgtctcgacgtcaaaagatgcgctgagcatcactgatgtgatggctgcgcagggtatgacacaaaaccgggctgagatgggattttctgcgttcctggggaaaatgggtattagtatgaatgacagggcgcgggcaacagaattactggcagattatgcattaagtcagtgcgatcgcgtggcggcgttaagaaaacttccggcagaaataaaaccggcagtgatgcgcattatggcttcgtatgcttttgaggattatgcccgcagcgcagcgagtaaaaagcagtgcccctgttgccgaggggaaaaatttattgaaagcgaagtttttacaaacaaggttcagtatccggatggcaagccgccagtatgggcaaagtgtacgaaaggtgtgtatccgtcttactgggaagaatggaaaaaaatccgggaggtggtgaaagtttcttgtcctgaatgtaaagggaagggggagatttccactgcctgtaaagactgccgtgggcgtggtgttgccattcatcgtgaagagtcggaaaaacggggtatgcctgtaatcaggaactgccagcgttgtggcggtcggggctatgaaagactaccatcaacggaggcatttaatgccatacgcaaagtgacgagtgctatcacgcttgatacgtggaaaaaatcagtgaaacgcttttacgatacgttggtggttcggtttgacattgaagaggcatgggcggagcggcagttaaagagggtaacgcgatag

SEQ ID NO: 2384 - protein, 273 aa, Escherichia coli
MRLEDLPKYYSPKSPGLTDASVSTSKDALSITDVMAAQGMTQNRAEMGFSAFLGKMGISMNDRARATELLADYALSQCDRVAALRKLPAEIKPAVMRIMASYAFEDYARSAASKKQCPCCRGEKFIESEVFTNKVQYPDGKPPVWAKCTKGVYPSYWEEWKKIREVVKVSCPECKGKGEISTACKDCRGRGVAIHREESEKRGMPVIRNCQRCGGRGYERLPSTEAFNAIRKVTSAITLDTWKKSVKRFYDTLVVRFDIEEAWAERQLKRVTR

SEQ ID NO: 2385 - DNA, 138 bp, Escherichia coli
atgggcgttttatgcctgacgttagaaggatttttacagcccgccatcgagcgggttttttatatctggaaagcggtgcataacgttaaacgtgatggcgattgcgcaatgagtttctcctgctctgaagtctcttga

SEQ ID NO: 2386 - protein, 45 aa, Escherichia coli
MGVLCLTLEGFLQPAIERVFYIWKAVHNVKRDGDCAMSFSCSEVS

SEQ ID NO: 2387 - DNA, 714 bp, Escherichia coli
atggatgacagcactctgctgaggaactcttcactttttattgcttatatgggctgtcttggatggggaagcgcttatttctatggatgggggacttccttttactatggctttccatggtggatcgtcggggttggcgttgatgatgtggcccgaagtttgttttatgctgtgagcgttatcgttatattccttactggatggggagtaggtattgttttctttttaggcataaaacaaaaaaacaatatacagaatttgagttttatcagactttttctggcaatattgctgctttttattccgcctgttctggagttttcggtaattcatcagcacgttgagccagatgtgctgtttttttgtgttattgctgcctttacaattacgctttttgtcaggtcaggaagaagacttatttcagtcaaatgtttttcggaagtgtcttttattcgccatcaccgaattgagtttattatggctggattcatgatttatttctggacattctctcttattgccggttggtataaaccccagtttaagagggaatatcagacgatccactatgagaatacttggtattacgttcttgcacgctatgatgatcgtctggttttatcgaaatcgtacagtaatgggagttctgcattcgttatacttaatagcgggcagattgatgactttgaaattaatgtagtcagagttcgttaa

SEQ ID NO: 2388 - protein, 237 aa, Escherichia coli
MDDSTLLRNSSLFIAYMGCLGWGSAYFYGWGTSFYYGFPWWIVGVGVDDVARSLFYAVSVIVIFLTGWGVGIVFFLGIKQKNNIQNLSFIRLFLAILLLFIPPVLEFSVIHQHVEPDVLFFCVIAAFTITLFVRSGRRLISVKCFSEVSFIRHHRIEFIMAGFMIYFWTFSLIAGWYKPQFKREYQTIHYENTWYYVLARYDDRLVLSKSYSNGSSAFVILNSGQIDDFEINVVRVR

SEQ ID NO: 2389 - DNA, 216 bp, Escherichia coli
atgaaatccatggacaaaatttcaacgggcattgcctacggcacctccgcaggcagtgctggctactggtttttacagtggcttgatcaggtcagtccgtcacagtgggctgcgattggtgttctggggagtctggttctgggcttcctgacttatctgacaaatctgtacttcaaaatcagagaagacaagcgtaaggctgcacggggagagtaa

SEQ ID NO: 2390 - protein, 71 aa, Escherichia coli
MKSMDKISTGIAYGTSAGSAGYWFLQWLDQVSPSQWAAIGVLGSLVLGFLTYLTNLYFKIREDKRKAARGE

SEQ ID NO: 2391 - DNA, 315 bp, Escherichia coli
atgactcaaaactatgaactgattgtgaaagggatccgcaattttgagaataaagttacggtaactttagcgttacgggacaaaaaacgctttgacggtgaaatttttgacctggacatctcgctggaccgtgttgaaggtgccgcgctggagttttatgaggcagcagccagaaggagcatcagacaggtcttcctagatgttgctgccgggttatgtgaaggggacgagctgttgccagaaacgcgcccctgttcagaggcgcggtataccataaaaattaacagttctgataactcgattacaggttgttag

SEQ ID NO: 2392 - protein, 104 aa, Escherichia coli
MTQNYELIVKGIRNFENKVTVTLALRDKKRFDGEIFDLDISLDRVEGAALEFYEAAARRSIRQVFLDVAAGLCEGDELLPETRPCSEARYTIKINSSDNSITGC

SEQ ID NO: 2393 - DNA, 534 bp, Escherichia coli
atgagcgcaaaaatcaaatacggcctgtcagctgcggttctggcgctgattgctgcaggtgcgtctgctcctcaaatacttgaccagtttctggatgaaaaagaaggtaaccacacaacggcataccgcgatggggccggcatctggaccatctgtcggggtgccacgatggtggatggaaaacccgtttttcccggtatgaaactgtcgaaggaaaaatgcgaccaggtcaacgccattgagcgtgataaggcgctggcatgggtggagcgcaatattaaagtaccaatgaccgaaccacaaaaagcgggtatcgcgtcattctgtccctataacattggccccggtaagtgttttccgtcgacgttttataagcggctgaatgccggtgatcgtaagggcgcatgcgaggcgattcgctggtggataaaagatggtgggcgcgattgccgcatacgttcaaataactgctatggacaggttattcgtcgtgaccaggaaagcgcattagcctgttgggggatagatcagtga

SEQ ID NO: 2394 - protein, 177 aa, Escherichia coli
MSAKIKYGLSAAVLALIAAGASAPQILDQFLDEKEGNHTTAYRDGAGIWTICRGATMVDGKPVFPGMKLSKEKCDQVNAIERDKALAWVERNIKVPMTEPQKAGIASFCPYNIGPGKCFPSTFYKRLNAGDRKGACEAIRWWIKDGGRDCRIRSNNCYGQVIRRDQESALACWGIDQ

SEQ ID NO: 2395 - DNA, 183 bp, Escherichia coli
atgcgaaagctgaaaatgaaactctgcgcgctgatgttgccgctggtcgtcgtcggttgcacatcaaagcagtctgtcagtcagtgcgtgaagccaccaccgcctccggcgtggataatgcaaccagcccccgactggcagacaccgctgaacgggattatttcaccctcagagagcggctga

SEQ ID NO: 2396 - protein, 60 aa, Escherichia coli
MRKLKMKLCALMLPLVVVGCTSKQSVSQCVKPPPPPAWIMQPAPDWQTPLNGIISPSESG

SEQ ID NO: 2397 - DNA, 465 bp, Escherichia coli
gtgagcagagtcgccgcgattatttatgctctggttatttgcatcatcgtctgcctgtcgtgggcggtcaatcattaccgtgataacgccatcgcctacaaagaacagcgtgataaaaaagtcagtgagctgaagcaggcgatcgccaccatcgctgacatgcagcagcgtcagcgtgatgttgctgcgctcgatgcaaagtactcgagagaattagccaatgcgaaagctgaaaatgaaactctgcgcgctgatgttgccgctggtcgtcgtcggttgcacatcaaagcagtctgtcagtcagtgcgtgaagccaccaccgcctccggcgtggataatgcaaccagcccccgactggcagacaccgctgaacgggattatttcaccctcagagagcggctgatgacgatgcagatgcaactggaaggggcacaggagtatatccgcactcagtgcattaagtag

SEQ ID NO: 2398 - protein, 154 aa, Escherichia coli
MSRVAAIIYALVICIIVCLSWAVNHYRDNAIAYKEQRDKKVSELKQAIATIADMQQRQRDVAALDAKYSRELANAKAENETLRADVAAGRRRLHIKAVCQSVREATTASGVDNATSPRLADTAERDYFTLRERLMTMQMQLEGAQEYIRTQCIK

SEQ ID NO: 2399 - DNA, 162 bp, Escherichia coli
catctgtgtcagaactgcctgcgcaatgggagagccgttgaagccagaactgtggaccacatcattccgaaagctcatggtggcacggatgcagacagtaacctgcagagtctgtgctggccctgtcataaagcaaaaacagcgcgcgaacgcatcaattga

SEQ ID NO: 2400 - protein, 53 aa, Escherichia coli
HLCQNCLRNGRAVEARTVDHIIPKAHGGTDADSNLQSLCWPCHKAKTARERIN

SEQ ID NO: 2401 - DNA, 483 bp, Escherichia coli
atgtctggacccccgaaaaccccgccacgcctgcatttgatacgaggtaacccctcaaagcggccagttaaagactccaaaaaaaccgctaaaaaggatgaaaaaggtctccctaaaattccgcaacatttaggggcgcaggggaagtactggttcaggcgaatggcggaagagctgaatgcggaagggatcatttctcagctcgatgcacgtgcgctcgagttactggtggaagcctacaccgaataccggcatcactgcgaaatactcgatgttgagggttatacctaccgcacgaaaacgcagaatggcgatgtgctgatcaaggcacacccggctgctgcgatgaaggctgatgcctggaagcggatccgggcgatgcttgcagaatttggtatgtcaccggcaagccgggcaaaagtaaataccgccggaccggataatgttgatccgctggcagagcttttaaaagcgagagactga

SEQ ID NO: 2402 - protein, 160 aa, Escherichia coli
MSGPPKTPPRLHLIRGNPSKRPVKDSKKTAKKDEKGLPKIPQHLGAQGKYWFRRMAEELNAEGIISQLDARALELLVEAYTEYRHHCEILDVEGYTYRTKTQNGDVLIKAHPAAAMKADAWKRIRAMLAEFGMSPASRAKVNTAGPDNVDPLAELLKARD

SEQ ID NO: 2403 - DNA, 1758 bp, Escherichia coli
atggcaaaagtggctgacgggatccgctacgccgaacgtgttgttgcaggagaaattgttgctggcgaatttgtccgcctggcctgccagcgttttcttgatgatctgaagtacggcgaaaagcgggggatttatttcagtgaaccccgtgcgcagcacatcctgaatttctacaaatttgtgcctcatgtaaaaggggcactggcaggccagcccattgagttgatggactggcatgtatttatcctcattaatatttttggttttgtcattccgctggtcaatgaagaaaccggggaagttgtcatgcgcagcgatggcagcggacgtccggtgatggtgcgccggttccggacggcgtacaacgaagtcgcccgtaaaaacgcaaaatcaaccctgtcatcgggtatcggcctgtatatgacgggggcagatagtgaaggcggagctgaggtgtattcagccgcaaccacgcgtgaccaggccagaatcgtgtttgaagacgccaaaaatatggtcagaaaagcccggtcgacactcgggcggttgtttgatttcaacaagctggcgatttaccaggagcagagcgcatcaaaatttgaaccgctttcctcggatgcaaacaacctggacggtctgaacatccactgcgccattattgatgagctgcatgcacataaaacccgcgacgtgtgggacgttctggaaacggcaaccggtgcccgtctgcagtccctgttatttggtatcaccacggctggctttaacaaggaagggatttgttacgagcagcgtgattacgccatcaaggtattgcgaggctataacagcgacgtggagggcgctgtaaaagacgactcttactttgcgatcatttacacgctcgatgagggagatgatccgtttgatgaaacggtctggcagaaagcgaatcctggcctgggcatctgtaaacgctgggatgatctgcgtcgtctggcgaaaaaagcgaaggagcaggtctctgcgcgggtgaatttttttaccaaacacatgaatgtgtgggtcactgccgaatctgcctggatggatatgattaagtgggagaagtgcgaatacattgctccacaacatgagctgaaaacatatcccatgtgggtcggcgtcgaccttgctcataagattgatatctgtgcggcggcaaaactctggcgaaccgataacggacatgttcatgctgattttaaattctggcttccggaaggacggctggaacgatgctcgcggcagcaggcagaactttaccggaagtgggcggagatggataagctcatcctgacggatggtgatgttatcgatcatgctcagataaaaagtgacttactggaatggattggcggtgaaaacctcagggaactgggatttgacccgtggagcgcaatgcagttcagtctggcactggctgaagaagggataccgctggtggaggttccgcagacggtccgcaatctgtcagaggccatgaaggaaacggaatcactggtttatgccgggcgtttccatcacagcaatcatccggtcatgaactggatgatgtctaacgttactgtaaaaccggacaaaaacgacaacatcttcccgaataaatccacgccggaagccaaaatcgacggccctgttgcgctttttacagccatgagccgctttctggtaaatggcgggggcgtgaatgactttctgtccacgcttgatcctgatgaggacctgttaattctgtga

SEQ ID NO: 2404 - protein, 585 aa, Escherichia coli
MAKVADGIRYAERVVAGEIVAGEFVRLACQRFLDDLKYGEKRGIYFSEPRAQHILNFYKFVPHVKGALAGQPIELMDWHVFILINIFGFVIPLVNEETGEVVMRSDGSGRPVMVRRFRTAYNEVARKNAKSTLSSGIGLYMTGADSEGGAEVYSAATTRDQARIVFEDAKNMVRKARSTLGRLFDFNKLAIYQEQSASKFEPLSSDANNLDGLNIHCAIIDELHAHKTRDVWDVLETATGARLQSLLFGITTAGFNKEGICYEQRDYAIKVLRGYNSDVEGAVKDDSYFAIIYTLDEGDDPFDETVWQKANPGLGICKRWDDLRRLAKKAKEQVSARVNFFTKHMNVWVTAESAWMDMIKWEKCEYIAPQHELKTYPMWVGVDLAHKIDICAAAKLWRTDNGHVHADFKFWLPEGRLERCSRQQAELYRKWAEMDKLILTDGDVIDHAQIKSDLLEWIGGENLRELGFDPWSAMQFSLALAEEGIPLVEVPQTVRNLSEAMKETESLVYAGRFHHSNHPVMNWMMSNVTVKPDKNDNIFPNKSTPEAKIDGPVALFTAMSRFLVNGGGVNDFLSTLDPDEDLLIL

SEQ ID NO: 2405 - DNA, 162 bp, Escherichia coli
gtgaaacagcttattactgatatgaccgggctgatcggtttcggtctgctcactgctggcgtttatctgtatgcaggtctgccagcgtctctgatgctgtctggctgtttgttgctgctttatgcactggtggtgtccatgaggagaaaacatgcttcttga

SEQ ID NO: 2406 - protein, 53 aa, Escherichia coli
MKQLITDMTGLIGFGLLTAGVYLYAGLPASLMLSGCLLLLYALVVSMRRKHAS

SEQ ID NO: 2407 - DNA, 1227 bp, Escherichia coli
atgcttcttgatgctctgtttcgcagtgagcctctggaaaatccctcggttccggtaaccggagaggccgctgagacggataatatttttgcccgggatgtgtatgtcagtccggaaacgtccatgaggctggctgctgtctatgcctgtatttatgttatttcatccagtgtggctcagatgcccctgcatgtgatgcgaaaaacgaatgagcatgttcagccggcacgcgatcacccgttgttctggctcgttcatgatgaaccgaatgcctggcagaccagctataagtggcgggaactgaagcagcgtcatgtgctggggtggggcaatggttatacgtgggtgaaacgtaatcgtcgtggcgaggttaccagtcttgaatgctgtatgccatgggaaaccacgttacttaacactggagggcgtcatacctacggtgtgtataacgaagagggtgcatttgcggtaagtccggacgacatgatccatatcagggcgctgggaaacaatcagaaaatgggactgagtccgatcatgcagcatgctgaaaccattggtatgggaatgagtggtcagcagtataccagtgctttttttaacggtaatgcccgtcctgccgggattatttctgtgaaaaatgaactgaacgaacagagttggagcaggctcaagaatatgtggcagcgggcggtgacagcgcttcgcagtcaggaaaataaaaccatgctgctgcctgcgcaactggattaccgtgccctgacagtttctccggtggatgctcagatcattgatatgaccaagctgaaccggtcgatgattgccggaatttttaatgtcccggcgcacatgattaatgacctggaaaaagccacattttcgaatattacacagcaggcgattcagtttgttcgctacacgatgatgccctgggttgcgaactgggagcaggagcttaaccgtcgcctgtttacccgcacagaacgggctgccgggtattacgttcgtttcaaccttacaggattgctccgcgggactccacaggagcgtgcgcagttttatcactttgccattacagatggctggatgagccggaatgaagcgagggcatttgaggacatgaacccggttgatggtctggatgaaatgctggtcagcgtaaatgcagcaaatccgttgaatgattttaaagatacgaaaggcaaagaggaaaagaacgatgaatga

SEQ ID NO: 2408 - protein, 408 aa, Escherichia coli
MLLDALFRSEPLENPSVPVTGEAAETDNIFARDVYVSPETSMRLAAVYACIYVISSSVAQMPLHVMRKTNEHVQPARDHPLFWLVHDEPNAWQTSYKWRELKQRHVLGWGNGYTWVKRNRRGEVTSLECCMPWETTLLNTGGRHTYGVYNEEGAFAVSPDDMIHIRALGNNQKMGLSPIMQHAETIGMGMSGQQYTSAFFNGNARPAGIISVKNELNEQSWSRLKNMWQRAVTALRSQENKTMLLPAQLDYRALTVSPVDAQIIDMTKLNRSMIAGIFNVPAHMINDLEKATFSNITQQAIQFVRYTMMPWVANWEQELNRRLFTRTERAAGYYVRFNLTGLLRGTPQERAQFYHFAITDGWMSRNEARAFEDMNPVDGLDEMLVSVNAANPLNDFKDTKGKEEKNDE

SEQ ID NO: 2409 - DNA, 600 bp, Escherichia coli
atgaatgaccgtgaaacgcgctgttacagcggggaagtgcgggcagaacaatatgataatgccccgactcatattttggggtatggctcggtatttaacagtcgttcagaacctctgtggggatttcgtgaaatcatcaagccgggggcttttgacgacgtgctgaatgatgatgtacgtggattgtttaatcatgatcctaatttcattctcggacgaagttctgccggcacgttgtcattatcagtggatgaacgtggtttgcgttacgacattgttgcaccggatacgccgacgatttgtgacctggtgctgtcaccaatgttgcgtggtgacattaatcagtcctcgttcgcgtttcgcgtcgctcgtgatggagagagctggtatgaagacgacgaggggattgttatccgggaaatcacgcgcatttctcgtctgtatgacgtcagcccggtgacatatccggcctatcaggacgcagactctggtgtccgctcaatgaaagcctggcaggaagcgcgggcgagtggtgcgctgaagaaagctgttaacgaacgaatggcgcgtgagcgtcttttgacccttcttaatgcataa

SEQ ID NO: 2410 - protein, 199 aa, Escherichia coli
MNDRETRCYSGEVRAEQYDNAPTHILGYGSVFNSRSEPLWGFREIIKPGAFDDVLNDDVRGLFNHDPNFILGRSSAGTLSLSVDERGLRYDIVAPDTPTICDLVLSPMLRGDINQSSFAFRVARDGESWYEDDEGIVIREITRISRLYDVSPVTYPAYQDADSGVRSMKAWQEARASGALKKAVNERMARERLLTLLNA

SEQ ID NO: 2411 - DNA, 1218 bp, Escherichia coli
atgaaacttcatgagatgaagcaaaaacgaaacaccattgcaaaggatatgcgtgcactgcatgaaaaaattggtgataacgcatggactgatgagcaacgggcagagtggaacagggcgaaagctgagctggatgcgctggatgagcaaatcgcccgtgaagaagagttgcgccgtcaggatcaggcatatgtggatgagtccgggccggaagagcgccagaataatgaggcggagaacgggaaaaaggcggtggaagagaagcgcgctgcggcatttaaccgttttctgcgtgccggatttgcagaactgaatgctgaagagcgtaatctgatgcgtgaactgcgggctcagagtgtaacaacggattctcagggcggatatacggtgcccacgcagatgcgtaacaaaatcattgacaccatgaaggcttatggcgggattgccagtgttgcgcaacttctgaccacatcaaccgggcaggatatcacctggtcaacgtctgatggcacgactgaagagggcgaactgctggcggaaaatacagccgcaacggaacaggatgtgacgttcgggaccgctattctgggggctaaaaagctgtcatcaaaaataattcgtgtgtccaatgagctgctccaggacagtggggtggatattgaatcttatctggcaaaccgtattgcccagcgtattggtcgtggagaggcgaaatatctggttcaggggaccggaacgggatcaccgttacagccaaaagggctggcagcgtcggtgacgggaatcatccagactgcagcctctgccgctttcacctggaaagaaatgaatgccctgaaacatgccattgatccggcatatcgtggtgggccgaaataccgctgggcattcaatgatgccacattgcagactattgaagagatggaggatggacagaaacgcccgttatggctgccggatattgcaggcggtacgccggctactgtgctggggatcccttatgttattgatcaggctattgacgggattggtaccggaaaaaaattcattttcctgggggatttcaaccgctttatcattcgccgcgttacttatatggaactgaaacgtctggttgagcgttatgctgagtttgatcaggtggcatttctggctttccatcgttttgactgtgtgctggaagatgtggcagccatcaaggcgctcactggcaaataa

SEQ ID NO: 2412 - protein, 405 aa, Escherichia coli
MKLHEMKQKRNTIAKDMRALHEKIGDNAWTDEQRAEWNRAKAELDALDEQIAREEELRRQDQAYVDESGPEERQNNEAENGKKAVEEKRAAAFNRFLRAGFAELNAEERNLMRELRAQSVTTDSQGGYTVPTQMRNKIIDTMKAYGGIASVAQLLTTSTGQDITWSTSDGTTEEGELLAENTAATEQDVTFGTAILGAKKLSSKIIRVSNELLQDSGVDIESYLANRIAQRIGRGEAKYLVQGTGTGSPLQPKGLAASVTGIIQTAASAAFTWKEMNALKHAIDPAYRGGPKYRWAFNDATLQTIEEMEDGQKRPLWLPDIAGGTPATVLGIPYVIDQAIDGIGTGKKFIFLGDFNRFIIRRVTYMELKRLVERYAEFDQVAFLAFHRFDCVLEDVAAIKALTGK

SEQ ID NO: 2413 - DNA, 318 bp, Escherichia coli
atggcagcaatagtggaaaaactcagggcgcagtgccgtattgatacagatgatgcaactgatgatgagttactgatgctgtatttccgggctgcctgccgcaaggcagaaaattttatcaaccgtaagctttatgaggagacggtgccggaaggtgatcctgaaggggtgcttatagctgatgatgttttgctggcgctcatgttgctggtcgggcactggtacgaaaaccgggaaaattcctcagatgtcagcaaggcaccagtcccgtttggtttttcttctctgctggagccttatcgttttattcctttgtag

SEQ ID NO: 2414 - protein, 105 aa, Escherichia coli
MAAIVEKLRAQCRIDTDDATDDELLMLYFRAACRKAENFINRKLYEETVPEGDPEGVLIADDVLLALMLLVGHWYENRENSSDVSKAPVPFGFSSLLEPYRFIPL

SEQ ID NO: 2415 - DNA, 339 bp, Escherichia coli
atgcaggcgggcagattacgtgatcgcgtaattattctgaatgtcaccaccgcccgctctccgtcagggcatccggtggagacggtgacggagggagctaccgtatgggcagaagttaagggtatcagcgggagggagataatctcaggcggagcagaaaccgctcaggctacggtcagagtctggatgagattccggcgcgatgtgacagcgacttcacgtctgaaagtgctgaccggtgcatttaaaggggccattctgggtatagaaggtccaccaataccggatgcacgcgctacccggcttgaaatactctgcagcctgaaggggaatgtgtga

SEQ ID NO: 2416 - protein, 112 aa, Escherichia coli
MQAGRLRDRVIILNVTTARSPSGHPVETVTEGATVWAEVKGISGREIISGGAETAQATVRVWMRFRRDVTATSRLKVLTGAFKGAILGIEGPPIPDARATRLEILCSLKGNV

SEQ ID NO: 2417 - DNA, 447 bp, Escherichia coli
atggatttcagtcttgatttttccggcctggcggatattgcacgggatttggagacgctcagcagggcagaaaacaataaggttctgcgcgatgccacccgtgccggtgctgaagttatgcgggatgcagttgttgaacgtgcgccggagcgaaccgggaaactgaagaaaaatgtggttgttctcactcagcgttcaaagcgtcggggggaaattatctcgggtgtccacattcgcggacggaacctgcgaaccggaaacagtgataacagcatgaaagccagcgatccccgaaatgcattttactggcgctttgtggagctgggaacgataaacatgcccgcgcatccattcattcgcccggctttcgatacgacagaggaactggcagcacggattgctatacagcgaatgaatcaggctattgatgaggtcttaagtaaatga

SEQ ID NO: 2418 - protein, 148 aa, Escherichia coli
MDFSLDFSGLADIARDLETLSRAENNKVLRDATRAGAEVMRDAVVERAPERTGKLKKNVVVLTQRSKRRGEIISGVHIRGRNLRTGNSDNSMKASDPRNAFYWRFVELGTINMPAHPFIRPAFDTTEELAARIAIQRMNQAIDEVLSK

SEQ ID NO: 2419 - DNA, 345 bp, Escherichia coli
atgagagaggccacactgtattccctgttgtctcagctggccggaggacaggtttatccttatgtggtcccactgacggagggaaagcctgcggtatctccgccgtggctggtgttttctgtggtgtctgacacggcatctgatgtgcttgatgggcaggctgaatccagaattaccgtgcagatcgatgtctgggcgacagtacctgatgacgcagataatattcgtgagcaggcgcttgatgcggtaagaaaactggcaccctccgttatttctaaaacgcagggttatgatcctgactcccgtctgagcagagccacgcttgaattccaagtaatagcctga

SEQ ID NO: 2420 - protein, 114 aa, Escherichia coli
MREATLYSLLSQLAGGQVYPYVVPLTEGKPAVSPPWLVFSVVSDTASDVLDGQAESRITVQIDVWATVPDDADNIREQALDAVRKLAPSVISKTQGYDPDSRLSRATLEFQVIA

SEQ ID NO: 2421 - DNA, 705 bp, Escherichia coli
atgtcctctaattttgagcgttcgcaactgacgaaaattatgatttcgtctgcaccggtaacagcagaaaccctggattctgccagctatcttggcctgagctgtacaatcaaagaggtgcagtttaccgcaggacaaaagcaggatattgatgtcaccacgctgtgttctgttgagcaggaaaatattaacggccttggggctgcttcagagatttccatgtcaggcaacttttatctgaatgctgcccagaacgcgttgcgcagtgcctatgacaatgacaccacgtatggctttaaagttatttttccgtcaggcaacggatttacctttatggcagaggtgcgtcagcatacctggtctgcaggaaccaatggtgttgtggctgcaacgttttccttgcgcctgaaaggtaaacctgtgctgacgacagagccgctgaaagtgaaggccgatttaaaaagcacgctgcgggttgcttccggagcgaaacttgaaatggcggttgaggctgcgggtggtgtgccgccttattcttatgtctggaagaaaggtggttctcctgtttccggacagacggcggcaacgttcagtaaggcattggtagtatccggtgatgcgggtgcatatacctgcgagatttctgattcagcaagcccggttaacaaagtgacctccacttcctgcactgtaaccgtcagttaa

SEQ ID NO: 2422 - protein, 234 aa, Escherichia coli
MSSNFERSQLTKIMISSAPVTAETLDSASYLGLSCTIKEVQFTAGQKQDIDVTTLCSVEQENINGLGAASEISMSGNFYLNAAQNALRSAYDNDTTYGFKVIFPSGNGFTFMAEVRQHTWSAGTNGVVAATFSLRLKGKPVLTTEPLKVKADLKSTLRVASGAKLEMAVEAAGGVPPYSYVWKKGGSPVSGQTAATFSKALVVSGDAGAYTCEISDSASPVNKVTSTSCTVTVS

SEQ ID NO: 2423 - DNA, 372 bp, Escherichia coli
atgactaaaaatatccgtaatctggcactggcaacgatgtcggggtttcgccataaaaccgttgatgtgcctgaatgggagggagcaacggttgtgttacgggaaccttctgcagaagcctggttgcgctggcaggagatcgttaaagcaaaagatgatgagacaccgttatccgttgcggagcgcgcccgccgaaatctggaggcagatgttgaactgttcattgatgttctgtgtgataccggactgcaacccgtattttcagaggatgatcgtgaacaggtgattgccgtgtatggcccggtgcatgcgcggcttcttcggcagtctctggaactgatcagtgatgccggcgaggttaaaaaaaagtag

SEQ ID NO: 2424 - protein, 123 aa, Escherichia coli
MTKNIRNLALATMSGFRHKTVDVPEWEGATVVLREPSAEAWLRWQEIVKAKDDETPLSVAERARRNLEADVELFIDVLCDTGLQPVFSEDDREQVIAVYGPVHARLLRQSLELISDAGEVKKK

SEQ ID NO: 2425 - DNA, 291 bp, Escherichia coli
atgcgttttctgatgatgctggcgctcaggatggggcgcacattgtcagagttacgccgggaaatgtccgcatcagaaatcatgatgtgggcagaatttgacaggttcagcccgctgggggacgaacgggctgatatccgggctgcccagattgtttcagctgtttacggtgcgcagggggtcaaagtgccactgaatgatgcgcttcttcagtgggagaaggagcagacagaaggcgtatcagatccatttgccggactggaaaacgcgcttttaatagtgtctcagtga

SEQ ID NO: 2426 - protein, 96 aa, Escherichia coli
MRFLMMLALRMGRTLSELRREMSASEIMMWAEFDRFSPLGDERADIRAAQIVSAVYGAQGVKVPLNDALLQWEKEQTEGVSDPFAGLENALLIVSQ

SEQ ID NO: 2427 - DNA, 3234 bp, Escherichia coli
atgagtgtggcgacattacgtgaactgattattaaaatctcggcaaattcccggtcattccagtcagagatctcccgggcttcgcgtatggggcaggattactaccgtaccatgcagaacggaggccggcagtccgctgctgcatcccgtgaaatgcggcgtgcactggcagaagtgacggatcagataaatacagctaaatcttcggcactgaatatggcgggggcatttgccggggcttttgctaccggtcatcttatttctttcgccgatgagtggaattcagtaaatgcccgtctgaagcaggcctcacagtccagtgatgattttcaggcatcacagcgtgaattaatggcgatcagccagagaacggggacggcgttttctgataacgccagcctttttgcccgttctgcagcttccatgcgggagtatggttacagttctgaggaggtactgaaagtcaccgaggcgatctccacgggcctgaaattatccggtgccagtacagcagaagccagttcggtgatcacgcagttcagtcaggcactggcgcagggagtgctgcgcggtgaagagtttaactcggtgaatgagaacggcgatcgtgttattcgtgcgctggctgcgggaatgggggttgcccgtaaggatctgaaggccatggcggataacggaaagttgaccgccgataaggttgttcctgcactgattagtcagcttggggcattacgtgatgaatatgcggcaatgcctgatacggtttcatcctctgcaaccaaagttgaaaacgcctttatggcctgggttggtggtgcgaacgaggcaagcggagtgacgaagacgctctccggtgtgctgaatggtattgcaggcaatattgacactgtggcaaccgctgccggtgctctggttgccgtcggggtagcccgatattttggcaatatggcgtcttctgctggatctgcaactgccggattaattactgcagccagaaacgaagtggctcttgcggaagcgcagctccgggggacacagatagcaacagccagggcgcgtgcggcggtttatcgtgcgcaacaggcggttgttgctgctcgcggtaccgaaaggcaggcagccgcagaagcgaaactggctgctgcccaggcatcacttacccgtaatattgcggccagaacagcagcacagacaacgctgaatactgtcacgtcagtgggaagtcgtctgttaagtggagcactgggactggttggtggggtgccggggcttgtcatgctgggggccgcggcctggtacacgatgtatcagaatcaggagcaggccagagaatctgcacgccagtatgccgcaacaatcgacgaaattcgccagaaaacgtcggcaatgtcgcttcctgaagcgtcagataatgaggaaaagacgcggcaggcacttgatgagcaaaacaggttaattgacgagcagaaaagtaagattaaatccttacaggaaaaaattgctggctatcagtatgtgctggcaaacccgggctggacaaccgataacggttttatgattaaccacatgacgtcggtaaaaacagtcacagaagggcttgcagaagcaacaaatcaactggcagttgaacagtcccgtctcacacaaatgcagggcaaagcgcaatccattcaggatgtgcttgccgggctggaggagcggcgggttgcgttgatccgtcaacaggcggcggaacaaaacaaagcgtatcagtccctgttgatcatgaatgggcagcataccgagtttaatcgccttcttgggcttggtaatgaattacttcagcagcgacaggggctggtgaatgtaccgttacggctaccacaggcaaccctggatgataaacagcagaccgcactgaataacagcaagcgcgaactggctctgtcccgccttaagggggaagcgcgtgagcgtgcccgactgggctatgctgcggatgatctcggctttgtgggagaggcgtatcagacagccagacagaattatatcaataactcactggatgcctggcgaaataaccaggcaaataaacccaaagcgcataaaaagaccgaagcggaaaaaacagaagatatttataaacggctgattaaacagcaaaaagaacagatagcactggcagggcagaatactgaactggctaagatgaaatatcaggtcagtcagggcgaattatcaaccctgtcagaagcgcagaaaaaaacgcttttgcagaatgcagcactcatcgaccagaaaaagattcgtgagcagcttgctgcgtatgaaagcagcctggcggacagtaatgccagtacccgggcgtctaacgacgcgcagttactgggatatggtgaaggctcacggatgcgtgaacgactccaggaaatgtggagtatccggcatgagtttgagcagaaaaataacgagctgctgagacagtatcaggccggagaaattgaagaagccctgtggaaacaggagaaagaactgaataaaaaatatctggaagagcgtctcagcgatcagcaggattattatgcaaaggccgatgctttacgtaataactggaatgcaggactccaggaggggctgaccaactgggcagacagtgccaccgattatgcttcgcaggcggcagatgctgtcgtttccactatggacgggctggtatcaaatatttccgatgcgctggccggaaatgttgtggactggagaaactgggggagttcaattctccaggaagtttcaaaaattctgatgaatgcggccattgttaacggactgaagtcactctccggtgccggagggtggcttggtacggtcggcggatggatttcgggggcggtggcaaacgcaaaaggtggtgtttacacatcggcaaatctgagtgcttacagtaacactattgtggatacaccgacgtattttgcttttgcgaaaggtgccgggctgatgggcgaggccgggcctgaagctatcatgccactgacacgggcagcggacggctctcttggggtcagagccattggcaatgtgaatagtggcgggggggttgtttattctcccgtgtatcacatcagcattcagaatcaagggagcaatggcgagatagatgcgcgctcagccaggggactggtggatctgatcgacagcagggttgtgtcaattatgcagtcatcgcgtcgggatggaggattgtacagtgcctga

SEQ ID NO: 2428 - protein, 1077 aa, Escherichia coli
MSVATLRELIIKISANSRSFQSEISRASRMGQDYYRTMQNGGRQSAAASREMRRALAEVTDQINTAKSSALNMAGAFAGAFATGHLISFADEWNSVNARLKQASQSSDDFQASQRELMAISQRTGTAFSDNASLFARSAASMREYGYSSEEVLKVTEAISTGLKLSGASTAEASSVITQFSQALAQGVLRGEEFNSVNENGDRVIRALAAGMGVARKDLKAMADNGKLTADKVVPALISQLGALRDEYAAMPDTVSSSATKVENAFMAWVGGANEASGVTKTLSGVLNGIAGNIDTVATAAGALVAVGVARYFGNMASSAGSATAGLITAARNEVALAEAQLRGTQIATARARAAVYRAQQAVVAARGTERQAAAEAKLAAAQASLTRNIAARTAAQTTLNTVTSVGSRLLSGALGLVGGVPGLVMLGAAAWYTMYQNQEQARESARQYAATIDEIRQKTSAMSLPEASDNEEKTRQALDEQNRLIDEQKSKIKSLQEKIAGYQYVLANPGWTTDNGFMINHMTSVKTVTEGLAEATNQLAVEQSRLTQMQGKAQSIQDVLAGLEERRVALIRQQAAEQNKAYQSLLIMNGQHTEFNRLLGLGNELLQQRQGLVNVPLRLPQATLDDKQQTALNNSKRELALSRLKGEARERARLGYAADDLGFVGEAYQTARQNYINNSLDAWRNNQANKPKAHKKTEAEKTEDIYKRLIKQQKEQIALAGQNTELAKMKYQVSQGELSTLSEAQKKTLLQNAALIDQKKIREQLAAYESSLADSNASTRASNDAQLLGYGEGSRMRERLQEMWSIRHEFEQKNNELLRQYQAGEIEEALWKQEKELNKKYLEERLSDQQDYYAKADALRNNWNAGLQEGLTNWADSATDYASQAADAVVSTMDGLVSNISDALAGNVVDWRNWGSSILQEVSKILMNAAIVNGLKSLSGAGGWLGTVGGWISGAVANAKGGVYTSANLSAYSNTIVDTPTYFAFAKGAGLMGEAGPEAIMPLTRAADGSLGVRAIGNVNSGGGVVYSPVYHISIQNQGSNGEIDARSARGLVDLIDSRVVSIMQSSRRDGGLYSA

SEQ ID NO: 2429 - DNA, 699 bp, Escherichia coli
atgcaggatatacagcaggaaacactcaatgagtgcactaaaacggagcaatccgcgctgatcgtgctctgggaaattgatctgacagaggtcggcggagatcgttatttcttctgtaatgagcagaacgaaaaaggtgaaccagtcacctggcagcggcggcagtatcaggcctatcccattcagggaagtggatttgagatgaacggcaaaggagccagtgcaaggccaacgcttaaagtctctaatctgtacggcatggtcaccgggatggcggaagacctgcagagtctggtcggcggaacggtggtcaggcgtaaggtttacgcccgttttctggatgcggtgaacttcgtcaacggaaacagtgacgccgacccggagcaggaggtgatcagccgctggcgcatcgagcagtgcagcgaactgagtgcggtcagtgcttcttttgtactgtccacgccgacggaaacggatggtgcggtttttccggggcgcatcatgctggccaacacctgtacctggacctatcgcggtgatgagtgcggttatagcggtccggctgtcgcggatgaatatgaccagccgacgtccgatatcacgaaagataaatgcagcaaatgcctgagtggctgtaagtttcgcaataacgtcggcaactttggcggctacctttccatcaacaaactttcgcagtaa

SEQ ID NO: 2430 - protein, 232 aa, Escherichia coli
MQDIQQETLNECTKTEQSALIVLWEIDLTEVGGDRYFFCNEQNEKGEPVTWQRRQYQAYPIQGSGFEMNGKGASARPTLKVSNLYGMVTGMAEDLQSLVGGTVVRRKVYARFLDAVNFVNGNSDADPEQEVISRWRIEQCSELSAVSASFVLSTPTETDGAVFPGRIMLANTCTWTYRGDECGYSGPAVADEYDQPTSDITKDKCSKCLSGCKFRNNVGNFGGYLSINKLSQ

SEQ ID NO: 2431 - DNA, 744 bp, Escherichia coli
atgacagagacagaatcagcgattctggcgcacgcccggcgatgtgcgccagcggagtcgtgcggcttcgtggtgagaacgccggagggggaaagatatttcccctgcgtgaatatctccggtgagccggaagattatttccggatgtcgccggaggactggctgcaggccaaaatgcagggtgagattgtggcgctggtccacagtcaccccggtggtctgccctggctgagtgaggctgacaggcggctgcaggtgcagagtgatttgccgtggtggctggtctgccggggggcgattcataagttccgctgtgtgccgcatcttaccgggcggcgctttgagcacggggtgacggactgttacacgctgttccgggatgcttatcatctggcggggattgagatgccggattttcatcgtgaggatgactggtggcgtcacggtcagaatctctatctggataatctggaggccacagggctgtatcaggtgccgttgtcatcagcacaaccgggcgatgtgctgctgtgctgctttggttcatcggtgccgaatcatgccgccatttactgcggcgacggcgagctgctgcaccatattcctgaacaactgagcaaacgagagaggtataccgacaaatggcagcgacgcacacactccctctggcgtcaccgggcatggcacgcatctgcctttacggggatttgcaacgatttggccaccgcatcgaccttcgtgtga

SEQ ID NO: 2432 - protein, 247 aa, Escherichia coli
MTETESAILAHARRCAPAESCGFVVRTPEGERYFPCVNISGEPEDYFRMSPEDWLQAKMQGEIVALVHSHPGGLPWLSEADRRLQVQSDLPWWLVCRGAIHKFRCVPHLTGRRFEHGVTDCYTLFRDAYHLAGIEMPDFHREDDWWRHGQNLYLDNLEATGLYQVPLSSAQPGDVLLCCFGSSVPNHAAIYCGDGELLHHIPEQLSKRERYTDKWQRRTHSLWRHRAWHASAFTGICNDLATASTFV

SEQ ID NO: 2433 - DNA, 582 bp, Escherichia coli
ttgcaacgatttggccaccgcatcgaccttcgtgtgaaaacgggagccgaagctatccgggcgctggccacgcagctcccggcgtttcgtcagaaactgaatgagggctggtatcaggtgcgcattgccgggcgtgatgcaggcgaaaacgaattatctgcccgtcttaatgagccgctggcaaatggtgccgtgatccacatcgtaccgcgtctggcgggtgccaaaagtggcggtgtttttcaggcagtgctgggggctgcgctgattgcggtggcatggtggaaccctgtgggctggctgggtgccgcggctgtatcgggtatgtatgcggcaggggccagtatgatcctgggcggtgtggcgcagatgctggcaccgaaagccagaactccccgcacacagacaacggataacggcaaacagaacacgtatttctcctcactggataacatggttgcccaggggaatgttctgcccgttctgtacggtgaaatgcgcgtggggtcacgcgtggtatctcaggagatcagcacggcagacgaaggggatggtggtcaggttgtgatgattggtcgatga

SEQ ID NO: 2434 - protein, 193 aa, Escherichia coli
MQRFGHRIDLRVKTGAEAIRALATQLPAFRQKLNEGWYQVRIAGRDAGENELSARLNEPLANGAVIHIVPRLAGAKSGGVFQAVLGAALIAVAWWNPVGWLGAAAVSGMYAAGASMILGGVAQMLAPKARTPRTQTTDNGKQNTYFSSLDNMVAQGNVLPVLYGEMRVGSRVVSQEISTADEGDGGQVVMIGR

SEQ ID NO: 2435 - DNA, 555 bp, Escherichia coli
atgggtaaaggcagcagtaaggggcataccccgcgcgaagcgaaggacaatctgaagtccacgcagttgctgagtgtgatcgatgccatcagtgaagggccggttgaaggtccggtggatggcttaaaaagcgtgctgctgaacagtacaccggtgctggacagtgaggggaataccaacatctccggcgtaacggtggtgttccgggcaggtgagcaggagcagactccgccggagggatttgaatcctccggctccgagacggtgctgggtacggaagtgaaatatgacacgccgatcacccggaccatcacgtcggcaaacattgaccgtctgcgctttaccttcggtgtgcaggcactggtggaaaccacctcaaagggggaccggaatccgtcggaagtccgyctgctggttcagatacagcgtaayggtggctgggtgacggaaaaagacatcaccattaagggcaaaaccacctcgcagtatctggcctcgggtggtggtggggtaacctgccgccgcgcccgttcaatatmcggatgcgcaggatga

SEQ ID NO: 2436 - protein, 184 aa, Escherichia coli
  Xaa 180: Xaa is any amino acid
MGKGSSKGHTPREAKDNLKSTQLLSVIDAISEGPVEGPVDGLKSVLLNSTPVLDSEGNTNISGVTVVFRAGEQEQTPPEGFESSGSETVLGTEVKYDTPITRTITSANIDRLRFTFGVQALVETTSKGDRNPSEVRLLVQIQRNGGWVTEKDITIKGKTTSQYLASGGGGVTCRRARSIXGCAG

SEQ ID NO: 2437 - DNA, 498 bp, Escherichia coli
gtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacgttcgtgcaggaccgaccgtcggataaggtgtggacctataaccgcagtaatgtggtgatgccggatgatggcgcgccgttccgctacagcttcagcgcccctgaaggaccgccataa

SEQ ID NO: 2438 - protein, 165 aa, Escherichia coli
MSRNYHLRGRILQVPSNYNPQTRQYSGIWDGTFKPAYSNNMAWCLWDMLTHPRYGMGKRLGAADVDKWALYVIGQNCDQSVPDGFGGTEPRITCNAWLTTQRKAWDVLSDFCSAMRCMPVWNGQTLTFVQDRPSDKVWTYNRSNVVMPDDGAPFRYSFSAPEGPP

SEQ ID NO: 2439 - DNA, 2559 bp, Escherichia coli
atggcgcgccgttccgctacagcttcagcgcccctgaaggaccgccataatgccgttgaggtgaactggattgacccggataacggctgggagacggcgacagagcttgttgaagatacgcaggccattgcccgttacggtcgtaacgtcacgaagatggatgcctttggctgtaccagccgggggcaggcgcaccgcgccgggctgtggctgattaaaacggaactgctggaaacgcagaccgtggacttcagcgtgggtgccgaagggcttcgccatgtaccgggcgatgtcattgaaatctgcgatgatgactatgccggtatcagcaccggcgggcgcgtgctggcggtaaacagccagacccggacgctgacgctcgaccgtgaaatcacgctgccatcctccggcaccacgctgataagcctggttgacgggcagggtaatccggtgagcgtggaggtccagtccgtcaccgacggtgtgaaggtgaaagtgagccgtgttcctgacggcgttgccggatacagcgtgtgggggctgaagctgccgacgctgcgccagcgcctgttccgctgtgtgagtatccgtgagaatgacgacggtacgtatgccatcaccgccgtacagcatgtaccggcaaaagaggccatcgtggataacggggcgcactttgacggcgaccagagcggcacggtgaatggtgtcacgccgccagcggtgcagcacctgaccgccgaagttaccgcagacagcggggaatatcaggtgctggcgcgctgggacacgccgaaggtggtgaagggcgtgagctttatgcttcgcctgaccgtggcagcggatgacggcagtgagcggctggtcagcacggcccggacgacggaaaccacataccgcttcacgcaactggcgctggggcggtacacgctgacagtccgggcagtaaatgcgtgggggcagcagggcgatccggcatcggtatcgttccggattgccgcaccggcagcgccgtctcggattgagctgacgccggggtattttcagataacggcggtcccgcgtcttgcggtgtatgacccgacggtacagtttgaattctggttctcagaaaaacgcatcacgaacacagcacaggtggaaaaatctgcccgttatctggggaccggcagtcagtggactgtccaggggagccggattaagccggggacggatttctggttttacgtgcgcagcgtcaacctggtggggaaatctgcttttgtggaagccagcgggcagcccagcaatgatggtgaagggtatctggaaattttccgggggctgatagatgagacgcttctgggtcaggcactgaaagagcgcattgatgcttcagcgctgcgtacggaggtcacgcaactggaagaagatatccgtcagcggatggacacggatatcgcagaagtgacccggaaaatcgggaaggcggaaaacagcctcacgcagctggttgcgaaaaagaatgaggaccagacactggccatcgcgcaggtgagccagaaagtggaccgggtgagcagtgaaatctcacagactgtcagccaggggcagtcagaaaacgcccgacagatagcacaggtccgccagtacgtggataaaaaagggagtgaaattacctcgaccacggataaaaagctgggtgaccaggccgtgaccatacagcaaatccagcgggttcagtcagacacgcgcaatgagctgaatgccatgtatatgctgaaggtgcagaaaacaaaaaacggtattccctatgtggccgggattggcgcggggattgaggatgttgatgatcagaccctgagtaacattctgctgcaggccgatcgcattgcgatgattaccccggagaacggcaacaccacgccgctgtttgtggcgcaggggaatcagctgttcatgaacgacgtgttcctgaagcgactgtttgcggtgagcatcacgtcatccggcaatcctccgacgttttccctgacgccggatggcaggctgacagcccgcaatgcggatatcagtggagccatcacggcgaataccggcacgctcaataatgtcaccattaacgagaactgtgtcatcagagggaaactgtctgcaaaccagattgaaggcgatctcgttaaaacagtgggtaaggctttcccccgtgactcccgtgcaccgaagcgttggccatcaggaaccattaccgtcagggtttatgacgatcagccgtttaaccggcagattgttattccggcggtggctttcagcggtgccagacatgagcgggagaacagcgatacttattcgtcatgccgcctgatagtgaagaaaaacggtgctgaaatttataaccgtaccgcgctggataatacgctggtttacagtggtgttattgatatgcctgctggtcgcggtcacatgacgctggagttttctgtatcagcatggtgggtaaatggctggtatcccacagcaagtatcagcgatttgctggttgttgtgatgaagaaagccactgcaggcatcacgattagctga

SEQ ID NO: 2440 - protein, 852 aa, Escherichia coli
MARRSATASAPLKDRHNAVEVNWIDPDNGWETATELVEDTQAIARYGRNVTKMDAFGCTSRGQAHRAGLWLIKTELLETQTVDFSVGAEGLRHVPGDVIEICDDDYAGISTGGRVLAVNSQTRTLTLDREITLPSSGTTLISLVDGQGNPVSVEVQSVTDGVKVKVSRVPDGVAGYSVWGLKLPTLRQRLFRCVSIRENDDGTYAITAVQHVPAKEAIVDNGAHFDGDQSGTVNGVTPPAVQHLTAEVTADSGEYQVLARWDTPKVVKGVSFMLRLTVAADDGSERLVSTARTTETTYRFTQLALGRYTLTVRAVNAWGQQGDPASVSFRIAAPAAPSRIELTPGYFQITAVPRLAVYDPTVQFEFWFSEKRITNTAQVEKSARYLGTGSQWTVQGSRIKPGTDFWFYVRSVNLVGKSAFVEASGQPSNDGEGYLEIFRGLIDETLLGQALKERIDASALRTEVTQLEEDIRQRMDTDIAEVTRKIGKAENSLTQLVAKKNEDQTLAIAQVSQKVDRVSSEISQTVSQGQSENARQIAQVRQYVDKKGSEITSTTDKKLGDQAVTIQQIQRVQSDTRNELNAMYMLKVQKTKNGIPYVAGIGAGIEDVDDQTLSNILLQADRIAMITPENGNTTPLFVAQGNQLFMNDVFLKRLFAVSITSSGNPPTFSLTPDGRLTARNADISGAITANTGTLNNVTINENCVIRGKLSANQIEGDLVKTVGKAFPRDSRAPKRWPSGTITVRVYDDQPFNRQIVIPAVAFSGARHERENSDTYSSCRLIVKKNGAEIYNRTALDNTLVYSGVIDMPAGRGHMTLEFSVSAWWVNGWYPTASISDLLVVVMKKATAGITIS

SEQ ID NO: 2441 - DNA, 600 bp, Escherichia coli
atgcgtaaagtttgtgcagccattttgtccgcagccatctgtctgtccgtatccggtgcgcctgcatgggcgtctgaacatcagtccacactgagcacagggtatcttcatgcccgtacgaacgctcccggcagcgataatctgaacgggattaacgtgaaataccgttatgagtttacggacacgctggggctgattacgtccttcagttatgccaatgctgaagatgagaaaaaaacgcactacagcgatacccgctggcatgaggattctgtgcgtaaccgctggttcagcgtgatggcggggccatctgtgcgcgtgaatgaatggttcagcgcgtatgtgatcgctggtgtgacttacagccgtgtgtcgactttttccggggattatctccgtgtaactgacagcaaggggaaaacgcacgatgtgctgaccggaagtgatgacgatcgccacagcaacacgtctctggcgtggggagctggcgtgcagtttaacccgaccgaatccgtggccattgaccttgcttatgaaggttccggcagtggtgactggcgcactgacggtttcatcgtgggtgtcggttataaattctga

SEQ ID NO: 2442 - protein, 199 aa, Escherichia coli
MRKVCAAILSAAICLSVSGAPAWASEHQSTLSTGYLHARTNAPGSDNLNGINVKYRYEFTDTLGLITSFSYANAEDEKKTHYSDTRWHEDSVRNRWFSVMAGPSVRVNEWFSAYVIAGVTYSRVSTFSGDYLRVTDSKGKTHDVLTGSDDDRHSNTSLAWGAGVQFNPTESVAIDLAYEGSGSGDWRTDGFIVGVGYKF

SEQ ID NO: 2443 - DNA, 285 bp, Escherichia coli
ttggcttcactgtctttggcattcgtctcactggttttcgctgccgtctggctggattttgcgtttttttcgctggcctttgtggctgtctcgctatttttcgcgttggtttctgattttttggctgctgtcgcggagtttgccgatgcagtctgcgaggccgctgccgcctgtgcgctgttagctgcattcgtttctgaggttttcgccgcattcttcgatgaggctgctgccgtttcggatttctttgccgccgctgcactctgtgatgacgctccggcatga

SEQ ID NO: 2444 - protein, 94 aa, Escherichia coli; identical to SEQ ID NO: 1360

SEQ ID NO: 2445 - DNA, 2067 bp, Escherichia coli
atggcagcagtaaaaatctcaggtgtgctgaaagatggtgcgggaaaaccaatacagaactgcactattcagttgaaggcaaagcgtaacagcaccacggtactggtgaacacggtggcctctgaaaatccggatgaagccgggcgttacagcatggatgttgagtatggccagtacagcgtcatcctgctggttgaaggttttccgccttcacatgccgggaccattaccgtctatgaaggttccagaccaggtacgctgaatgattttctcggtgccatgacggaggatgatgttcgtccggaggcactgcgccgttttgagctgatggtgaatgaagtggcacgtcatgccggagcgtcatcacagagtgcagcggcggcaaagaaatccgaaacggcagcagcctcatcgaagaatgcggcgaaaacctcagaaacgaatgcagctaacagcgcacaggcggcagcggcctcgcagactgcatcggcaaactccgcgacagcagccaaaaaatcagaaaccaacgcgaaaaatagcgagacagccacaaaggccagcgaaaaaaacgcaaaatccagccagacggcagcgaaaaccagtgagacgaatgccaaagacagtgaagccaacgcaaaggtgagcgaaacagcggcggcgaactcggcgaaagcatcggcagcaagccagacggcagcaaaagcaagtgaagatgctgccagagaatacgcaaaccagacagcagagccgtacagatatgttttacagccgctgccggatgtgtggataccctttaatgattcgctggatatgattacgggctattctccgggttataaaaaagtgaagattggtgataatgtggttcaggttgccagtgataaacaggttaatttcagtcgcgcatcaacggcaacatatatcaacaaatctggcgaactgaaaacggcggaaattaatgagccacgatttgaaaaagaaggtttattgattgaaggtcagcgaaccaactacatgttgaattcagcaactccagcttcttggggtaaatctgcaaatatgaatgtcgctgaggttggaactgatagttttggttttacttatggaaagtttgtttgtaacgattctctgattgggcaaacgtcagccattaatatggcatcaattgctgctacaaagtcagttgatgtttcaggcgataacaagtacgtgacaacctcatgtcgttttaaaacagaacgacaggtaaggttgcgtatccgctttgataaatatgacggtagtgcaacaacttttcttggtgatgcatatattgatacacaaacgcttgaaattaatatgacaggtggcgcggcctcaaggattacagcgagagtcagaaaggacgaagctaccggatggatttttgcagaggcaacaatcctggcaattgatgatgagttaaaaataggatctcagatacagtattctcctaatcagggcggagcaaccgtatctggagactatatttatctggccacccctcaggttgaggatggttcgtgtgcatcatcttttattatctcaggaacgacggcggctacccgcgcaagcgatatagttacagttccaattaataataatctttataatcttccttttacggttctttgtgaggtacataagaactggtataaaacgccaaatgcagcgccacgtgtttttgataccggcggtcatcaaaccggagcggctattattcttggcttcggatcttcggcagatgggccagacggatttccttattgcgatattggtggatcaaataggcgtgttaacgaaaacgcatcgttgaaaaaaatggttatggggatgcgtgtaaagtcagatcagtctacatgtgcagtaagtaacgggcgtatatccagcgaaacaaaaaccacatgggaatatatccggagtacagcaaccattcgcattggtggacaaactacagcaggattacgccatttatttgggcatgtgaggaattttcgtctctggcataaagagctaacagatgcgcagcttggggaggttgtggagtga

SEQ ID NO: 2446 - protein, 688 aa, Escherichia coli
MAAVKISGVLKDGAGKPIQNCTIQLKAKRNSTTVLVNTVASENPDEAGRYSMDVEYGQYSVILLVEGFPPSHAGTITVYEGSRPGTLNDFLGAMTEDDVRPEALRRFELMVNEVARHAGASSQSAAAAKKSETAAASSKNAAKTSETNAANSAQAAAASQTASANSATAAKKSETNAKNSETATKASEKNAKSSQTAAKTSETNAKDSEANAKVSETAAANSAKASAASQTAAKASEDAAREYANQTAEPYRYVLQPLPDVWIPFNDSLDMITGYSPGYKKVKIGDNVVQVASDKQVNFSRASTATYINKSGELKTAEINEPRFEKEGLLIEGQRTNYMLNSATPASWGKSANMNVAEVGTDSFGFTYGKFVCNDSLIGQTSAINMASIAATKSVDVSGDNKYVTTSCRFKTERQVRLRIRFDKYDGSATTFLGDAYIDTQTLEINMTGGAASRITARVRKDEATGWIFAEATILAIDDELKIGSQIQYSPNQGGATVSGDYIYLATPQVEDGSCASSFIISGTTAATRASDIVTVPINNNLYNLPFTVLCEVHKNWYKTPNAAPRVFDTGGHQTGAAIILGFGSSADGPDGFPYCDIGGSNRRVNENASLKKMVMGMRVKSDQSTCAVSNGRISSETKTTWEYIRSTATIRIGGQTTAGLRHLFGHVRNFRLWHKELTDAQLGEVVE

SEQ ID NO: 2447 - DNA, 279 bp, Escherichia coli
gtgagagatttcacgttgcgtttcagtgataaagcagatttcagggcatttctcaggaaacttaactgggaagaggacgaagagctgcagaatgccgttctggttgatgagattggttttacgttcagggagacagatgttcctgatgacggagaaccagaatacacgcgaaacgaagggtactttgttaatatccgtcttcttgacgatggatttgatgattccgtgttccgtgagtgggtggttacaccagagcgcccgctcagggagtggttttaa

SEQ ID NO: 2448 - protein, 92 aa, Escherichia coli
MRDFTLRFSDKADFRAFLRKLNWEEDEELQNAVLVDEIGFTFRETDVPDDGEPEYTRNEGYFVNIRLLDDGFDDSVFREWVVTPERPLREWF

SEQ ID NO: 2449 - DNA, 291 bp, Escherichia coli
atggatatcacgtcgatacttcatgcgctttgtgccgtagcggtgcaggtactggctggtctttttaccggaaactgggcttacggggcgatagccggttgtacgttcttcattgcgcgtgaacacacccaggcagaatatcgctggattgaaatgttcgggcatggcaagcgtatgaatatgccgtggtggggtggttttgacccgcgcgtgtgggatatggcaagtctgatggattttgctgtgccggtggtggcgtgtctgctgatctggctgttggttaatcggtaa

SEQ ID NO: 2450 - protein, 96 aa, Escherichia coli
MDITSILHALCAVAVQVLAGLFTGNWAYGAIAGCTFFIAREHTQAEYRWIEMFGHGKRMNMPWWGGFDPRVWDMASLMDFAVPVVACLLIWLLVNR

SEQ ID NO: 2451 - DNA, 714 bp, Escherichia coli
gtggataaaaaactaattgcatttttgtgcacacttataattactggttgctcgaatgggatcggggattcaccttcccctccgggaaaaaatgtagaattggttggaatccctggacaaggtattgcagtgacttcaaacggtgcaactccaacacttggagccaacaacactgagtttcctgaagtttcaataatgagcactggtggggcgctgcttactatttgggccagacctgttcgtaactggctttgggggtatactccttttgattcagtaaattttggtgagaatcggaactggaaggttgtggatggaaaagatgccggcacagtgaaatttgttaatgttgcccaggggacttgcatggaggcctttaaaaacggggtgatacataatacctgtgatgataactcgttatctcaggagtttcagttactgccttctactaatggtaatgtgcttataagaagtagtgccttgcagacgtgtataagagcagactatttaagcagaactatactgtcaccgtttgcttttacaatcacccttgagaaatgccctggtgcaaaagaagaaacgcaagaaatgctatgggcaataagtccacctgtcagagcggcaaaaccaaatctgattaagccagagttaagaccattcagaccattgccaattccacctcatgacaaacctgatggaatggagggagtatga

SEQ ID NO: 2452 - protein, 237 aa, Escherichia coli
MDKKLIAFLCTLIITGCSNGIGDSPSPPGKNVELVGIPGQGIAVTSNGATPTLGANNTEFPEVSIMSTGGALLTIWARPVRNWLWGYTPFDSVNFGENRNWKVVDGKDAGTVKFVNVAQGTCMEAFKNGVIHNTCDDNSLSQEFQLLPSTNGNVLIRSSALQTCIRADYLSRTILSPFAFTITLEKCPGAKEETQEMLWAISPPVRAAKPNLIKPELRPFRPLPIPPHDKPDGMEGV

SEQ ID NO: 2453 - DNA, 822 bp, Escherichia coli
atgaaaaaattattattcctgttaatgattttgccgggtatttcttttgcagatttaagcgattttaaagttgcaacctggaatttgcaggggtcaaatgcaccgacagaaaataaatggaacacacatgtccgacaacttgttacgggaagtggtgctgttgatatcgtgatggttcaggaggcaggggcagtaccagcttctgcaacgttgactgagcgagaatttagcactcccggtattccgatgaatgagtatatctggaataccggaaccaatagtcgtccacaggagttgtttatatatttctcacgtgttgatgcattcgctaacagagtaaatcttgcgattgtttcaaacagaagagctgatgaggtgattgtattacctcctccaactgttgtatcacgaccgatcatcggcattagaattggtaatgatgttttcttctcaacccatgcattggcgaatcgaggcgtggattcaggagcaattgtaaatagtgtttttgagttcttcaacagacaaacggatcctataagacaggccgctaactggatgattgcaggagattttaaccgttcaccggctacactattttcaactcttgaaccagggattcgtaatcatgtaaatattattgctccaccagatccaacgcaagccagtggtggtgttcttgattatgcggtagttggaaattcagtgagctttgtacttcctctgttgagggcctcgttgttattcggattattaagagggcaaattgcctctgatcactttccagttggctttattcctggaagaggagcaagaagatga

SEQ ID NO: 2454 - protein, 273 aa, Escherichia coli
MKKLLFLLMILPGISFADLSDFKVATWNLQGSNAPTENKWNTHVRQLVTGSGAVDIVMVQEAGAVPASATLTEREFSTPGIPMNEYIWNTGTNSRPQELFIYFSRVDAFANRVNLAIVSNRRADEVIVLPPPTVVSRPIIGIRIGNDVFFSTHALANRGVDSGAIVNSVFEFFNRQTDPIRQAANWMIAGDFNRSPATLFSTLEPGIRNHVNIIAPPDPTQASGGVLDYAVVGNSVSFVLPLLRASLLFGLLRGQIASDHFPVGFIPGRGARR

SEQ ID NO: 2455 - DNA, 555 bp, Escherichia coli
ctttttgttttactgctgacaggttgtgctgctgaacctgcaaatcagcgtaatcttcttactcagtttgtcggcaacaatgcccctgtagaccctgaacccagtccagtattggttaatatcagaaacgttcttacaggggggataatccgaaatcctgttggcagtgactttaatgtaaataattgggttatatctgaagtaaagactaatgatttggatttgatatcggcaccgggagggcatgttcagattaaaaatcctgatggcaatgaatgctttgctattctaaacgggcaattggcagtggctaagcagtgctctgaaagtgaccgtaacgcattgtttacatttataaccagtgatactggggctgtgcaaatcaagtcaataggaagcggtcaatgcctagggaatggagagagcattacagatttcagattaaaaaaatgtgttgatgatcttgggcgtccttttgatacggtgccgccggggttactctggatgctgaatccaccattatctccggcaataatgtctccattaacgagctga

SEQ ID NO: 2456 - protein, 184 aa, Escherichia coli
LFVLLLTGCAAEPANQRNLLTQFVGNNAPVDPEPSPVLVNIRNVLTGGIIRNPVGSDFNVNNWVISEVKTNDLDLISAPGGHVQIKNPDGNECFAILNGQLAVAKQCSESDRNALFTFITSDTGAVQIKSIGSGQCLGNGESITDFRLKKCVDDLGRPFDTVPPGLLWMLNPPLSPAIMSPLTS

SEQ ID NO: 2457 - DNA, 651 bp, Escherichia coli
ttggcgattcgtcttcataaactggctgttgctttaggcgtctttattgttagcgctcctgccttttcgcatggtcatcactcacacggcaaacccttaacagaggtcgaacaaaaagctgctaatggtgtttttgatgataccaatgtacaaaaccgaacactcagtgactgggatggagtctggcaatccgtttatcctttactgcaaagtggcaaacttgaccccgtctttcagaagaaagcggatgcagataaaaccaaaacatttgctgaaattaaagattattatcgcaaaggttatgtgacagatatcgagatgattggcattgaggacggcattgttgaattccatagacataatgaaacaacatcctgtaaatatgattacgatggatacaaaatactcacctataaatcaggcaagaaaggcgttcgttacttattcgaatgtaaagatcctgaaagcaaagcccctaaatatattcaatttagcgatcatataattgcaccacgaaaatcatctcattttcacatttttatgggtaatgatacccaacagtctttattgaatgaaatggaaaactggccaacgtattatccatatcagttgagtagcaaagaagtggtcgaggagatgatgtctcattga

SEQ ID NO: 2458 - protein, 216 aa, Escherichia coli
MAIRLHKLAVALGVFIVSAPAFSHGHHSHGKPLTEVEQKAANGVFDDTNVQNRTLSDWDGVWQSVYPLLQSGKLDPVFQKKADADKTKTFAEIKDYYRKGYVTDIEMIGIEDGIVEFHRHNETTSCKYDYDGYKILTYKSGKKGVRYLFECKDPESKAPKYIQFSDHIIAPRKSSHFHIFMGNDTQQSLLNEMENWPTYYPYQLSSKEVVEEMMSH

SEQ ID NO: 2459 - DNA, 636 bp, Escherichia coli
atgcgtctgacagcaaaacaggtgacatggctgaaagtttgcctgcatcttgccggattgttgccgtttctctggctggcctgggcgatcaatcacggtggactgggtgccgatccggtgaaagatattcagcattttaccggtcgcactgcactgaaatttttgctggcgaccttgttaatcacacctctggcacgctacgcaaaacagccgttattgatacgcactcgccgcctgttaggcttatggtgctttgcctgggcgacactgcatttaaccagttacgcattgctggagctgggcgtgaataatctggcgttattaggtaaggagttaattacccggccttatttaacgttaggtattatcagctgggtaattttgcttgcgttagcgttcacttcaacccaggcgatgcagcgaaaactcggcaaacactggcaacagttgcataacttcgtctatcttgtcgcgatcctggccccaatacattatttgtggtcagtgaagattatttcaccgcagccactcatctacgctgggctggcggtactgcttttagccttacggtataagaagttgctttcccttttcaaccagttacgcaagcaggttcacaacaaattatctctataa

SEQ ID NO: 2460 - protein, 211 aa, Escherichia coli
MRLTAKQVTWLKVCLHLAGLLPFLWLAWAINHGGLGADPVKDIQHFTGRTALKFLLATLLITPLARYAKQPLLIRTRRLLGLWCFAWATLHLTSYALLELGVNNLALLGKELITRPYLTLGIISWVILLALAFTSTQAMQRKLGKHWQQLHNFVYLVAILAPIHYLWSVKIISPQPLIYAGLAVLLLALRYKKLLSLFNQLRKQVHNKLSL

SEQ ID NO: 2461 - DNA, 1005 bp, Escherichia coli
atgaaaaagaatcaatttttaaaagaatcagatgttacggccgagtcggtattctttatgaagcgtcggcaggtgttaaaagcactgggcatcagcgcggctgcactttctttgcctcacgctgcgcatgccgatctgcttagctggtttaaagggaacgatcgcccacccgcccccgccggaaaagcgctggagttcagcaagcctgcagcctggcaaaataacctgccactgacgccagcagataaagtttccggttataacaacttctatgaattcgggttggataaagccgatcccgccgctaatgctggtagcctgaaaaccgatccatggacactgaaaatcagcggcgaagtggcaaaaccattgaccctcgatcacgatgatttaacccgtcgcttcccgctggaagagcgtatttatcgtatgcgctgcgtagaagcatggtcgatggtggtgccgtggattggttttccgctgcacaaattgctggcgcttgccgaacccaccagcaatgcgaagtatgtcgctttcgaaacaatttatgcaccggaacagatgccaggccagcaggaccgctttatcggcggcgggctgaaatatccttatgtcgaaggattgcgtctcgacgaagcaatgcatccgctcacactgatgaccgtaggtgtttatggcaaggcgttaccaccgcaaaatggcgcgccggtgcgactgattgtgccgtggaaatatggctttaaagggattaaatcgatagtcagtattaagctgacccgcgagcgtccgccaaccacctggaatctggcagcgcctgacgaatacggtttttacgccaacgttaatccgcatgttgatcacccgcgctggtcacaggctaccgaacgatttattggttcaggcggcatcctcaatgtacagcgccagccaacgctactgtttaatggttacgccgagcaggtggcatcgctgtatcgtggcctggatttgcgggagaatttctaa

SEQ ID NO: 2462 - protein, 334 aa, Escherichia coli
MKKNQFLKESDVTAESVFFMKRRQVLKALGISAAALSLPHAAHADLLSWFKGNDRPPAPAGKALEFSKPAAWQNNLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILNVQRQPTLLFNGYAEQVASLYRGLDLRENF

SEQ ID NO: 2463 - DNA, 414 bp, Escherichia coli
atgttaaagcgttatttagtactctccgtagtaacggctgcattttcattaccttctttggtctatgctgcacaacaaaacattcttagcgtgcacattttgaaccagcaaacaggaaaacccgctgccgacgtgacagtcactcttgaaaagaaagcggataacggctggttacaacttaataccgccaaaacagataaggatggacgaattaaggcactgtggcccgagcaaactgcgactactggcgattaccgtgtcgtatttaaaaccggggactatttcaagaaacaaaatcttgaaagtttcttccctgagatccccgttgaatttcatattaataaagtgaacgagcattatcatgtgcctttgttactcagccaatatgggtattcaacctatcgtggcagttaa

SEQ ID NO: 2464 - protein, 137 aa, Escherichia coli
MLKRYLVLSVVTAAFSLPSLVYAAQQNILSVHILNQQTGKPAADVTVTLEKKADNGWLQLNTAKTDKDGRIKALWPEQTATTGDYRVVFKTGDYFKKQNLESFFPEIPVEFHINKVNEHYHVPLLLSQYGYSTYRGS

SEQ ID NO: 2465 - DNA, 783 bp, Escherichia coli
atgagttttgaggatagcgaaaaaacgtccagggtaaccttacagcagcattacaattttgtaatgaaccaggctgtttctataacatatgatttatggcatattattttcatgaagattctacttattgaagataatcaaaggacccaggaatgggtaacgcaggggctttccgaagcgggttatgtcattgatgccgtttcagatggcagagatgggctttatcttgcgctgaaggatgattatgcattgatcattctggatattatgcttccgggtatggatggctggcagatcttacaaacgttaagaacagcaaagcaaacccctgttatttgccttactgcaagggattctgtcgatgacagagtcagagggctggacagtggggcaaatgattatctggtaaaacctttttcattttctgagttgctggcaagggttcgggcacaattaaggcaacatcacgctctgaattcatcattagaaatcagcggcttaagaatggactctgtcagtcaaagtgtgagcagggacaatatcagtattacactgacgcgcaaggagtttcagttactttggctactggcctccagagctggcgagattatccccagaacggttattgcgagtgaaatttggggaatcaactttgatagtgataccaatacggtggacgtcgccattcgcaggctccgcgcaaaagttgatgatccttttcctgaaaagctaatctccacaatccgggggatgggctattcattcgtagcggtaaaaaaataa

SEQ ID NO: 2466 - protein, 260 aa, Escherichia coli
MSFEDSEKTSRVTLQQHYNFVMNQAVSITYDLWHIIFMKILLIEDNQRTQEWVTQGLSEAGYVIDAVSDGRDGLYLALKDDYALIILDIMLPGMDGWQILQTLRTAKQTPVICLTARDSVDDRVRGLDSGANDYLVKPFSFSELLARVRAQLRQHHALNSSLEISGLRMDSVSQSVSRDNISITLTRKEFQLLWLLASRAGEIIPRTVIASEIWGINFDSDTNTVDVAIRRLRAKVDDPFPEKLISTIRGMGYSFVAVKK

SEQ ID NO: 2467 - DNA, 1359 bp, Escherichia coli
atgaaaagattatctataaccgtccgtttaaccttgctttttatattgctgctgtttgttgctggcgctggaattgtctggactctctataatggcctggcaagtgagttgaaatggcgcgatgatacaacactcattaaccggacagcgcagatcaagcagttgttaattgatggggtaaatccagatacgttacctgtgtactttaaccggatgatggatgttagtcaggatatcttgatcattcatggtgatggcatcaataaaattgttaaccggacaaatgtcagtaatggcatgttaaataacatacctgctagtgagacaatcagcgcagctggcatttacagaagcattattaatgacacagagatagatgctttacgaattaatattgatgaagtttcgccatcattaacggttactgtggctaaattggcttcagccagacataacatgcttgaacagtataaaattaatagcattataatttgcattgtcgccattatactgtgctcagtattaagtccgttgttaatcagaacggggttacgagagatcaaaaagttgagtggtgtaacggaagcgctgaattataacgatagccgagagcctgttgaggttagcgcattaccgagagaactaaaacctcttgggcaggcgttgaataaaatgcaccaagctttagtcaaagattttgaacgtctaagtcagtttgctgacgatctcgctcatgaacttagaacgccaattaatgcattactgggtcagaatcaggttacgctcagtcaaaccagaagtatcgctgaatatcaaaaaacaattgccggaaacattgaagagctggaaaatatttcgcgattaacagagaacatactgtttcttgccagggcagataaaaataatgttttggtgaaactggactcgctttctctcaataatgaagtcgaaaatttgttggactatcttgaatacctttcagacgagaaagagatttgctttaaggtcgagtgcaatcagcacatctttgcggataaaattttactacaacgaatgttatcgaatcttattgttaacgctattcgatattcgccagaaaaatcgcgtattcagataaccagttttcttgataccaacggttctcttaatattgatatcgccagtcctggaacgaaaattcatgagcctgaaaaactcttccgtagattttggcggggagataattcgcgtcattccgtaggtcagggacttggtctttctttagtcaaagcgattgccgaattacatgggggaagtgctacgtatcactatctcagtaagcataatgtgttccggattacgttaccgcaaagaaattaa

SEQ ID NO: 2468 - protein, 452 aa, Escherichia coli
MKRLSITVRLTLLFILLLFVAGAGIVWTLYNGLASELKWRDDTTLINRTAQIKQLLIDGVNPDTLPVYFNRMMDVSQDILIIHGDGINKIVNRTNVSNGMLNNIPASETISAAGIYRSIINDTEIDALRINIDEVSPSLTVTVAKLASARHNMLEQYKINSIIICIVAIILCSVLSPLLIRTGLREIKKLSGVTEALNYNDSREPVEVSALPRELKPLGQALNKMHQALVKDFERLSQFADDLAHELRTPINALLGQNQVTLSQTRSIAEYQKTIAGNIEELENISRLTENILFLARADKNNVLVKLDSLSLNNEVENLLDYLEYLSDEKEICFKVECNQHIFADKILLQRMLSNLIVNAIRYSPEKSRIQITSFLDTNGSLNIDIASPGTKIHEPEKLFRRFWRGDNSRHSVGQGLGLSLVKAIAELHGGSATYHYLSKHNVFRITLPQRN

SEQ ID NO: 2469 - DNA, 852 bp, Escherichia coli
atgactgttcaaaaaagtaaaaatccacaggtcgatattgctgaagataatgcattcttcccttcagaatattcgcttagccaatatacgagtcccgtctctgatcttgatggcgtggactatccaaaaccgtatcgcggtaaacataaaattctggtgatcgccgctgatgaacgctatttgccgactgataacggcaaactcttctcaacgggcaatcatccgattgaaacgttgctgccgttgtatcatctccatgctgcaggtttcgaattcgaagtggcgaccatttccggtctgatgaccaagtttgaatactgggctatgccgcacaaagatgaaaaagtaatgccattctttgagcagcataaatcgttgttccgcaatccgaagaaattagcggatgttgtcgccagcctgaacgcagacagcgaatatgcagcgatctttgttcccggtggtcatggtgcactcatcggtttgccagaaagtgaagacgtagccgccgctctgcagtgggctattgaaaatgaccgttttgttatctccctatgccatggtccggctgcttttctggcgcttcgccacggcgataacccactgaacggttattccatttgtgcattcccggacgccgcagacaaacaaacgccagagataggctatatgccgggtcatctcacctggtacttcggcgaagagctgaagaaaatgggcatgaacatcattaatgacgacatcaccgggcgagtacataaggaccgtaaagttctcaccggcgacagtcctttcgcagcgaatgcgttgggtaaactggcggcacaggaaatgctggcagcttacgcgggttaa

SEQ ID NO: 2470 - protein, 283 aa, Escherichia coli
MTVQKSKNPQVDIAEDNAFFPSEYSLSQYTSPVSDLDGVDYPKPYRGKHKILVIAADERYLPTDNGKLFSTGNHPIETLLPLYHLHAAGFEFEVATISGLMTKFEYWAMPHKDEKVMPFFEQHKSLFRNPKKLADVVASLNADSEYAAIFVPGGHGALIGLPESEDVAAALQWAIENDRFVISLCHGPAAFLALRHGDNPLNGYSICAFPDAADKQTPEIGYMPGHLTWYFGEELKKMGMNIINDDITGRVHKDRKVLTGDSPFAANALGKLAAQEMLAAYAG

SEQ ID NO: 2471 - DNA, 1116 bp, Escherichia coli
atgaaaagaaaagttctggcaatgctggtcccggcgttattagttgctggcgcagcaaatgcggctgaaatttataataaagatggcaataaagttgatttctacggcaagatggttggcgaacgcatctggtcaaatactgatgataataacagcgaaaacgaagatacctcctatgctcgtttcggtgttaaaggtgaaacccaaatcaccagcgaactgactggtttcggtcagtttgaatacaacctcgacgccagcaaacctgaaggtgaaaaccaggaaaaaacccgtttaaccttcgccggtttgaaatataacgagttaggatcatttgactatggccgtaactacggtgttgcttatgatgccgcagcttataccgatatgttagttgaatggggtggcgattcctgggcttccgctgacaacttcatgaatggtcgtaccaacggtgttgcaacctaccgtaactatgatttctttggcctggttgatggtcttgattttgcgattcagtaccaaggcaaaaacagcaaccgtagcactaagaaacaaaatggtgacggctatgcgttgtctgtagactataacatcaatggttttggtatcgttggtgcatatagcaaatctgatcgcaccaacgatcaagttgccgatggaaacggttcaaatgctgaactgtggtcattggctgcaaagtatgacgcgaacaatgtctacgcagttgtaatgtacggtgaaactcgtaatatgactccgggttctattgatacaggtgttgccgatcgagaaggcaatacaataatgcgtgatcaacttatcaatgaaacccagaactttgaagcggttgttcagtatcaattcgactttggtctgcgtccgtccttaggttatgtgtattctaaaggtaaagatatcaaaggtgtacctggacatagatatgttgacgctgaccgtgtgaactacattgaagttggtacctggtactacttcaataagaacatgaacgtttatactgcatacaaattcaacatgctggataaagatgacgccgccattactggcgcagcagctgatgaccagtttgcagttggtatcgtctaccagttctaa

SEQ ID NO: 2472 - protein, 371 aa, Escherichia coli
MKRKVLAMLVPALLVAGAANAAEIYNKDGNKVDFYGKMVGERIWSNTDDNNSENEDTSYARFGVKGETQITSELTGFGQFEYNLDASKPEGENQEKTRLTFAGLKYNELGSFDYGRNYGVAYDAAAYTDMLVEWGGDSWASADNFMNGRTNGVATYRNYDFFGLVDGLDFAIQYQGKNSNRSTKKQNGDGYALSVDYNINGFGIVGAYSKSDRTNDQVADGNGSNAELWSLAAKYDANNVYAVVMYGETRNMTPGSIDTGVADREGNTIMRDQLINETQNFEAVVQYQFDFGLRPSLGYVYSKGKDIKGVPGHRYVDADRVNYIEVGTWYYFNKNMNVYTAYKFNMLDKDDAAITGAAADDQFAVGIVYQF

SEQ ID NO: 2473 - DNA, 696 bp, Escherichia coli
atggacttacaacactggcaggcacagttcgaaaactggttaaaaaaccatcaccagcaccaggacgcggcccatgacgtatgtcattttcgccgcgtctgggctacggcacagaagctggcggcagatgacgatgtcgatatgctggtgattttaaccgcctgttattttcacgatattgtgagcctggcgaaagatcatccacaacggcagcgttcttcaatcctggcggcagaagagacgcgtcgcctgctccgtgaagagttcgtgcaatttccggcggagaaaatcgaggccgtttgtcatgccattgccgctcacagtttcagcgcgcaaatcgcccccttaacaacggaagctaaaatcgtccaggatgcggatcggctggaagccctgggggcgattggcctggcgcgcgtgtttgccgtttcaggggcattgggcgtggcgctgtttgatggtgaagatccgttcgcacagcatcgtccgcttgatgataaacgctacgcgctggatcatttccagactaagttgctgaagctaccgcaaaccatgcaaaccgcaagaggcaagcagctggcgcagcacaacgcgcaatttttagtcgagtttatggcgaagctcagtgccgaactggcgggggagaatgaaggtgtcgatcacaaggtgatagatgcgttttcacccgcgggctga

SEQ ID NO: 2474 - protein, 231 aa, Escherichia coli
MDLQHWQAQFENWLKNHHQHQDAAHDVCHFRRVWATAQKLAADDDVDMLVILTACYFHDIVSLAKDHPQRQRSSILAAEETRRLLREEFVQFPAEKIEAVCHAIAAHSFSAQIAPLTTEAKIVQDADRLEALGAIGLARVFAVSGALGVALFDGEDPFAQHRPLDDKRYALDHFQTKLLKLPQTMQTARGKQLAQHNAQFLVEFMAKLSAELAGENEGVDHKVIDAFSPAG

SEQ ID NO: 2475 - DNA, 1419 bp, Escherichia coli
atgcaggaaaatatatcagtaaccgattcatacagcaccgggaatgccgcacaggcaatgctggagaaactgctgcaaatttatgatgttaaaacgctggtggcgcagcttaatggtgtgggtgagaatcactggagcgcggcaattttaaaacgtgcgctggcgaatgactcggtatggcaccgtttaagtgagaaagagttcgcccatctgcaaacgttgttacccaaaccaccggcacatcatccgcattatgcgtttcgctttatcgatctatttgccggaattggcggcatccgtcgcggttttgaatcgattggcggacagtgcgtgtttaccagcgaatggaacaaacatgcggtacgcacttataaagccaatcattattgcgacccggcgacgcatcattttaatgaagatatccgcgacatcaccctcagccataaagaaggcgtgagtgatgaggcggcggcggaacatattcgtcaacacattcctgaacacgatgtattactggcgggttttccttgtcagccattttcgctggctggcgtatcgaaaaagaactcgctcgggcgggcgcacggttttgcctgcgatacccagggcacgctgttctttgatgtggtgcgcattatcgacgcgcgtcgtccggcgatgtttgtgctcgaaaacgtcaaaaacctgaaaagtcacgaccagggtaaaacgttccgcatcatcatgcagacgctggacgaactgggctatgacgtggctgatgcagaagataacgggccggacgatccgaaaatcatcgatggcaaacatttcctgccgcagcaccgtgaacgcatcgtgctggtgggttttcgtcgcgatctgaatctgaaagccgattttactctgcgtgatatcagcgaatgtttccctgcacagcgagtgacgctggcgcagctgctggacccgatggttgaggcgaaatatatcctgacgccggtgctgtggaagtacctctatcgatatgcgaaaaaacatcaggcgcgcggtaacggcttcggttatggaatggtttatccgaacaatccgcaaagcgtcacccgtacgctgtctgctcgttattacaaggatggcgcggaaattttaatcgaccgcggctgggatatggccacgggtgagaaagactttgacgatccgctgaatcagcaacatcgtccacgtcggttaacacctcgtgaatgcgcgcgcttaatgggttttgaagcgccgggagaagcgaaattccgcattccggtttcggacactcaggcctatcgccagttcggtaactcggtggtcgtgccggtctttgccgcggtggcaaaactgcttgagccaaaaatcaaacaggcggtggcgttgcgtcagcaagaggcacaacatggtcgacgttcacgataa

SEQ ID NO: 2476 - protein, 472 aa, Escherichia coli
MQENISVTDSYSTGNAAQAMLEKLLQIYDVKTLVAQLNGVGENHWSAAILKRALANDSVWHRLSEKEFAHLQTLLPKPPAHHPHYAFRFIDLFAGIGGIRRGFESIGGQCVFTSEWNKHAVRTYKANHYCDPATHHFNEDIRDITLSHKEGVSDEAAAEHIRQHIPEHDVLLAGFPCQPFSLAGVSKKNSLGRAHGFACDTQGTLFFDVVRIIDARRPAMFVLENVKNLKSHDQGKTFRIIMQTLDELGYDVADAEDNGPDDPKIIDGKHFLPQHRERIVLVGFRRDLNLKADFTLRDISECFPAQRVTLAQLLDPMVEAKYILTPVLWKYLYRYAKKHQARGNGFGYGMVYPNNPQSVTRTLSARYYKDGAEILIDRGWDMATGEKDFDDPLNQQHRPRRLTPRECARLMGFEAPGEAKFRIPVSDTQAYRQFGNSVVVPVFAAVAKLLEPKIKQAVALRQQEAQHGRRSR

SEQ ID NO: 2477 - DNA, 921 bp, Escherichia coli
atgcgtttccgccagttgttaccgctttttggcgcgctgtttgcgttgtatatcatttggggctcaacctattttgtcattcggattggcgtggaaagctggcctccgttaatgatggcgggcgttcgattcctggcagccggtattttattgctggcatttttgctactgcgcggacacaaacttcccccgctacgtccgctgctcaatgccgcgctgattggcctgttattgctggctgtcggtaatggcatggtgacggttgccgaacatcaaaatgttccttccggcatcgccgccgtagtggttgcaaccgtgcccctctttaccctgtgcttcagccgcctgtttggcattaaaacgcgcaaactggaatgggtgggtatcgccattgggcttgccggaatcatcatgctcaatagcggtggaaatttaagcggcaatccgtggggcgcgattctgattttaatcggctcgattagctgggcgtttggctcagtttatggctcgcgcattaccttacctgtagggatgatggcgggtgcgattgagatgctggcggcaggcgtggtgttaatgatcgcatcgatgattgcgggtgaaaaactgacggcgctcccttccctgtcaggcttccttgcggtcggctatctggcgctgtttggttcgattatcgccattaacgcttatatgtatttaatccgtaatgtcagtccggctctcgccaccagctacgcctacgttaacccggtggtcgcggtcttgctgggtacgggactgggtggcgaaacgctgtcgaaaattgaatggctggcgctcggcgtaattgttttcgcggtggtactggtcacgttgggaaaatatctcttcccggccaaacccgttgtcgcgccagttattcaggatgcatcaagcgagtaa

SEQ ID NO: 2478 - protein, 306 aa, Escherichia coli
MRFRQLLPLFGALFALYIIWGSTYFVIRIGVESWPPLMMAGVRFLAAGILLLAFLLLRGHKLPPLRPLLNAALIGLLLLAVGNGMVTVAEHQNVPSGIAAVVVATVPLFTLCFSRLFGIKTRKLEWVGIAIGLAGIIMLNSGGNLSGNPWGAILILIGSISWAFGSVYGSRITLPVGMMAGAIEMLAAGVVLMIASMIAGEKLTALPSLSGFLAVGYLALFGSIIAINAYMYLIRNVSPALATSYAYVNPVVAVLLGTGLGGETLSKIEWLALGVIVFAVVLVTLGKYLFPAKPVVAPVIQDASSE

SEQ ID NO: 2479 - DNA, 471 bp, Escherichia coli
atggtcgacgttcacgataaggccacccgcagcaaaaatatgcgcgcgattgccacgcgtgatacggcgattgagaagcgcctcgccagtttgttaaccgggcagggccttgcgtttcgcgttcaggacgccagtctgcccggacgcccggattttgtcgttgatgaatatcgctgcgtgatatttacccacggctgcttctggcatcatcatcactgctatctgtttaaagtgcctgcgacccgaaccgagttctggctggagaagataggtaaaaatgttgaacgcgatcgccgcgatatcagtcgcttgcaggagctcggctggcgcgtactgattgtctgggagtgtgcgttacgtgggcgcgagaagctgacggatgcggcgcttaccgagcgtctggaagagtggatctgcggcgaaggtgccagcgcgcagatcgacacgcaggggattcatttactcgcttga

SEQ ID NO: 2480 - protein, 156 aa, Escherichia coli
MVDVHDKATRSKNMRAIATRDTAIEKRLASLLTGQGLAFRVQDASLPGRPDFVVDEYRCVIFTHGCFWHHHHCYLFKVPATRTEFWLEKIGKNVERDRRDISRLQELGWRVLIVWECALRGREKLTDAALTERLEEWICGEGASAQIDTQGIHLLA

SEQ ID NO: 2481 - DNA, 918 bp, Escherichia coli
atgcttttggccgggagtagtttactgacgttgctcgatgatatcgccacactgctggacgatatctccgtgatgggcaaactggcggcgaagaaaaccgccggtgtattaggggatgatttatcgctcaatgcgcaacaagtttcaggcgtgcgggccaaccgggaacttcccgtggtctggggcgtggcgaaaggatcgctgatcaataaagtgattctggtgccgctggcgttgatcatcagtgcgtttatcccgtgggcgattacgccactgttgatgattggtggcgcgtttctctgctttgaaggggtagagaaagtgctgcatatgctggaggcgcgtaaacataaagaagatccagcgcagagccagcagcgtctggagaagctggcggcgcaggatccgctgaagtttgaaaaggacaaaattaaaggggcgattcgtaccgattttattttgtctgcggaaatcgtcgccatcacgctggggattgtggcagaggcgccgttgcttaatcaggtgctggtgctttcaggcatcgcgctggtagtgaccgtgggcgtctacggtctggtaggggttatcgttaagattgatgacctggggtattggctggcggaaaaatccagcgcgctgatgcaggcattaggtaaagggttattgattatcgcgccctggctgatgaaagcattatcgattgtcggcacgctggcgatgttcctcgtcggcggcgggattgtggtacatggtattgcgccgctgcatcacgccattgaacatttcgccgggcagcaaagtgcagtggtggcgatgatattaccgactgttttaaatctgattcttggatttatcatcggcggcatcgtggtgctgggagtgaaagcagtagcgaaaatgcgcggtcaggcacattaa

SEQ ID NO: 2482 - protein, 305 aa, Escherichia coli
MLLAGSSLLTLLDDIATLLDDISVMGKLAAKKTAGVLGDDLSLNAQQVSGVRANRELPVVWGVAKGSLINKVILVPLALIISAFIPWAITPLLMIGGAFLCFEGVEKVLHMLEARKHKEDPAQSQQRLEKLAAQDPLKFEKDKIKGAIRTDFILSAEIVAITLGIVAEAPLLNQVLVLSGIALVVTVGVYGLVGVIVKIDDLGYWLAEKSSALMQALGKGLLIIAPWLMKALSIVGTLAMFLVGGGIVVHGIAPLHHAIEHFAGQQSAVVAMILPTVLNLILGFIIGGIVVLGVKAVAKMRGQAH

SEQ ID NO: 2483 - DNA, 96 bp, Escherichia coli
atgagctttatggttagtgaggaagttacggttaaagagggcggcccgcggatgattgtcactggatactccagcggtatggttgagtgtcgttga

SEQ ID NO: 2484 - protein, 31 aa, Escherichia coli
MSFMVSEEVTVKEGGPRMIVTGYSSGMVECR

SEQ ID NO: 2485 - DNA, 291 bp, Escherichia coli
atggaaaaccagagctggttgaaaaaactcgcacgccgcctggggcctggtcatatcgttaatctctgctttatcgtggtattgcttttttccaccttgctcacctggcgtgaagtggtggtgctggaagatgcggaagatgcctatatctccagccagcgtaatcatctggaaaacgtagccaacgcgctcgataagcatttgcagtataacgtcgacaaactgatctttttgcgtaatggcatgcgcgaaagctctcgtggcgccactggatttcacctctctgcgtaa

SEQ ID NO: 2486 - protein, 96 aa, Escherichia coli
MENQSWLKKLARRLGPGHIVNLCFIVVLLFSTLLTWREVVVLEDAEDAYISSQRNHLENVANALDKHLQYNVDKLIFLRNGMRESSRGATGFHLSA

SEQ ID NO: 2487 - DNA, 1428 bp, Escherichia coli
gtggcgccactggatttcacctctctgcgtaatgccgtaaccgagttcgaacagcatcgcgacgagcacgcctggcaaatcgaactcaaccgacggcgcaccctgccagtcaatggcgtatcggatgcattagtcagcgaggggaatctcctgtctcgcgaaaatgaaagcctcgacaatgaaattaccgctgcactggaagttggttacttgctgcgactggcgcacaactcctcgtcgatggttgaacaggcgatgtatgtctcgcgtgctggattttacgtttcgacgcagccgaccttgtttacgcgcaatgtaccaacgcgttattacggctatgtcacccaaccctggtttatcggccattcgcaacgagaaaatcgtcaccgcgcggtacgctggttcacttcgcaaccggaacacgccagcaatactgaaccgcaggttaccgtcagtgttccggtagacagtaataactactggtatggcgtgctggggatgagtattcccgtgcgtactatgcagcaatttttaagaaacgccatcgataaaaacctcgatggtgagtatcagctctatgacagtaagctgagatttttgacctcttccaatcctgaccatccaacagggaatatttttgatcctcgtgaactggccttgctggcgcaggcaatggaacatgacacgcggggcggcattcgtatgaacagtcgttatgttagctgggaacgtctggaccatttcgacggtgtgctggtgcgcgtccatacgctaagcgaaggcgtgcgtggtgatttcggcagtatcagcattgcattaactctgctgtgggcgctctttaccaccatgttactcatctcctggtatgtgattcgccggatggttagcaacatgtatgttttgcaaagctcgttgcagtggcaggcgtggcacgacaccttaacgcgtttatataaccgtggcgcactgttcgaaaaagcccgtccgctcgctaaattgtgtcagacgcaccaacatcctttttctgtcattcaggtcgaccttgaccattttaaagcgattaatgaccgctttggtcatcaggcgggcgaccgtgttctttctcatgctgccggattaattagcagttccttgcgtgcgcaggacgttgccgggcgggtcggtggtgaggagttttgtgtgattctgcccggcgcgagtctgacgcaggctgcggaggttgcagaacgtattcgcctgaagctaaatgaaaaagagatgttgatcgccaagagtacgacgatacgcattagtgcctcgctgggggtaagcagcagcgaggaaaccggtgattatgattttgaacaactccagtcactggccgaccgtcggctttatctcgctaaacaggccgggcgcaatcgggtatgcgcgagcgataacgcttaa

SEQ ID NO: 2488 - protein, 475 aa, Escherichia coli
MAPLDFTSLRNAVTEFEQHRDEHAWQIELNRRRTLPVNGVSDALVSEGNLLSRENESLDNEITAALEVGYLLRLAHNSSSMVEQAMYVSRAGFYVSTQPTLFTRNVPTRYYGYVTQPWFIGHSQRENRHRAVRWFTSQPEHASNTEPQVTVSVPVDSNNYWYGVLGMSIPVRTMQQFLRNAIDKNLDGEYQLYDSKLRFLTSSNPDHPTGNIFDPRELALLAQAMEHDTRGGIRMNSRYVSWERLDHFDGVLVRVHTLSEGVRGDFGSISIALTLLWALFTTMLLISWYVIRRMVSNMYVLQSSLQWQAWHDTLTRLYNRGALFEKARPLAKLCQTHQHPFSVIQVDLDHFKAINDRFGHQAGDRVLSHAAGLISSSLRAQDVAGRVGGEEFCVILPGASLTQAAEVAERIRLKLNEKEMLIAKSTTIRISASLGVSSSEETGDYDFEQLQSLADRRLYLAKQAGRNRVCASDNA

SEQ ID NO: 2489 - DNA, 816 bp, Escherichia coli
atgctttcaattcaacaaccactactggtttttagcgatcttgatggcaccctgctggacagtcatagttatgactggcaaccagctgccccctggctcagccgtttacgcgaagcgaatgttcccgtcattctctgtagcagtaagacatcagccgaaatgctgtacttgcaaaaaacgttggggctacaaggtttaccgctgattgccgaaaatggcgcagtgatccagcttgctgagcaatggcaggatatagacggttttccacgcatcatctcaggtattagccatggcgaaatcagccaggttttaaatacgctacgcgagaaagaacattttaaattcacgacttttgatgatgtcgacgatgcaaccatcgccgaatggacgggattaagccgtagccaggcggcgctgacgcagctacatgaggcgtcggtaacgctaatctggcgcgacagtgacgagcgtatggcacaatttaccgctcgtctgaacgaactgggcttgcagtttatgcagggtgcgcgcttctggcacgtcctggatgcctctgccggaaaagatcaggctgccaactggattatcgcgacctatcaacaatcgtcaggcaaacgcccaaccacacttggcctgggcgatgggccaaacgatgcgcccttactggaggtaatggattacgcggtgattgtgaaagggttaaaccgtgaaggggtgcatctgcatgatgaggatccgacccgcgtctggcgaacgcagcgtgaaggaccggaaggctggcgtgaagggctggaccattttttctccgcccgttaa

SEQ ID NO: 2490 - protein, 271 aa, Escherichia coli
MLSIQQPLLVFSDLDGTLLDSHSYDWQPAAPWLSRLREANVPVILCSSKTSAEMLYLQKTLGLQGLPLIAENGAVIQLAEQWQDIDGFPRIISGISHGEISQVLNTLREKEHFKFTTFDDVDDATIAEWTGLSRSQAALTQLHEASVTLIWRDSDERMAQFTARLNELGLQFMQGARFWHVLDASAGKDQAANWIIATYQQSSGKRPTTLGLGDGPNDAPLLEVMDYAVIVKGLNREGVHLHDEDPTRVWRTQREGPEGWREGLDHFFSAR

SEQ ID NO: 2491 - DNA, 243 bp, Escherichia coli
ttgcgaggaaagatgatgaaaaccgcaaaagagtacagcgataccgcaaaacgtgaggtcagcgtcgatgtcgatgccctgctggcggcgatcaatgaaattagcgaaagcgaagttcatcgcagccagaacgattctgaacacgttagcgtcgatggacgtgaatatcatacatggcgtgaattggcggatgccttcgaactggatattcatgacttcagcgtctctgaagtgaatcgttga

SEQ ID NO: 2492 - protein, 80 aa, Escherichia coli
MRGKMMKTAKEYSDTAKREVSVDVDALLAAINEISESEVHRSQNDSEHVSVDGREYHTWRELADAFELDIHDFSVSEVNR

SEQ ID NO: 2493 - DNA, 189 bp, Escherichia coli
atgaaggtgaatgatcgggtaacagtcaaaacggatggcggtccgcgtcgtcctggcgtggtactggcagttgaggagtttagtgaaggcacaatgtacctggtttcgctggaagactacccgctcggcatctggttctttaatgaagcagggcatcaggacggtatctttgtggagaaagcagagtaa

SEQ ID NO: 2494 - protein, 62 aa, Escherichia coli
MKVNDRVTVKTDGGPRRPGVVLAVEEFSEGTMYLVSLEDYPLGIWFFNEAGHQDGIFVEKAE

SEQ ID NO: 2495 - DNA, 624 bp, Escherichia coli
atgtcaacgattattatggatttatgtagttacacccgactaggtttaaccgggtatctgttgagtagaggggttaaaaaaagagaaatcaacgacattgaaaccgttgatgaccttgccatagcttgtgattcacagcgcccttcagtggtgtttattaatgaggactgtttcatccacgatgcttctaacagtcagcgtatcaagctcatcattaatcaacatcccaatacgttatttatcgtttttatggcaattgccaatgttcattttgatgaatatctattggtcagaaaaaatttattgatcagttctaaatcgattaaaccggaatctctcgacgatatccttggcgatattctgaaaaaagagacaacgataacctcgtttttaaatatgccgacgttatcattgagccgaaccgaatcgagtatgttgcgaatgtggatggcaggtcagggaaccattcaaatctctgaccaaatgaatatcaaagccaagaccgtttcatcgcataaaggtaatattaaacgtaagatcaaaacgcataataaacaggttatctaccatgtcgtccgactgacggataatgtgactaatggtatttttgtcaacatgcgctaa

SEQ ID NO: 2496 - protein, 207 aa, Escherichia coli
MSTIIMDLCSYTRLGLTGYLLSRGVKKREINDIETVDDLAIACDSQRPSVVFINEDCFIHDASNSQRIKLIINQHPNTLFIVFMAIANVHFDEYLLVRKNLLISSKSIKPESLDDILGDILKKETTITSFLNMPTLSLSRTESSMLRMWMAGQGTIQISDQMNIKAKTVSSHKGNIKRKIKTHNKQVIYHVVRLTDNVTNGIFVNMR

SEQ ID NO: 2497 - DNA, 786 bp, Escherichia coli
atgatgcaggtaacaagcgatcaatggctttcctggttaagcctgtacttctggccgttactgcgcgtgctggcgctcatttctaccgcaccaattctgagcgaacgcagcgtgccgaaacgggtaaaactgggtctggcaatgatgatcacgttcgctattgccccatcattacctgccaacgatgttcctgttttttcgttctttgctctgtggctggccgtgcagcagatcctgatcggcattgcgcttggttttaccatgcaatttgcctttgccgctgtgcgaaccgctggtgaaattatcggtctgcaaatggggctgtcatttgcgacgtttgtcgatccggccagccatctcaatatgcccgttttagcgcgtatcatggatatgctggcgttactgctgttcctgacatttaacggtcatttatggttgatttcactgctggtcgatacctttcacaccctgccaattggtggcgaaccgttgaacagcaatgcgtttctggcactcaccaaagcagggagtttgattttccttaacgggctgatgctggcattaccgctcattactctgctgctgaccctgaatctggcattaggcttacttaatcgtatggccccacaattatccatttttgttattggatttccattaactctgactgtcggtatctctttaatggcggcattaatgccgttaattgcgcctttttgcgaacatttattcagtgagatgtttaatttgctggctgatattattagtgaattgccattaatataa

SEQ ID NO: 2498 - protein, 261 aa, Escherichia coli
MMQVTSDQWLSWLSLYFWPLLRVLALISTAPILSERSVPKRVKLGLAMMITFAIAPSLPANDVPVFSFFALWLAVQQILIGIALGFTMQFAFAAVRTAGEIIGLQMGLSFATFVDPASHLNMPVLARIMDMLALLLFLTFNGHLWLISLLVDTFHTLPIGGEPLNSNAFLALTKAGSLIFLNGLMLALPLITLLLTLNLALGLLNRMAPQLSIFVIGFPLTLTVGISLMAALMPLIAPFCEHLFSEMFNLLADIISELPLI

SEQ ID NO: 2499 - DNA, 270 bp, Escherichia coli
atgacacctgaatcggtcatgatgatggggactgaagcgatgaaagtcgcgctggcactggctgccccactgttgctggtggcgctggtcacgggtcttatcatcagtattttgcaggccgccacccagattaacgaaatgacgttgtcgtttattccgaaaatcatcgccgtatttatcgccattattattgccggaccgtggatgctcaatctgttgctggattacgtccgcaccttgttcactaacctgccgtatatcatcgggtag

SEQ ID NO: 2500 - protein, 89 aa, Escherichia coli
MTPESVMMMGTEAMKVALALAAPLLLVALVTGLIISILQAATQINEMTLSFIPKIIAVFIAIIIAGPWMLNLLLDYVRTLFTNLPYIIG

SEQ ID NO: 2501 - DNA, 438 bp, Escherichia coli
atgtcgccggtgatcgataaaatttatgtcgatgcgtaccagccattcaacgaagagaaaatatcaatgcaggaggcgctggaaaaaggggagcagccgctgcgtgagtttatgctgcgtcagacccgtgaggcggatttagggttgtttgccagactggcgaatactggcccgttgcagggacctgaagctgtgccgatgcgcattttgctcccggcctacgtgaccagcgagttgaaaaccgcatttcagataggcttcacgattttcattccttttttgattatcgacctggtgattgccagcgtgttgatggcattggggatgatgatggttcccccagccacaattgctctgccctttaaactgatgctgtttgtactggtggatggctggcaattgctggtcggttcgctggcgcagagcttttacagctag

SEQ ID NO: 2502 - protein, 145 aa, Escherichia coli
MSPVIDKIYVDAYQPFNEEKISMQEALEKGEQPLREFMLRQTREADLGLFARLANTGPLQGPEAVPMRILLPAYVTSELKTAFQIGFTIFIPFLIIDLVIASVLMALGMMMVPPATIALPFKLMLFVLVDGWQLLVGSLAQSFYS

SEQ ID NO: 2503 - DNA, 417 bp, Escherichia coli
  n 395, 396, 397, 398, 399: n is any nucleotide
gtgacagatacagcgttatctcctgaagagcagttaatcgaggatattgcagggttcactcacgatccgcttggctatgccctctatgcgttcccgtggggggaagagggtactgaactggcacatgccaccggtccacgtcagtggcaggccgatgcgttccgagagatacgtgatcacctgcagaatccagagacgcgatatcagccgcttatgctggcacgtgcttctggtcacggtattggtaaatccgcattcatctcaatgctgatcaactggggcatgtccacttgcgaggattgtaaggtcgtggtgaccgccaacaccgacaaccagctacgaacgaagacctggccggaaattatcaagtggtcaaaccttgctatcacgaaagnnnnncattcattcattaattaa

SEQ ID NO: 2504 - protein, 138 aa, Escherichia coli
  Xaa 132, 133: Xaa is any amino acid
MTDTALSPEEQLIEDIAGFTHDPLGYALYAFPWGEEGTELAHATGPRQWQADAFREIRDHLQNPETRYQPLMLARASGHGIGKSAFISMLINWGMSTCEDCKVVVTANTDNQLRTKTWPEIIKWSNLAITKXXHSFIN

SEQ ID NO: 2505 - DNA, 603 bp, Escherichia coli
gtggttatgatgcctgctgaacctaaagcctataaacgcaaatcaacgcaatttaagccactaacagcaatgcaggaggcttattgccagtcatacatcaaaacgcctgaaaaccagactcaggcagcgattaacgcaggattctccccaaatacagcggcagttaaagccagtctcatgatgcgcgatgaacgcattcaaaaacggattgccgagctgatggaagagcgcaacaaacgaatgcgcgtcagtgctgattacgttctcatgcgcctggtggagatcgaccagatggacgtgatcgacatcctcaacgacgatgggagccttaagccaatccgcgagtggccgaaaatctggcgcactacgcttagtggctttgatctgtcatcgaccatcatgaacatgaacgaggattcgatagagacaatcctcaaaaaaattaaatggcctgacaaggtgaagaacctcgaactgattggtaagcacgtcgacgtcaacgcattcaaagaacgcctggatgttaatgtgaatgtgacaattgctgatcgcatagcggcagccaggaagagactgaaagaacgccaggatggcaatcagtga

SEQ ID NO: 2506 - protein, 200 aa, Escherichia coli
MVMMPAEPKAYKRKSTQFKPLTAMQEAYCQSYIKTPENQTQAAINAGFSPNTAAVKASLMMRDERIQKRIAELMEERNKRMRVSADYVLMRLVEIDQMDVIDILNDDGSLKPIREWPKIWRTTLSGFDLSSTIMNMNEDSIETILKKIKWPDKVKNLELIGKHVDVNAFKERLDVNVNVTIADRIAAARKRLKERQDGNQ

SEQ ID NO: 2507 - DNA, 135 bp, Escherichia coli
gtgacatgtcacgagtgggttatgcatgatgaatttgatggttttgaatactgccgccaactatggcggctttattttgcatggtactattaccacaacggtaactattaccacggtggttatgatgcctgctga

SEQ ID NO: 2508 - protein, 44 aa, Escherichia coli
MTCHEWVMHDEFDGFEYCRQLWRLYFAWYYYHNGNYYHGGYDAC

SEQ ID NO: 2509 - DNA, 339 bp, Escherichia coli
atggctaaatcagcagcagagcgcaaagccgctcagagagccagacaagctgcatctggtgtgcgtaaactggagattgtgcttgatgctcaggaaattgaaatgctggagcgtaactgtgccacgcgtcgccccgggcgtgcgccttacgaatttggtgagtatattgcgttacttatccgccaggatgatgctcgcgtgcacgggcgtataaaatcgatcagcagaaaacgttgcggtaagtgcggcgagagagttcctgtgaattcatgcccgtgtaatggtgactcgcaatgctgggtgaccaaaggctggcatgaaacgaaattaatattgtga

SEQ ID NO: 2510 - protein, 112 aa, Escherichia coli
MAKSAAERKAAQRARQAASGVRKLEIVLDAQEIEMLERNCATRRPGRAPYEFGEYIALLIRQDDARVHGRIKSISRKRCGKCGERVPVNSCPCNGDSQCWVTKGWHETKLIL

SEQ ID NO: 2511 - DNA, 306 bp, Escherichia coli
  n 9, 10, 11, 12, 13: n is any nucleotide
atggaatgnnnnnggaggaaggtcgtggctaacctgcaacttgccgttaaaggtgaatacttcgatgccatgattcgcggagagaaaacggaagagtatcgcctgtgtaatgactactggaataagcgaattatgttccgcgagtatgaccgcctgattatcacaaagggatatccgaagcgcgacgattccagccgcagaattgacgtcccgtatgacggatatgaaatcaagacaatcacacatccccacttcggtgataaaccggtaaaggtgttcgcgataaaggtgaatattgatggctaa

SEQ ID NO: 2512 - protein, 101 aa, Escherichia coli
  Xaa 3, 4, 5: Xaa is any amino acid
MEXXXRKVVANLQLAVKGEYFDAMIRGEKTEEYRLCNDYWNKRIMFREYDRLIITKGYPKRDDSSRRIDVPYDGYEIKTITHPHFGDKPVKVFAIKVNIDG

SEQ ID NO: 2513 - DNA, 702 bp, Escherichia coli
ttgtgcatggatggttccagtacagagcgtaataataaggacatgaaaatgaaatggtatgaactggctagatccagaatgaaagagctcggcataactcaagagaagttagccgaagagctaggtatgacgcagggtgggattggacactggttgcgcggatctcgtcatccatctcttagtgatattggtgtggtgtttaaataccttggtattgataacatatcattcaaccacgacgggacattttcacctgttggcgaatactcatcggccccagttaaaaaacaatatgagtaccctgttttttctcatgttcaggctgggatgttctctccagaactcagaacctttaccaaaggcgatgcggagagattggtaagcacaaccaaaaaagccagtgactctgcattctggcttgaggttgaaggtaactcaatgaccgcaccaacaggttccaaacccagctttcctgacgggatgttaattctggttgaccctgagcaagctgttgagcccggcgatttctgcatagccagacttggtggtgatgaatttaccttcaagaaactgatcagggatagcggtcaggtgtttctacagccactaaacccacaatacccaatgatcccatgcaatgagagttgttccgttgtggggaaagttatcgccagccaatggcctgaagagacgtttgggtga

SEQ ID NO: 2514 - protein, 233 aa, Escherichia coli
MCMDGSSTERNNKDMKMKWYELARSRMKELGITQEKLAEELGMTQGGIGHWLRGSRHPSLSDIGVVFKYLGIDNISFNHDGTFSPVGEYSSAPVKKQYEYPVFSHVQAGMFSPELRTFTKGDAERLVSTTKKASDSAFWLEVEGNSMTAPTGSKPSFPDGMLILVDPEQAVEPGDFCIARLGGDEFTFKKLIRDSGQVFLQPLNPQYPMIPCNESCSVVGKVIASQWPEETFG

SEQ ID NO: 2515 - DNA, 207 bp, Escherichia coli
ctacgaaaatatcgagagtcactgaatatctctcaaacaacacttgctaaggcagttggatgcacacagggagctatcggacattgggaatctggtcgtcgcttcccagaccttaaaacatgccgtgctcttgttgcgtgcctaaacaagttaggcgcaaaagtcagtcttgatgacgtgttcccgccggaacacaaagccgcttaa

SEQ ID NO: 2516 - protein, 68 aa, Escherichia coli
LRKYRESLNISQTTLAKAVGCTQGAIGHWESGRRFPDLKTCRALVACLNKLGAKVSLDDVFPPEHKAA

SEQ ID NO: 2517 - DNA, 297 bp, Escherichia coli
atggaaagaacaagttacagcaaactatcacagcgtgacgttgatcgcgcagaaacagatttacttatcaatctgtcagctattacccagcgcggtctggcaaagatgattggctgtcatgaatcgaagataagcagaacggactggagatttattgcttcggtcttgtgtgctttcggaatggcatcagacatcagtccgattagcagggcttttaagtatgcgcttgatggactcaccaataaaaaacgcccggcggcaaccgagcgttctgaacaaatccagatggaattctga

SEQ ID NO: 2518 - protein, 98 aa, Escherichia coli
MERTSYSKLSQRDVDRAETDLLINLSAITQRGLAKMIGCHESKISRTDWRFIASVLCAFGMASDISPISRAFKYALDGLTNKKRPAATERSEQIQMEF

SEQ ID NO: 2519 - DNA, 900 bp, Escherichia coli
atgacaaatacagcaaaaatactcaacttctgcagaggtaactttgccaaacaggagcgtaatgtggcagatctcgatgatggttacgccagactatcaaatatgctgcttgaggcttattcaggcgcagatctgaccaagcgacagtttaaagtgctgcttgccattctgcgtaaaacctatggatggaataaaccaatggacagaatcaccgattctcaacttagcgagattacaaagttacccgtcaaacggtgcaatgaagccaagttagaactcgtcagaatgaatattatcaagcagcaaggcggcatgtttggaccaaataaaaacatctcagaatggtgtatccctcaaaacgagggaaaatcccctaaaacgagggataaaacatccctcaaattgggggattgctatccctcaaaacagggggacacaaaagacactattacaaaagaaaaaagaaaagattattcgtcagagaattctggcgaatcctctgaccagccagaaaacgacctttctgtggtgaaaccggatgctgcaattcagagcggcagcaagtgggggacagcagaagacctgaccgccgcagaatggatgtttgacatggtgaagaccatcgcgccatcagccagaaaaccgaattttgcagggtgggctaacgatatccgcctgatgcgtgaacgtgacggacgtaaccatcgcgacatgtgtgtactgttccgctgggcatgccaggacaacttctggtccggtaacgtgctgagcccggccaaactccgcgacaagtggacccagctcgaaatcaaccgtaacaagcaacaggcaggtgtgacagcctgcaaaccaaaactcgacctgacaaacactgactggatttacggggtggatttatga

SEQ ID NO: 2520 - protein, 299 aa, Escherichia coli
MTNTAKILNFCRGNFAKQERNVADLDDGYARLSNMLLEAYSGADLTKRQFKVLLAILRKTYGWNKPMDRITDSQLSEITKLPVKRCNEAKLELVRMNIIKQQGGMFGPNKNISEWCIPQNEGKSPKTRDKTSLKLGDCYPSKQGDTKDTITKEKRKDYSSENSGESSDQPENDLSVVKPDAAIQSGSKWGTAEDLTAAEWMFDMVKTIAPSARKPNFAGWANDIRLMRERDGRNHRDMCVLFRWACQDNFWSGNVLSPAKLRDKWTQLEINRNKQQAGVTACKPKLDLTNTDWIYGVDL

SEQ ID NO: 2521 - DNA, 252 bp, Escherichia coli
  n 229, 230, 231, 232, 233: n is any nucleotide
ttgaccgtgagcagatgcgtcgggatcgccaacaacatgccggaacagtacgacgaaaagccgcaggtacagcaggtagcgcagatcatcaacggtgtgttcagccagttactggcaactttcccggcgagtctggctaaccgtgaccagaacgaactgaacgaaatccgccgccagtgggttctgggctttccgggaaaacgggatcaccacaatggaacagttaacnnnnncattccattcattaattaa

SEQ ID NO: 2522 - protein, 83 aa, Escherichia coli
  Xaa 77, 78: Xaa is any amino acid
MTVSRCVGIANNMPEQYDEKPQVQQVAQIINGVFSQLLATFPASLANRDQNELNEIRRQWVLGFPGKRDHHNGTVNXXIPFIN

SEQ ID NO: 2523 - DNA, 360 bp, Escherichia coli
  n 4, 5, 6, 7, 8: n is any nucleotide
atgnnnnngcaaggttactgcctgtacaaaatgggctgcaaagggcctaccacctataacgcctgttcctccacacgctggaacgatggcgtttccttcccgatccagtcaggtcacggctgcctgggttgtgcggaaaatggtttctgggatcgcggttcgttctacagccgcgtggtcgatattccacaaatgggtacccattccaccgccgacaccgtcggtttaaccgcgcttggcgtggtggcagcggctgttggtgtgcacgcagccgccagcgccgttgaccagcgcagacgtcataaccagcaacctacagaaaccgaacatcagccaggcaatgaggataaacaggcatga

SEQ ID NO: 2524 - protein, 119 aa, Escherichia coli
  Xaa 2, 3: Xaa is any amino acid
MXXQGYCLYKMGCKGPTTYNACSSTRWNDGVSFPIQSGHGCLGCAENGFWDRGSFYSRVVDIPQMGTHSTADTVGLTALGVVAAAVGVHAAASAVDQRRRHNQQPTETEHQPGNEDKQA

SEQ ID NO: 2525 - DNA, 1794 bp, Escherichia coli
atgagcactcagtacgaaactcagggatacaccatcaacaatgccggacgccgcctggtggtcgacccgattacgcgcattgaaggccacatgcgctgcgaagtgaatattaacgatcagaatgtgatcaccaatgccgtctcctgcggcaccatgtttcgcgggctggagatcatcctgcaagggcgtgacccgcgcgatgcgtgggcgttcgttgaacgtatctgcggcgtctgtactggcgtacacgccctggcttcggtttacgccatcgaagatgccatcggtattaaagtgccggacaacgccaatatcatccgcaacattatgctggcaacgctctggtgccacgatcatctggtgcacttctatcagcttgccgggatggactggatcgatgtgttagatgcgctgaaagccgacccgcggaaaacctccgaactggcgcaaagcctctcctcatggccgaaatcatcccctggctatttcttcgacgtacaaaaccgcctgaagaaattcgttgaaggcgggcagttggggatcttccgcaatggctactgggggcacccgcagtacaaactgccgccagaagccaacctgatgggctttgcccactatctcgaagctctcgatttccagcgtgaaattgtcaaaatccacgcggtctttggtggtaaaaacccgcatccaaactggattgtcggcgggatgccttgcgccattaacattgacgaaagcggcgcagtcggggcggtcaatatggaacgcctgaacctggtgcagtcgatcattacccgtacggcggacttcattaacaacgtgatgatccccgacgccttagccatcggccagttcaacaaaccgtggagcgaaatcggcacgggtctttctgataaatgtgtcctcagctacggcgcattcccggatattgccaacgactttagtgagaaaagtctgctgatgcctggcggcgcggtgattaacggcgacttcaacaatgtgctgccagtggatttggttgatccgcagcaggtgcaggagtttgtcgaccacgcctggtatcgttatcccaacgatcaggtggggcgtcatccgttcgatggcattaccgacccgtggtacaaccccggcgatgtcaaaggcagcgataccaacattcagcagctgaatgaacaggaacgctactcgtggatcaaagcgccacgctggcgcggtaacgcgatggaagtggggccgctggcacgcacgttaatcgcttatcacaaaggcgatgctgcgaccgttgagtcggtcgatcgtatgatgtcggcgttgaaactgccgctttccggcatccagtcaacgttgggccgcattttgtgtcgcgcgcacgaagcgcagtgggccgcaggtaagttgcagtatttcttcgataaactgatgaccaacctgaaaaacggcaatcttgccaccgcttccacggaaaaatgggaaccagcaacctggccgacagagtgccgtggtgtcggttttaccgaagcaccgcgcggggcgttaggccactgggctgccattcgcgatggcaagattgatctctatcagtgcgtggtgccgaccacctggaacgccagcccgcgcgatcccaaagggcagattggcgcttatgaagcggcgctgatgaacaccaaaatggcgatccccgagcaaccgctggagatcctgcgtactctgcacagctttgacccgtgcctcgcctgttcaacacacgtgctgggcgacgacggtagcgagcttatctccgtgcaggtgcgttaa

SEQ ID NO: 2526 - protein, 597 aa, Escherichia coli
MSTQYETQGYTINNAGRRLVVDPITRIEGHMRCEVNINDQNVITNAVSCGTMFRGLEIILQGRDPRDAWAFVERICGVCTGVHALASVYAIEDAIGIKVPDNANIIRNIMLATLWCHDHLVHFYQLAGMDWIDVLDALKADPRKTSELAQSLSSWPKSSPGYFFDVQNRLKKFVEGGQLGIFRNGYWGHPQYKLPPEANLMGFAHYLEALDFQREIVKIHAVFGGKNPHPNWIVGGMPCAINIDESGAVGAVNMERLNLVQSIITRTADFINNVMIPDALAIGQFNKPWSEIGTGLSDKCVLSYGAFPDIANDFSEKSLLMPGGAVINGDFNNVLPVDLVDPQQVQEFVDHAWYRYPNDQVGRHPFDGITDPWYNPGDVKGSDTNIQQLNEQERYSWIKAPRWRGNAMEVGPLARTLIAYHKGDAATVESVDRMMSALKLPLSGIQSTLGRILCRAHEAQWAAGKLQYFFDKLMTNLKNGNLATASTEKWEPATWPTECRGVGFTEAPRGALGHWAAIRDGKIDLYQCVVPTTWNASPRDPKGQIGAYEAALMNTKMAIPEQPLEILRTLHSFDPCLACSTHVLGDDGSELISVQVR

SEQ ID NO: 2527 - DNA, 708 bp, Escherichia coli
atgcaacagaaaagcgacaacgttgtcagtcactatgtctttgaagcacccgtgcggatatggcactggctgacagtgttatgcatggcggtgttgatggtcaccggttactttatcggcaagccgctaccttccgtcagcggcgaggcgacgtatctgttctatatgggctacatcaggttaattcacttcagcgccgggatgatttttaccgtggtcttgctgatgcggatctactgggcttttgttggcaatcattactcccgcgagctgtttatcgtgccggtatggcgtaaaagctggtggcagggcgtgtggtatgaaatccgctggtatctgtttctggcaaaacgtccgagtgccgatataggccataaccccatcgcccaggcggcgatgttcggctatttcctgatgtcagtttttatgatcatcaccggctttgcgctgtacagcgaacacagccagtacgctatttttgcgccgttccgttatgtggtggaatttttctactggacgggcggcaactcaatggacattcacagctggcatcggctggggatgtggctgattggcgcgtttgtgatcggtcatgtctacatggcgctgcgtgaagacatcatgtccgacgacacggtgatctccactatggtcaacggctaccgtagccacaaatttggcaaaataagtaacaaggagcgttcatga

SEQ ID NO: 2528 - protein, 235 aa, Escherichia coli
MQQKSDNVVSHYVFEAPVRIWHWLTVLCMAVLMVTGYFIGKPLPSVSGEATYLFYMGYIRLIHFSAGMIFTVVLLMRIYWAFVGNHYSRELFIVPVWRKSWWQGVWYEIRWYLFLAKRPSADIGHNPIAQAAMFGYFLMSVFMIITGFALYSEHSQYAIFAPFRYVVEFFYWTGGNSMDIHSWHRLGMWLIGAFVIGHVYMALREDIMSDDTVISTMVNGYRSHKFGKISNKERS

SEQ ID NO: 2529 - DNA, 588 bp, Escherichia coli
atgagcgagcaacgcgtggtggtaatggggctgggcaacctgctgtgggccgatgaaggcttcggcgtgcgggtggcggaacggctgtatgcccattaccactggcccgaggatgtggagattgtcgatggcggcacccaaggactgaacttgctggggtatgtcgaaagcgccggtcatctgttgattctcgatgccattgattacgggctggaacccggaacgctacgaacgtatgccggagaacgcattccggcttatctcagcgcgaagaaaatgagcctgcaccagaacagtttctccgaagtgctggcgctggcagatatccgcggacatctgccagcacatattgccctcgtcggtctgcaacccgcgatgctcgacgactacggcggcagcctgagcgaactggcgcgggagcaactgcccgctgcggaacaggcggcgctggcgcagctggctgcgtggggaattgtgccgcaaccggctaatgaatcgcgctgtctcaattatgactgtctgtcgatggaaaattacgaaggcgttcgcttgcgtcagtacaggatgaggctggaggaacagggatga

SEQ ID NO: 2530 - protein, 195 aa, Escherichia coli
MSEQRVVVMGLGNLLWADEGFGVRVAERLYAHYHWPEDVEIVDGGTQGLNLLGYVESAGHLLILDAIDYGLEPGTLRTYAGERIPAYLSAKKMSLHQNSFSEVLALADIRGHLPAHIALVGLQPAMLDDYGGSLSELAREQLPAAEQAALAQLAAWGIVPQPANESRCLNYDCLSMENYEGVRLRQYRMRLEEQG

SEQ ID NO: 2531 - DNA, 399 bp, Escherichia coli
atgagcaacgacacaccatttaatgcgttgtggcaacgaatgctggcacgtggctggacgccggtcagtgaatgccgtcttgacgactggcttacgcaagcgccagacggcgtggtgttattaagcagtgacccgaaacgcacgccagaagtcagcgataacccggtaatgattggcgaattactgcgcgaatttcccgactatacatggcaggtagcgattgctgatcttgagcagagcgaagccatcggcgatcgctttggcgtctttcgctttcccgccacattagtgtttaccggcggaaactatcgcggcgtgctgaatggtattcacccgtgggcggaactgataaacctgatgcgcgggcttgtcgaaccgcaacaggagcgtgcttcatga

SEQ ID NO: 2532 - protein, 132 aa, Escherichia coli
MSNDTPFNALWQRMLARGWTPVSECRLDDWLTQAPDGVVLLSSDPKRTPEVSDNPVMIGELLREFPDYTWQVAIADLEQSEAIGDRFGVFRFPATLVFTGGNYRGVLNGIHPWAELINLMRGLVEPQQERAS

SEQ ID NO: 2533 - DNA, 858 bp, Escherichia coli
atgagcgaaacttttttccatctgctggggccaggaacgcaaccgaacgatgacagtttcagcatgaatccactgccgatcacctgtcgggtgaatggtgaaccgagtatggcggccctggagcaatgtgctcacagcccgcaggtgattgcgctgttaaacgagttacaacatcaactaagcgaacgccagccgccgctgggtgaggtactggcagtcgatctgttaaatctcaacgccgacgatcgtcactttatcaatacgcttctcggggaaggggaagtgtcagtgcgcattcagcaggctgacgacagtgaaagtgaaattcaggaggcgatcttctgcggattatggcgggtacgcagacgtcacggcgaacagttgctggaagacaaactggaggctggctgcgcaccgctggcgttgtggcaggcggcaacgcaaaacgtcttgccgacagattcgctgttaccgccgcccattgatggcctgatgaatggcctaccgttggcccatgaattactggcacatgtacgtaaccccgacgcgcagccgcacagcattaatatgacgcaattacccatcagcgaagctgaccggctttttctctcacgtctctgtgggccgggaaatattcagattcgtaccattggctatggcgagagctatatcaacgccacggggttacgccatgtctggcatttacgctgtacggacaccttaaaaggcccgttactggaaagttatgaaatctgcccaataccggaagtggtgctggcagcgccagaagatttggtcgactctgcgcagcggcttagcgaggtatgccagtggctggcggagggggcaccgacgtaa

SEQ ID NO: 2534 - protein, 285 aa, Escherichia coli
MSETFFHLLGPGTQPNDDSFSMNPLPITCRVNGEPSMAALEQCAHSPQVIALLNELQHQLSERQPPLGEVLAVDLLNLNADDRHFINTLLGEGEVSVRIQQADDSESEIQEAIFCGLWRVRRRHGEQLLEDKLEAGCAPLALWQAATQNVLPTDSLLPPPIDGLMNGLPLAHELLAHVRNPDAQPHSINMTQLPISEADRLFLSRLCGPGNIQIRTIGYGESYINATGLRHVWHLRCTDTLKGPLLESYEICPIPEVVLAAPEDLVDSAQRLSEVCQWLAEGAPT

SEQ ID NO: 2535 - DNA, 1545 bp, Escherichia coli
atgtgggatgtcattgatttatcgcgctggcagtttgctctgaccgcgctgtatcactttttatttgtaccccttaccttggggctgatttttttgctggctatcatggaaaccatttacgtggtcaccggcaaaacaatctaccgcgatatgacgcgcttctggggtaagctcttcggtatcaactttgctcttggcgtggctaccggcctgaccatggagtttcagtttggtactaactggtcattctattccaactatgtgggcgatatttttggcgcaccgctggcgatggaagcattaatggccttcttcctcgaatccacctttgtcgggctgttcttcttcggctggcagcggctgaataaataccagcacctgctggtgacgtggctggtggcgttcggttcaaatctctctgcgttgtggatattgaatgccaacggttggatgcaatacccgaccggtgcgcattttgatatcgacaccctgcgtatggagatgaccagtttcagcgagctggtctttaacccggtcagccaggtgaaatttgtgcacaccgtaatggcgggatacgtgaccggggctatgtttattatggcgatcagcgcctggtatttactgcgcggacgggagcgcgatgtcgcattacgctcgtttgccatcggttccgtcttcggtactctggcgattatcagtacgctgcaactcggagacagttctgcgtatgaagtcgcgcaagtacaaccggtaaaactggcggcgatggaaggggagtggcaaacagaacctgcacctgcaccgttccatgtggttgcctggccggaacaggatcaagagcgtaacgcctttgccatcaaaattcccgcgctgctagggatcctcgccactcactcattagataaacccgtgccgggtctgaagaatttgatggctgaaacctacccacgcttgcaacgcggacgtatggcgtggctgttaatgcaggaaatatcgcaaggcaatcgtgagccgcatgtgttgcaggcattccgggagctggaaggcgacctgggttacggcatgttgctctcccgctatgcaccggatatgaatcatgtcacagccgcacagtaccaggcggcgatgcgtggcgcgatacctcaggttgcgccggtattctggagtttccgcatcatggtgggctgtggttccctgctgctactggtgatgctgattgcgcttgttcagacgctgcgtggcaaaatcgaccagcatcgctgggtgctgaaaatggcgctctggagtttgccgctgccgtggattgcgattgaagccggatggtttatgaccgagtttggtcgtcagccgtgggcgatacaagacatcttaccgacatactccgcgcactccgccttaaccacaggacaactggctttctcactgatcatgatcgtagggctttacaccctgttcttaatcgccgaagtctacctgatgcagaaatatgcccgtctggggccgagcgcgatgcagagtgaacaaccgacgcagcaacaggggtaa

SEQ ID NO: 2536 - protein, 514 aa, Escherichia coli
MWDVIDLSRWQFALTALYHFLFVPLTLGLIFLLAIMETIYVVTGKTIYRDMTRFWGKLFGINFALGVATGLTMEFQFGTNWSFYSNYVGDIFGAPLAMEALMAFFLESTFVGLFFFGWQRLNKYQHLLVTWLVAFGSNLSALWILNANGWMQYPTGAHFDIDTLRMEMTSFSELVFNPVSQVKFVHTVMAGYVTGAMFIMAISAWYLLRGRERDVALRSFAIGSVFGTLAIISTLQLGDSSAYEVAQVQPVKLAAMEGEWQTEPAPAPFHVVAWPEQDQERNAFAIKIPALLGILATHSLDKPVPGLKNLMAETYPRLQRGRMAWLLMQEISQGNREPHVLQAFRELEGDLGYGMLLSRYAPDMNHVTAAQYQAAMRGAIPQVAPVFWSFRIMVGCGSLLLLVMLIALVQTLRGKIDQHRWVLKMALWSLPLPWIAIEAGWFMTEFGRQPWAIQDILPTYSAHSALTTGQLAFSLIMIVGLYTLFLIAEVYLMQKYARLGPSAMQSEQPTQQQG

SEQ ID NO: 2537 - DNA, 1137 bp, Escherichia coli
atgtttgattatgaaacattgcgcttcatctggtggctgctgattggcgtgatcctggtggtctttatgatctccgacggatttgacatggggatcggctgtctgctgccgctggtggcgcgtaatgatgatgaacgtcggatagtgataaacagcgttggcgcgcactgggaaggcaatcaggtctggttgatcctcgcaggtggggcattatttgccgcctggcccagagtgtatgcagcggcgttttccggcttttatgtggcgatgattctggtgctgtgctcgctgttcttccgcccgctggcctttgattatcgcggaaaaatcgccgatgcacgctggcgtaaaatgtgggatgccggactggtcatcggcagtctggtgccgccggtagtcttcggtattgcattcggcaacttgctactcggcgtgccgtttgctttcacaccgcaattacgcgtggaatatctcggcagcttctggcaactgctgacgccattccctttattgtgtggattgctcagtcttgggatggtgattttgcaaggtggcgtctggttacaactgaaaactgttggtgtgattcatctgcgttcacagctggcgaccaaacgcgccgcactactggtgatgctgtgctttttgctggcgggttactggctgtgggttggtattgatggctttgtactgctcgcccaggatgctaacggtccttccaatccgttaatgaaactggtggcagtgctacctggtgcctggatgaataatttcgtcgaatcgcccgttttgtggatcttcccgctgctggggttcttctgcccattgctgacggtgatggcgatttatcgtggtcgcccgggttggggatttttgatggcgtcattgatgcaatttggcgtgattttcacggcaggcatcacgctgttcccctttgtcatgccgtcaagcgtgagtccgatctccagcctgacgttgtgggacagcacttccagtcagctgacgctgagcattatgttggtaatcgtgctgatatttttgcccattgtgttgctctacactctctggagctactacaaaatgtgggggcgcatgacgacagaaactctccgccgtaacgaaaacgagctgtactaa

SEQ ID NO: 2538 - protein, 378 aa, Escherichia coli
MFDYETLRFIWWLLIGVILVVFMISDGFDMGIGCLLPLVARNDDERRIVINSVGAHWEGNQVWLILAGGALFAAWPRVYAAAFSGFYVAMILVLCSLFFRPLAFDYRGKIADARWRKMWDAGLVIGSLVPPVVFGIAFGNLLLGVPFAFTPQLRVEYLGSFWQLLTPFPLLCGLLSLGMVILQGGVWLQLKTVGVIHLRSQLATKRAALLVMLCFLLAGYWLWVGIDGFVLLAQDANGPSNPLMKLVAVLPGAWMNNFVESPVLWIFPLLGFFCPLLTVMAIYRGRPGWGFLMASLMQFGVIFTAGITLFPFVMPSSVSPISSLTLWDSTSSQLTLSIMLVIVLIFLPIVLLYTLWSYYKMWGRMTTETLRRNENELY

SEQ ID NO: 2539 - DNA, 93 bp, Escherichia coli
atgtggtatttactttggttcgtcggcattttgttgatgtgttcgctctccacccttgtgttggtatggctggacccgcgtctgaaaagttaa

SEQ ID NO: 2540 - protein, 30 aa, Escherichia coli
MWYLLWFVGILLMCSLSTLVLVWLDPRLKS

SEQ ID NO: 2541 - DNA, 213 bp, Escherichia coli
ttgtcccgtaaaatgacaggaattgtcaaaacctttgatcgcaaaagcggcaaaggattcattatcccctccgacggtcgtaaagaagtccaggtccatatttccgcattcactccccgcgacgcagaagtgcttataccaggattacgcgtggaattttgccgcgtaaatggcctgcgtggaccaacagcggcaaatgtttatttgtcttga

SEQ ID NO: 2542 - protein, 70 aa, Escherichia coli
MSRKMTGIVKTFDRKSGKGFIIPSDGRKEVQVHISAFTPRDAEVLIPGLRVEFCRVNGLRGPTAANVYLS

SEQ ID NO: 2543 - DNA, 1332 bp, Escherichia coli
atgaaaagcggaaacatatcgatgaaagcgatcttgatcccattcttatctcttctgattccgttaacaccgaaatttgcattcgctcagagtgagccggagctgaagctggaaagtgtggtgattgtcagtcgtcacggtgtgcgtgcaccaaccaaggccacgcaactgatgcaggatgtcacccctgacgcatggccaacctggccggtaaaactgggttggctgacaccgcgcggtggtgagctaatcgcttatctcggacattaccaacgccagcgtctggtggccgacggattgctggcaaaagagggctgcccgcagccaggtcaggtcgcggttattgctgatgtcgacgaacgtacccgtaaaacaggcgaagccttcgccgccgggctggcacctgactgtgcaataaccgtacatacccaggcagatacgtccagtcccgatccgttatttaatcctctaaaaactggcgtttgccaactggataacgcgaatgtgactgacgcgatcctcagcagggcaggagggtcaattgctgactttaccgggcatcggcaaacggcgtttcgcgaactggaacgggtgcttaatttcccgcaatcaaacttgtgccttaaccgtaagaaacaggacgaaagctgttcattaacgcaggcattaccatcggaactcaaggtgagcgccgacaatgtctcattaaccggtgcggtaagcctcgcatcaatgctgacggagatatttctcctgcaacaagcacagggaatgccggagccggggtggggaaggatcaccgattcacaccagtggaacaccttgctaagtctacataacgcgcagttttatttgctgcaacgcacaccagaggttgcccgcagtcgcgccaccccgttattggatttgatcatgacagcgttggcgccccatccaccgcaaaaacaggtgtatggtgtgacattacccacttcagtgctgtttatcgccggacacgatactaatctggcaaatctcggcggcgcactggagctcaactggacgcttccaggtcagccggataacacgccgccaggtggtgaactagtgtttgaacgctggcgtcggctcagcgataacagccagtggattcaggtttcgctggtcttccagactttacagcagatgcgtgataaaacgccgctgtcattaaatacgccgcccggagaggtgaaactgaccctggcaggatgtgaagagcgaaatgcgcggggcatgtgttcgttggccggttttacgcaaatcgtgaatgaagcacgcataccagcgtgcgctctccatcaagacaaataa

SEQ ID NO: 2544 - protein, 443 aa, Escherichia coli
MKSGNISMKAILIPFLSLLIPLTPKFAFAQSEPELKLESVVIVSRHGVRAPTKATQLMQDVTPDAWPTWPVKLGWLTPRGGELIAYLGHYQRQRLVADGLLAKEGCPQPGQVAVIADVDERTRKTGEAFAAGLAPDCAITVHTQADTSSPDPLFNPLKTGVCQLDNANVTDAILSRAGGSIADFTGHRQTAFRELERVLNFPQSNLCLNRKKQDESCSLTQALPSELKVSADNVSLTGAVSLASMLTEIFLLQQAQGMPEPGWGRITDSHQWNTLLSLHNAQFYLLQRTPEVARSRATPLLDLIMTALAPHPPQKQVYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNARGMCSLAGFTQIVNEARIPACALHQDK

SEQ ID NO: 2545 - DNA, 99 bp, Escherichia coli
ttgagattaagcaaattttattttagccgtccggcggtcttaaatatcgctggctttattttattaaccccgtatagtgcagcgcagtattttcagtaa

SEQ ID NO: 2546 - protein, 32 aa, Escherichia coli
MRLSKFYFSRPAVLNIAGFILLTPYSAAQYFQ

SEQ ID NO: 2547 - DNA, 213 bp, Escherichia coli
atgtctaataaaatgactggtttagtaaaatggtttaacgcagataaaggttttggctttatcactcctgatgatggcagcaaagacgttttcgtccatttcactgccatccagagcaatgaattccgcacgctgaacgaaaatcagaaagttgaattttctattgagcaggggcaacgtggtcccgcggcagcgaacgttgttacgctctaa

SEQ ID NO: 2548 - protein, 70 aa, Escherichia coli
MSNKMTGLVKWFNADKGFGFITPDDGSKDVFVHFTAIQSNEFRTLNENQKVEFSIEQGQRGPAAANVVTL

SEQ ID NO: 2549 - DNA, 174 bp, Escherichia coli
gtgaatattgaagagttaaaaaaacaagccgaaacggaaatcgccgactttatcgcgcaaaaaatcgccgagctgaacaagaatacagggaaagaagtctctgaaattcgcttcaccgcacgagaaaaaatgaccgggcttgaaagttatgatgtcaaaatcaaaataatgtga

SEQ ID NO: 2550 - protein, 57 aa, Escherichia coli
MNIEELKKQAETEIADFIAQKIAELNKNTGKEVSEIRFTAREKMTGLESYDVKIKIM

SEQ ID NO: 2551 - DNA, 1074 bp, Escherichia coli
atggcagagaaaaaaagaacccgctggcagcggcggccaggcacgacgggcggcaaattaccgtggaatgactggcgcaatgccacgacctggcgtaaagcgacgcaattattactgttggcaattaatatttatattgccatcacgttctggtattgggtgcgctattacgaaacggcaggtagtacgacatttgtcaccagaccgggaggtatcgaaggctggctaccgattgccggtctgatgaatctgaaatatagccttgcaacaggtcagttaccgtccgtccacgccgccgcgatgctgttattggtcgcttttatcgtcatcagtctattactcaaaaaggccttttgttcatggttatgcccggttggtacgctttcggaattaatcggcgatctcggtaacaaactgtttggtcggcaatttgtccttccccgctggctggatattcctctgcgcggcgtgaaatatttgctgttgagtttttttctctatatcgcgttattgatgcccgctcaggcgattcactattttatgttgtcgccctacagcgtggtgatggacgttaaaatgctcgatttctttcgtcatatggggaccgcgacattaatcagcatgatcgttttgctgattgccagcctgtttattcgccatgcctggtgtcgttatctttgcccatatggcgcgctgatgagcgtggtttcgctattatcgccgtttaagattcgtcgcaatgccgaaagttgtatcgattgtggcaaatgcgcaaaaagttgcccatcacggatcccggtcgataaattaactcaggtacgaacagtggaatgtaccggctgtatgacttgcgtagagtcatgtccggtagcctcaacattgaccttttcactgcaaaaacctgcggcaaataaaaaagcctttgcgttgtctggctggttaatgacgctactggttatggggattatgtttgcggcaactggttacgcaatgtatgcgggagtatggcaaagcccggtgccggaggaattgtaccaacgcttaattccgcaatcgccaatgattggtcactaa

SEQ ID NO: 2552 - protein, 357 aa, Escherichia coli
MAEKKRTRWQRRPGTTGGKLPWNDWRNATTWRKATQLLLLAINIYIAITFWYWVRYYETAGSTTFVTRPGGIEGWLPIAGLMNLKYSLATGQLPSVHAAAMLLLVAFIVISLLLKKAFCSWLCPVGTLSELIGDLGNKLFGRQFVLPRWLDIPLRGVKYLLLSFFLYIALLMPAQAIHYFMLSPYSVVMDVKMLDFFRHMGTATLISMIVLLIASLFIRHAWCRYLCPYGALMSVVSLLSPFKIRRNAESCIDCGKCAKSCPSRIPVDKLTQVRTVECTGCMTCVESCPVASTLTFSLQKPAANKKAFALSGWLMTLLVMGIMFAATGYAMYAGVWQSPVPEELYQRLIPQSPMIGH

SEQ ID NO: 2553 - DNA, 2733 bp, Escherichia coli
gtgaatttaaccctgacccgaagactctggatgggctttgccctgatggcgctgttaaccctgaccagtaccctggtgggatggtacaacctgcgctttatcagccaggtggaaaaagacaacactcaggcattgattcctaccatgaatatggcgcgccagttgagcgaagccagcgcctgggaacttttcgccgcgcagaacctgaccagtgccgataacgaaaagatgtggcaggcgcaggggcgaatgctcaccgcacaaagcctgaagattaatgcgttgctgcaagcgttacgggaacaaggttttgacaccaccgctattgaacaacaggagcaggagatctcccgttcgttacgtcagcaaggggaactggtggggcagcgtttgcaactgcgccagcaacaacagcaactcagtcagcagatagtcgccgccgccgatgagatcgcacgcctggcgcaaggtcaggcgaataatgcggcaacctccgccggagcgacccaggccgggatttacgatttgatcgaacaacatcagcgtcaggccgcagaaagtgcactcgatcggctgattgatatcgatcttgagtatgttaaccagatgaatgaactgcgccttagcgccctgcgggtgcagcaaatggtgatgaatctggggctggaacagatccagaaaaatgcgccaacgctggaaaagcagctcaataatgcggtgaaaattctgcaacgtcggcaaatacgcattgaagatccgggtgttcgtactcaggtagcaacaacgttaactaccgttagccaatatagcgatttgctggcgctgtatcagcaggacagtgaaatcagcaatcacctgcaaactctcgcccaaaataacatcgcccagttcgcgcagtttagtagcgaagtcagtcagctggtcgacaccattgagctgcgtaatcagcacgggctggcacatctggaaaaagccagtgcacgcgggcaatacagcctgttattgctgggattagtttctctttgcgcactgattctgatcctctggcgcgtggtttatcgctcagtcacgcgccctcttgcagaacaaacgcaggcgctgcaacgcttgctggatggtgatatcgactcccctttcccggaaaccgctggcgtacgggaactggataccatcgggcggctgatggatgcgtttcgcagcagtgttcatgcactgaatcgccaccgcgaacagctggcggcgcaggtcaaagcgcgtacagctgaattgcaggaactggtgatagaacaccgacaggcacgggcggaagcagaaaaagccagccaggcaaaatcggcgtttctggcggcgatgagccatgagatccgcacaccgctgtacggtattctcggcaccgcacagctgctggcagataaccccgcacttaacgcccagcgcgatgatttgcgggcgattaccgactctggtgaatcgttgctgaccatcctcaacgatattctcgattattcggctatcgaagcaggcggcaagaatgtttcggtcagcgatgaaccctttgaaccgcgcccgctgctggaaagtaccctgcaattaatgagcggaagggtgaaaggtcgcccgattcgcctggcaacagaaattgccgacgatgtaccgactgcgttaatgggcgatccgcggcgtattcgtcaggtcatcaccaacctgttgagcaacgccctgcgtttcaccgacgaagggcacattatcctgcgtagtcgcactgatggcgaacaatggctggtcgaagtggaagacagcggttgcggtattgatcccgcgaaactggcagaaatcttccagccatttgttcaggtaagcagcaaacgcggcggaaccgggctggggctgactatcagtagccgtctggcccaggcgatgggcggcgaactgagcgccaccagcacgccggaggttggaagctgtttttgtttacgcttgccgttacgtattgccactgcacccgtgcccaaaacagtcaatcaggcggtacgtctggacgatttgcgtttgctgttaattgaagataacccgctcacccagcgaattactgtcgaaatgctgaacaccagtggtgcgcaggtcgttgcagtaggaaatgccgcgcaggcaatagaggcattgcaaaatagcgaaccgtttgctgccgcactggtggattttgatctgccggatatcgacggcattacccttgcccggcaactggcacagcaatatccgtcactggttttgattggctttagcgcccatgtcattgacgaaacactgcgacagcgtaccagctcgctatttcgcgggattatccctaaaccggtgccgcgtgaagtgctcggtcaattactggcgcactatctccaactgcaagtcaataacgatcaaccactggatgtatcgcaactcaatgaagatgctcatttaatgggggcggagaagatccacgaatggctgatattatttaaacaacatgccctgccgcttctcgatgaaatcgacattgcccgcgccagtcaggataacgagaaaataaagcgtgccgcacatcagctaaaaagcagttgctcgagtctgggaatgcgtagcgccagccagcaatgcgcacaactggagcagcagccattatctgccccccttccacacgaagaaattacacgcagtgttgccgctctggaagcatggttaataagaaagacctga

SEQ ID NO: 2554 - protein, 910 aa, Escherichia coli
MNLTLTRRLWMGFALMALLTLTSTLVGWYNLRFISQVEKDNTQALIPTMNMARQLSEASAWELFAAQNLTSADNEKMWQAQGRMLTAQSLKINALLQALREQGFDTTAIEQQEQEISRSLRQQGELVGQRLQLRQQQQQLSQQIVAAADEIARLAQGQANNAATSAGATQAGIYDLIEQHQRQAAESALDRLIDIDLEYVNQMNELRLSALRVQQMVMNLGLEQIQKNAPTLEKQLNNAVKILQRRQIRIEDPGVRTQVATTLTTVSQYSDLLALYQQDSEISNHLQTLAQNNIAQFAQFSSEVSQLVDTIELRNQHGLAHLEKASARGQYSLLLLGLVSLCALILILWRVVYRSVTRPLAEQTQALQRLLDGDIDSPFPETAGVRELDTIGRLMDAFRSSVHALNRHREQLAAQVKARTAELQELVIEHRQARAEAEKASQAKSAFLAAMSHEIRTPLYGILGTAQLLADNPALNAQRDDLRAITDSGESLLTILNDILDYSAIEAGGKNVSVSDEPFEPRPLLESTLQLMSGRVKGRPIRLATEIADDVPTALMGDPRRIRQVITNLLSNALRFTDEGHIILRSRTDGEQWLVEVEDSGCGIDPAKLAEIFQPFVQVSSKRGGTGLGLTISSRLAQAMGGELSATSTPEVGSCFCLRLPLRIATAPVPKTVNQAVRLDDLRLLLIEDNPLTQRITVEMLNTSGAQVVAVGNAAQAIEALQNSEPFAAALVDFDLPDIDGITLARQLAQQYPSLVLIGFSAHVIDETLRQRTSSLFRGIIPKPVPREVLGQLLAHYLQLQVNNDQPLDVSQLNEDAHLMGAEKIHEWLILFKQHALPLLDEIDIARASQDNEKIKRAAHQLKSSCSSLGMRSASQQCAQLEQQPLSAPLPHEEITRSVAALEAWLIRKT

SEQ ID NO: 2555 - DNA, 693 bp, Escherichia coli
atgccacatcacattgttattgttgaagatgagccggttacccaggcgcgattacaatcttacttcactcaggaggggtataccgtttccgttacggcgagcggtgccgggctgcgggaaattatgcagaatcagccggtggatttgattctgctggatatcaatttgcccgatgaaaatggcctgatgttaacccgcgccctgcgagaacgctcaacggtggggattattctggttaccggacgcagcgatcggattgaccgtattgttgggctggaaatgggcgcagacgattacgtcaccaaaccgctggagctgcgcgaactggtggtacgagtgaaaaatttgctctggcgaatcgacctcgcgcgacaggcgcaaccgcacactcaggacaactgctatcgctttgccggttattgcctgaatgtgtcgcgccatacgctggagcgggatggcgagccgattaaactgacccgcgcagagtatgaaatgctggtggcatttgtgactaatccgggcgaaattctcagccgtgaacgtctgctgcgtatgctctctgcgcgtcgggtggaaaaccctgacctgcgcaccgtcgatgtgttaattcgtcgtttacgccataaactcagtgcggatttactggtgacacaacatggcgaaggttatttcttagccgctgatgtgtgctga

SEQ ID NO: 2556 - protein, 230 aa, Escherichia coli
MPHHIVIVEDEPVTQARLQSYFTQEGYTVSVTASGAGLREIMQNQPVDLILLDINLPDENGLMLTRALRERSTVGIILVTGRSDRIDRIVGLEMGADDYVTKPLELRELVVRVKNLLWRIDLARQAQPHTQDNCYRFAGYCLNVSRHTLERDGEPIKLTRAEYEMLVAFVTNPGEILSRERLLRMLSARRVENPDLRTVDVLIRRLRHKLSADLLVTQHGEGYFLAADVC

SEQ ID NO: 2557 - DNA, 1029 bp, Escherichia coli
atgcgcgtactgctatttttacttctttcccttttcatgttatcggcattttcggctgataacctgttgcgctggcatgatgcacagcattacacggtgcaagcctctacgccgctaaaagccaaacgcgcatggaaactgtgcgcgctttatcccagtttgaaagattcatactggttatcgttgaactatggtatgcaggaggctgctcgccgctacggtgtggatttaaaagtgctggaggcaggcggctacagccagttggctacccagcaagcacaaatcgaccagtgtaaacagtggggcgcagaggccattttgctcggtagtagcacgacgtcatttcccgatctgcaaaagcaggtagcaaatctgccggtgatcgaactggtgaatgctattgatgctccccaggtgaaaagccgcgttggtgtgccctggtttcagatgggctatcaaccagggcgatatctggtgcaatgggcgcacggtaaaccactgaacgtgctgttgatgcccggccccgataacgccgggggcagtaaggagatggtagagggttttcgcgcagccattgccggaagcccggtacgtattgttgatattgcgctcggtgataacgatattgaaatccagcgtaacctgctgcaggagatgctggaacgccatccagaaatcgacgtcgttgccggaacggccattgcggcagaggcggcaatgggggaagggcgcaacctgaaaacgccgcttaccgtggtgtcgttttatctttcacatcaggtgtatcgcgggttgaagcggggaagagtgattatggcagccagcgatcaaatggtctggcagggggaactggcggttgagcaggctatcaggcaattacaggggcaatcggtgtctgataatgtcagcccaccgattttagtcatgacgccgaaaaatgccgaccgcgaacatatccgccgctcgctgtcaccagggggatttcgtccggtttatttttatcagcacacatcagcggctaagaaataa

SEQ ID NO: 2558 - protein, 342 aa, Escherichia coli
MRVLLFLLLSLFMLSAFSADNLLRWHDAQHYTVQASTPLKAKRAWKLCALYPSLKDSYWLSLNYGMQEAARRYGVDLKVLEAGGYSQLATQQAQIDQCKQWGAEAILLGSSTTSFPDLQKQVANLPVIELVNAIDAPQVKSRVGVPWFQMGYQPGRYLVQWAHGKPLNVLLMPGPDNAGGSKEMVEGFRAAIAGSPVRIVDIALGDNDIEIQRNLLQEMLERHPEIDVVAGTAIAAEAAMGEGRNLKTPLTVVSFYLSHQVYRGLKRGRVIMAASDQMVWQGELAVEQAIRQLQGQSVSDNVSPPILVMTPKNADREHIRRSLSPGGFRPVYFYQHTSAAKK

SEQ ID NO: 2559 - DNA, 1173 bp, Escherichia coli
atgcggaaactctggaacgcgctacgccgacccagtgctcgttggtcggtactggcgctggtcgctactgggattgtgattggcattgcgctgattgtattgccacacgttgggatcaaagtcaccagcacaaccgaattttgtgtcagttgccacagtatgcaaccggtgtatgaagaatataaacagtcggtgcatttccagaacgcctccggcgtgcgagctgaatgccatgactgtcatatcccgccggatattccaggcatggtgaagcgcaaactggaagcgagcaacgacatttaccagacctttattgcccactccattgatacacctgagaaatttgaagccaaacgcgcggaacttgccgagcgtgaatgggcgcgaatgaaagaaaacaactcggcaacctgccgctcctgccataactacgatgcgatggatcatgcgaagcagcatcctgaagcggcgcgtcagatgaaggtggcagcgaaagataatcaatcctgcatcgactgtcataaaggtattgcccaccagttaccggatatgagtagtggcttccgtaagcagttcgatgagctgcgcgccagtgctaatgatagtggtgacacgctgtactccattgatattaagccgatttatgcggcgaaaggcgataaagaagcgtctggttctctgctgcctgcttcggaagtgaaagtccttaaacgtgacggcgactggctgcaaattgaaatcactggctggacggaaagtgcaggacgtcagcgtgtactcacccaattcccaggtaaacgcatctttgttgcctcgattcgtggtgatgtgcagcagcaggtgaaaacactggagaaaaccaccgttgccgacaccaataccgagtggagcaagttgcaggccactgcgtggatgaagaaaggcgacatggtgaacgatatcaaaccgatctgggcttatgcggattcgctgtacaacggcacctgtaaccagtgccacggcgcaccggaaatatcccactttgacgctaacggttggatcggcacgctcaacggcatgattggctttaccagcctcgataaacgtgaagaacgcaccttgttgaaatatctgcaaatgaatgcgtctgacaccgcaggtaaagctcacggcgataagaaggaagaaaaataa

SEQ ID NO: 2560 - protein, 390 aa, Escherichia coli
MRKLWNALRRPSARWSVLALVATGIVIGIALIVLPHVGIKVTSTTEFCVSCHSMQPVYEEYKQSVHFQNASGVRAECHDCHIPPDIPGMVKRKLEASNDIYQTFIAHSIDTPEKFEAKRAELAEREWARMKENNSATCRSCHNYDAMDHAKQHPEAARQMKVAAKDNQSCIDCHKGIAHQLPDMSSGFRKQFDELRASANDSGDTLYSIDIKPIYAAKGDKEASGSLLPASEVKVLKRDGDWLQIEITGWTESAGRQRVLTQFPGKRIFVASIRGDVQQQVKTLEKTTVADTNTEWSKLQATAWMKKGDMVNDIKPIWAYADSLYNGTCNQCHGAPEISHFDANGWIGTLNGMIGFTSLDKREERTLLKYLQMNASDTAGKAHGDKKEEK

SEQ ID NO: 2561 - DNA, 2547 bp, Escherichia coli
atgaacaataacgatctctttcaggcatcacgtcggcgttttctggcacaactcggcggcttaaccgtcgccgggatgctggggccgtcattgttaacgccgcgccgtgcgactgcgacgcaagcggcgactgaggctgtcatctcgaaagagggcattcttaccgggtcgcactggggggctatccgcgcgacggtgaaggatggtcgctttgtggcagcaaaaccgttcgaactggataaatatccgtcgaaaatgatcgccggattgccggatcatgtacacaacgcggcgcgtattcgttacccgatggtacgcgtggactggctgcgtaagcgccatctgagcgacacctcccaacgcggtgataaccgttttgtgcgcgtgagctgggatgaagccctcgacatgttctatgaagaactggaacgcgtacagaaaactcacgggccgagtgccttgctgaccgccagtggttggcaatcgacagggatgttccataacgcttcggggatgctggcgaaagctattgccttacatggtaatagcgtgggtacgggcggagattactctaccggggctgcgcaggtgatcctgccgcgcgtggtaggttcgatggaagtgtatgaacagcaaacctcctggccgctggtattgcagaacagcaaaactattgtgctgtggggctccgatttgttgaaaaaccagcaagcgaactggtggtgcccggatcacgatgtttatgaatattacgagcagctaaaagcgaaagtcgccgccggtgaaattgaggtcatcagcatcgatccggttgtcacatccacccatgagtatctggggcgcgagcatgtgaagcacattgcggttaacccgcaaactgacgtgccgctgcaactggcgctggcgtatacgctgtacagtgaaaacctgtacgacaaaaacttcctcgctaactactgtgtaggttttgagcagttcctgccgtatctgctgggtgagaaagacggtcagccgaaagatgccgcatgggctgaaaaactgaccggcattgatgccgaaaccattcgtgggctggcacggcagatggcggcgaacagaacgcagattattgctggctggtgcgtacagcgtatgcagcacggtgaacagtgggcgtggatgattgtcgttctggcggcgatgctggggcaaattggcctgccaggtggtggttttggttttggctggcactataacggcgcaggcacgccggggcgtaaaggcgttattttgagtggtttctccggctctacgtcgattccgcctgttcacgacaacagtgactacaaaggctacagcagcaccattccgattgcccgttttatcgatgcgatcctcgaaccggggaaagtgatcaactggaacggtaaatcggtaaaactgccgccgctgaaaatgtgtatttttgccggaactaacccgttccatcgccatcagcagatcaaccgcattattgaaggctggcgcaagctggaaacggttatcgccatagataaccagtggacctcaacctgccgctttgccgatatcgtgctgcctgcgaccacgcagtttgagcgtaacgatctcgaccagtacggcaaccactccaatcgtggcatcatcgccatgaaacaggtcgtgccgccgcagttcgaggcgcgcaacgactttgatattttccgcgagctgtgccgccgctttaatcgcgaagaagcctttaccgaagggctggacgagatgggctggctgaaacgcatctggcaggaaggtgtacaacaaggcaaaggacgcggcgttcatctgccagcgtttgatgacttctggaataacaaagagtacgtcgagtttgaccatccgcagatgtttgttcgccaccaggcattccgcgaagatccggatctcgaaccgctgggcacgccgagtggcctgattgagatctactcaaaaaccatcgccgacatgaactacgacgattgtcaggggcatccgatgtggtttgagaaaatcgaacgctcccacggtgggcctggctcgcagaagtatccgttgcatctgcaatctgtgcatccggatttccgacttcactcgcagttatgtgagtcggaaactctgcgtcagcaatataccgtagcgggtaaagagccagtatttattagcccgcaggatgccagcgcgcgcggtattcgtcacggtgatgtggtacgcgtctttaacgttcgtggtcaggtgttggctggagcagtggtttctgaccgttatgcacccggcgtggcgcgaattcacgaaggggcatggtacgatccggacaaaggcggcgagccaggggcgctgtgcaaatacggtaaccccaacgtgttgaccatcgacatcggtacttcgcagctggcgcaggcgaccagtgcgcacactacgctggtggaaattgagaagtacaacggaacagtggagcaggtgacggcgtttaacggccccgtggagatggtggcgcagtgcgaatatattcccgcgtcgcaggtgaaatcatga

SEQ ID NO: 2562 - protein, 848 aa, Escherichia coli
MNNNDLFQASRRRFLAQLGGLTVAGMLGPSLLTPRRATATQAATEAVISKEGILTGSHWGAIRATVKDGRFVAAKPFELDKYPSKMIAGLPDHVHNAARIRYPMVRVDWLRKRHLSDTSQRGDNRFVRVSWDEALDMFYEELERVQKTHGPSALLTASGWQSTGMFHNASGMLAKAIALHGNSVGTGGDYSTGAAQVILPRVVGSMEVYEQQTSWPLVLQNSKTIVLWGSDLLKNQQANWWCPDHDVYEYYEQLKAKVAAGEIEVISIDPVVTSTHEYLGREHVKHIAVNPQTDVPLQLALAYTLYSENLYDKNFLANYCVGFEQFLPYLLGEKDGQPKDAAWAEKLTGIDAETIRGLARQMAANRTQIIAGWCVQRMQHGEQWAWMIVVLAAMLGQIGLPGGGFGFGWHYNGAGTPGRKGVILSGFSGSTSIPPVHDNSDYKGYSSTIPIARFIDAILEPGKVINWNGKSVKLPPLKMCIFAGTNPFHRHQQINRIIEGWRKLETVIAIDNQWTSTCRFADIVLPATTQFERNDLDQYGNHSNRGIIAMKQVVPPQFEARNDFDIFRELCRRFNREEAFTEGLDEMGWLKRIWQEGVQQGKGRGVHLPAFDDFWNNKEYVEFDHPQMFVRHQAFREDPDLEPLGTPSGLIEIYSKTIADMNYDDCQGHPMWFEKIERSHGGPGSQKYPLHLQSVHPDFRLHSQLCESETLRQQYTVAGKEPVFISPQDASARGIRHGDVVRVFNVRGQVLAGAVVSDRYAPGVARIHEGAWYDPDKGGEPGALCKYGNPNVLTIDIGTSQLAQATSAHTTLVEIEKYNGTVEQVTAFNGPVEMVAQCEYIPASQVKS

SEQ ID NO: 2563 - DNA, 600 bp, Escherichia coli
atgaccacgctgacagtacaacagattgcctgtgtttacgcctggctggcgcagttgttctcccgtgaactggacgatgaacaactgacgcaaatcgccagtgcgcagatggctgaatggttttcgttgctgaaaagcgaacctccgctcactgcggcggtgaatgggctggaaaacagtattgccactctgacagtacgtgacgatgcccgtctggaactggccgctgacttttgcggcctgtttctgatgaccgacaaacaagcggcgctgccgtatgcatcggcctacaaacaggacgagcaagagattaaacgcttgttagttgaggcagggatggagaccagcggcaatttcaacgaaccggcagatcatctggcgatctatctcgagttgttgagtcatctgcatttttcgctgggagaggggaccgttcctgcgcgaagaatcgacggtttgcggcaaaaaacactgacggcgctgcgggaatggttaccagagtttgctgcgcgttgtcgacagtatgacagctttggtttttacgcggcactaagccagttattgctggtgttagtggagtgtgactaccaaaaaagataa

SEQ ID NO: 2564 - protein, 199 aa, Escherichia coli
MTTLTVQQIACVYAWLAQLFSRELDDEQLTQIASAQMAEWFSLLKSEPPLTAAVNGLENSIATLTVRDDARLELAADFCGLFLMTDKQAALPYASAYKQDEQEIKRLLVEAGMETSGNFNEPADHLAIYLELLSHLHFSLGEGTVPARRIDGLRQKTLTALREWLPEFAARCRQYDSFGFYAALSQLLLVLVECDYQKR

SEQ ID NO: 2565 - DNA, 111 bp, Escherichia coli
gtgagtttgttgcctgatgcgacgcttaacgcgtcttatcaggcccacaaaaagcgctgttcccgtaggccggataaggcgttctcgccgcatccggcaactgcgccataa

SEQ ID NO: 2566 - protein, 36 aa, Escherichia coli
MSLLPDATLNASYQAHKKRCSRRPDKAFSPHPATAP

SEQ ID NO: 2567 - DNA, 306 bp, Escherichia coli
atggctaatgttacggtgacttttactattaccgaattttgcctgcataccggcatctctgaagaggagttgaatgaaattgtcggtttgggggtggttgaaccgagtgagatccaggagacaacctgggtatttgacgaccatgccgccattgtggtgcaacgcgcggtacgcctgcgtcatgaactggctctggactggccggggatcgcggtggcgctgacgttaatggatgatattgcgcacctgaagcaggaaaaccgcctgctgcgccagcggctttcccggtttgtggctcacccgtga

SEQ ID NO: 2568 - protein, 101 aa, Escherichia coli
MANVTVTFTITEFCLHTGISEEELNEIVGLGVVEPSEIQETTWVFDDHAAIVVQRAVRLRHELALDWPGIAVALTLMDDIAHLKQENRLLRQRLSRFVAHP

SEQ ID NO: 2569 - DNA, 921 bp, Escherichia coli
atggaattaaaggattattacgccatcatgggcgtgaaaccgacggacgatctcaagacaatcaagaccgcctatcgtcgactggcccgcaaataccatcctgatgtcagcaaagaaccggatgccgaagcccgcttcaaagaggtcgctgaagcctgggaagtgttaagtgatgaacaacgtcgcgctgagtatgatcagatgtggcaacatcgcaacgatccgcaatttaaccgtcagttccatcatggcgacggtcagagttttaacgccgaagattttgacgatatcttctcgtcaattttcggtcagcatgcccgccagagccgtcaacgccccgccacacgcggccacgatattgaaatcgaagtggcggtattcctcgaagaaacgcttactgagcataagcgtaccatcagctataacctgccggtttataacgcctttggcatgatcgaacaggaaatcccgaaaacgctgaatgtgaagatcccggcgggcgtcggcaatggtcaacgcatccgcctgaaaggtcaggggacgccgggcgaaaacggcggtccaaatggcgacctgtggctggtgattcacattgcgccacatccgctgtttgatattgtcggccaggatctggaaatagtggtgccggttagcccgtgggaagcggcgctgggtactaaagtcaccgttccaacactgaaagaaagcattttgctgactatcccgcctggcagccaggccgggcaacgattgcgcgttaaaggcaaaggtctggtgagcaaaaaacagaccggcgatctgtatgcggtactgaaaatcgtgatgccgccgaaaccggatgaaaacactgccgcgctgtggcagcaactggcagacgcccagtcgtcttttgatccacgtaaagattgggggaaagcataa

SEQ ID NO: 2570 - protein, 306 aa, Escherichia coli
MELKDYYAIMGVKPTDDLKTIKTAYRRLARKYHPDVSKEPDAEARFKEVAEAWEVLSDEQRRAEYDQMWQHRNDPQFNRQFHHGDGQSFNAEDFDDIFSSIFGQHARQSRQRPATRGHDIEIEVAVFLEETLTEHKRTISYNLPVYNAFGMIEQEIPKTLNVKIPAGVGNGQRIRLKGQGTPGENGGPNGDLWLVIHIAPHPLFDIVGQDLEIVVPVSPWEAALGTKVTVPTLKESILLTIPPGSQAGQRLRVKGKGLVSKKQTGDLYAVLKIVMPPKPDENTAALWQQLADAQSSFDPRKDWGKA

SEQ ID NO: 2571 - DNA, 1242 bp, Escherichia coli
atgaacaaaacgctaatcgccgcaactgtggcagggatagttttactcgcttcaaatgctcaggcacaaaccgtaccggaaggctatcagctacagcaagtccttatgatgagccgtcataacttacgtgcgccgctggcgaacaatggcagtgtgctggagcagtcgacgccgaataaatggcctgaatgggacgtccccggtgggcagctcaccactaaagggggcgtgctcgaagtgtatatgggccattatatgcgtgaatggctggcagaacaggggatggtgaaatcaggggaatgcccgccaccggacaccgtttatgcctatgccaatagtctgcaacgcaccgtcgcgaccgcgcagttctttattactggcgcattccctgggtgtgatattcatgttcatcaccaggaaaaaatgggcactatggaccccacctttaacccagtgatcaccgatgattccgccgcattcagtgaacaggcggtggcggcaatggagaaagagctcagcaaactccagcttaccgacagctacaagctactggaacaaatcgttaactataaagattcccctgcctgtaaagagaagcaacaatgttcgcttgtagatggcaaaaatacctttagcgcgaagtatcaacaagaaccgggcgtttccgggccgctgaaagttggcaactcgctggtagatgcgtttactttgcaatactacgaaggttttccgatggatcaggtggcctggggagaaattaaatctgaccagcagtggaaggtgttgtcgaagctgaaaaacggttaccaggacagcctgtttacctcaccggaagtggcgcgcaatgttgcgaaaccgctggtcagttatatcgacaaagccctggtcaccgatcgcaccagtgcaccgaaaatcacggtattagttgggcacgactccaacattgcctctctgttaacggcgctggatttcaaaccgtatcagttgcatgaccagaacgaacgcacgccgattggcggcaaaatcgttttccagcgttggcatgacagcaaagccaatcgcgacctgatgaaaattgaatatgtgtaccagagtgcggaacagttacgtaatgccgatgcgttaaccctgcaggcacctgcgcagcgcgtgacgctggaattaagcggttgcccgatagatgccaacggtttttgcccaatggataagtttgatagcgtattgaatgaagcggtgaaataa

SEQ ID NO: 2572 - protein, 413 aa, Escherichia coli
MNKTLIAATVAGIVLLASNAQAQTVPEGYQLQQVLMMSRHNLRAPLANNGSVLEQSTPNKWPEWDVPGGQLTTKGGVLEVYMGHYMREWLAEQGMVKSGECPPPDTVYAYANSLQRTVATAQFFITGAFPGCDIHVHHQEKMGTMDPTFNPVITDDSAAFSEQAVAAMEKELSKLQLTDSYKLLEQIVNYKDSPACKEKQQCSLVDGKNTFSAKYQQEPGVSGPLKVGNSLVDAFTLQYYEGFPMDQVAWGEIKSDQQWKVLSKLKNGYQDSLFTSPEVARNVAKPLVSYIDKALVTDRTSAPKITVLVGHDSNIASLLTALDFKPYQLHDQNERTPIGGKIVFQRWHDSKANRDLMKIEYVYQSAEQLRNADALTLQAPAQRVTLELSGCPIDANGFCPMDKFDSVLNEAVK

SEQ ID NO: 2573 - DNA, 228 bp, Escherichia coli
atgccaactcaagaagcgaaagctcatcacgtcggtgaatgggcatctctgcgcaatacgtcgccggaaatagccgaggccattttcgaagtcgccgggtacgacgaaaaaatggcggaaaagatttgggaagaaggtagcgatgaagtgttagtcaaagcctttgctaagaccgataaagattcgcttttttggggcgaacagaccatcgaacgtaaaaacgtttaa

SEQ ID NO: 2574 - protein, 75 aa, Escherichia coli
MPTQEAKAHHVGEWASLRNTSPEIAEAIFEVAGYDEKMAEKIWEEGSDEVLVKAFAKTDKDSLFWGEQTIERKNV

SEQ ID NO: 2575 - DNA, 597 bp, Escherichia coli
atggctaaagttctggtgctttattattccatgtacggacatattgaaacgatggcacgcgcagttgctgagggtgcaagcaaagtggatggcgcagaagttgtcgttaagcgtgtaccggaaaccatgccgccgcaattatttgaaaaagcaggcggtaaaacgcaaactgcaccggttgcaaccccgcaagaactggccgattacgacgccattatttttggtacacctacccgctttggtaacatgtccggtcaaatgcgtaccttcctcgaccagacgggcggcctgtgggcttccggcgcactatacggaaaactggcgagcgtctttagttccaccggtactggcggcggtcaggaacaaaccatcacatccacctggacgacccttgcgcatcacggcatggtgattgtccccattggctacgcagcgcaggaattatttgacgtttcacaggttcgcggcggtacgccgtacggcgcaaccaccatcgcaggcggtgacggttcacgccagcccagccaggaagaactgtctattgctcgttatcaaggggaatatgtcgcaggtctggcagttaaacttaacggctaa

SEQ ID NO: 2576 - protein, 198 aa, Escherichia coli
MAKVLVLYYSMYGHIETMARAVAEGASKVDGAEVVVKRVPETMPPQLFEKAGGKTQTAPVATPQELADYDAIIFGTPTRFGNMSGQMRTFLDQTGGLWASGALYGKLASVFSSTGTGGGQEQTITSTWTTLAHHGMVIVPIGYAAQELFDVSQVRGGTPYGATTIAGGDGSRQPSQEELSIARYQGEYVAGLAVKLNG

SEQ ID NO: 2577 - DNA, 159 bp, Escherichia coli
ttgcagaagaccgcgaaagagcatcagaagcaggtaaaaaaggtggacagcacagcgggggtaatttcaaaaatgacccgcagcgcgcatctgaagcaggtaaaaaaggtggcaagagcagtcacggtaaaagcgacaactagccgggctaatcaatga

SEQ ID NO: 2578 - protein, 52 aa, Escherichia coli
MQKTAKEHQKQVKKVDSTAGVISKMTRSAHLKQVKKVARAVTVKATTSRANQ

SEQ ID NO: 2579 - DNA, 696 bp, Escherichia coli
gtgatgaccaacgttttagggctgggaaaagccgtcgattttactctcgtcagccatgctgcctggttcggtctgccacatttttccactcctgcttttaatggtcaggcaatgatgctgattgcgcccgtggcggtgattctggtggcggaaaacttaggtcatctcaaggcggtcgccgggatgaccggacgcaatatggacccgtatatggggcgggcattcgtaggcgatgggctggcgacgatgctttctggctctgtcggcggtagcggcgtaaccacctacgccgagaatattggtgtgatggccgtgacaaaagtctactcgacgctggtgtttgttgccgctgccgtcatcgccatgctgttgggcttttcgccgaaatttggcgcgctgatccatactattccggccgcggtgattggtggtgcatcaattgttgtgttcgggctgattgccgtcgcaggcgcacggatctgggtacaaaacagtgtggatttaagccagaacggtaatttgattatggtcgcagtaaccttagtgctgggtgcgggtgattttgctctcacgctgggcggttttacgttgggagggatcggtacagcaacttttggcgcgattttactcaatgcgttgttaagcagaaggttggttgacgttccaccgccagaagttgttcatcagaagccataa

SEQ ID NO: 2580 - protein, 231 aa, Escherichia coli
MMTNVLGLGKAVDFTLVSHAAWFGLPHFSTPAFNGQAMMLIAPVAVILVAENLGHLKAVAGMTGRNMDPYMGRAFVGDGLATMLSGSVGGSGVTTYAENIGVMAVTKVYSTLVFVAAAVIAMLLGFSPKFGALIHTIPAAVIGGASIVVFGLIAVAGARIWVQNSVDLSQNGNLIMVAVTLVLGAGDFALTLGGFTLGGIGTATFGAILLNALLSRRLVDVPPPEVVHQKP

SEQ ID NO: 2581 - DNA, 138 bp, Escherichia coli
atgacgcatgcatttttgtctgtagctcgtcaaaaagccatcaccgccggttaccccggcggttttctgtttatggcttctgatgaacaacttctggcggtggaacgtcaaccaaccttctgcttaacaacgcattga

SEQ ID NO: 2582 - protein, 45 aa, Escherichia coli
MTHAFLSVARQKAITAGYPGGFLFMASDEQLLAVERQPTFCLTTH

SEQ ID NO: 2583 - DNA, 531 bp, Escherichia coli
atggcaatgttcggttttcctcactggcagttaaaatcgacctctacagagagcggcgtggtcgcgccggatgaacgattgccgtttgctcaaacggcagtaatgggcgttcaacacgcggtggcgatgtttggcgcgacggtgttaatgccaattctgatggggctggatcccaatctttccattttaatgtcggggatcggcacgttactgtttttctttattaccggcgggcgcgtgcccagttatctcggttccagcgcggcttttgtcggcgtggtgattgccgcgacgggctttaatggtcagggaattaatccgaatatcagcatcgcgctgggcgggattatcgcctgtgggctggtttataccgtcattggcctggtggtgatgaaaatcggtacgcgctggattgaacgactaatgccgccggttgtgacgggtgcggtagtgatggcgattggcctgaacttagcgcctatcgcagtgaaaaatgtatcggcttcggcctttgatagctggatggcgtga

SEQ ID NO: 2584 - protein, 176 aa, Escherichia coli
MAMFGFPHWQLKSTSTESGVVAPDERLPFAQTAVMGVQHAVAMFGATVLMPILMGLDPNLSILMSGIGTLLFFFITGGRVPSYLGSSAAFVGVVIAATGFNGQGINPNISIALGGIIACGLVYTVIGLVVMKIGTRWIERLMPPVVTGAVVMAIGLNLAPIAVKNVSASAFDSWMA

SEQ ID NO: 2585 - DNA, 495 bp, Escherichia coli
atgaacattgtcgatcaacaaacctttcgcgatgcgatgtcctgtatgggcgcggcggtcaatatcatcactactgacggtccagccgggcgcgccgggttcaccgccagcgccgtctgcagcgtgactgacacgccgcccacattactggtgtgcctgaatcgtggggcgtccgtctggccggtattcaatgaaaatcgaacgctgtgtgtaaatacacttagcgccgggcaggagccgctttcaaacctttttggcggcaaaacgcccatggaactccgctttgccgccgcccgctggcagactggtgtgaccggatgcccgcaactggaagaggcactggtttcgtttgactgccgtatcagccaggtggtgagcgtcggcacccacgacattttgttttgcgccatcgaagcgattcatcgtcacgccacaccctacgggctggtgtggttcgatcgcagttatcacgcgctgatgcgccctgcttgttaa

SEQ ID NO: 2586 - protein, 164 aa, Escherichia coli
MNIVDQQTFRDAMSCMGAAVNIITTDGPAGRAGFTASAVCSVTDTPPTLLVCLNRGASVWPVFNENRTLCVNTLSAGQEPLSNLFGGKTPMELRFAAARWQTGVTGCPQLEEALVSFDCRISQVVSVGTHDILFCAIEAIHRHATPYGLVWFDRSYHALMRPAC

SEQ ID NO: 2587 - DNA, 474 bp, Escherichia coli
atgaaatgggggccgacatctgctaactgttctccggcacggatcgtgtttatccgcactgcagaaggaaaagaacgtctgcgcccggcgctttccagcggcaatctgcaaaaaaccctgaccgcgcccgtcaccgctatcgtcgcctgggacagtgaattttatgaacggttaccacagctgtttcctcacggcgatgcccgcagttggtttacctccagcccacaacttgccgaagaaacagcgtttcgcaacagttccatgcaggcggcctatctgatcttcgcctgccgtgcgctggggctggataccggcccgatgtcgggctttgaccgtcaatacgttgacgacgccttttttgcgggcagcacgctgaagagcaatctgctgattaatatcggctatggcgattccagcaaactttttgcgcgcctgccacgtctgtcctttgaagaagcctgcgggctgttgtaa

SEQ ID NO: 2588 - protein, 157 aa, Escherichia coli
MKWGPTSANCSPARIVFIRTAEGKERLRPALSSGNLQKTLTAPVTAIVAWDSEFYERLPQLFPHGDARSWFTSSPQLAEETAFRNSSMQAAYLIFACRALGLDTGPMSGFDRQYVDDAFFAGSTLKSNLLINIGYGDSSKLFARLPRLSFEEACGLL

SEQ ID NO: 2589 - DNA, 801 bp, Escherichia coli
atgaaactttcactctcacctcccccttatgctgatgcgcccgtagtggtgttgatttcgggtcttggcggtagcggcagttactggttaccgcaactggcggtgctggttcaggagtatcaggtagtctgttacgaccagcgcggcaccggcaataatcccgacacgctggcagaagattacagtatcgcccagatggcagcggaactgcatcaggcgctggtagccgcagggattgagcgttacgcggtggtcggccatgcgctcggtgcgctggtgggaatgcagctggcgctggattatcccgcgtcggtaactgtgctggtcagcgttaacggctggctacgaataaacgcccatacgcgccgctgttttcaggttcgcgaacagttactacatagcggcggcgcgcaggcatgggtggaagcgcagccgttgttcctctatcccgccgactggatggcggcccgcgcacctcgccttgaggcagaagatgcgctggcactggcgcattttcaaggcaaaaataatttactgcgtcgacttaacgccctcaaacgcgctgactttagtcaccatgcggatcgtatccgctgcccggtgcaaatcatctgcgccagtgatgatctgctggtgccaacagcatgttccagtgaacttcacgccgccctgcccgatagccagaaaatggtgatgcgctatggcggacacgcctgcaacgtgaccgatcccgaaacgtttaatgctctgttactcaacgggcttgccagcctgttacatcaccgtgaagccgctctgtaa

SEQ ID NO: 2590 - protein, 266 aa, Escherichia coli
MKLSLSPPPYADAPVVVLISGLGGSGSYWLPQLAVLVQEYQVVCYDQRGTGNNPDTLAEDYSIAQMAAELHQALVAAGIERYAVVGHALGALVGMQLALDYPASVTVLVSVNGWLRINAHTRRCFQVREQLLHSGGAQAWVEAQPLFLYPADWMAARAPRLEAEDALALAHFQGKNNLLRRLNALKRADFSHHADRIRCPVQIICASDDLLVPTACSSELHAALPDSQKMVMRYGGHACNVTDPETFNALLLNGLASLLHHREAAL

SEQ ID NO: 2591 - DNA, 96 bp, Escherichia coli
gtgagtgcgggcatcggtgaacagggtgctaagcgcacctgggctaacggcttcgttcatagcaattccttacagagcggcttcacggtgatgtaa

SEQ ID NO: 2592 - protein, 31 aa, Escherichia coli
MSAGIGEQGAKRTWANGFVHSNSLQSGFTVM

SEQ ID NO: 2593 - DNA, 387 bp, Escherichia coli
atgccaaaatccgtaattattcctgctggcagcagcgcaccgctggcccccttcgttcccggcacgctggctgatggcgtggtgtatgtctccggtacgctggcttttgatcaacataacaacgtgctgtttgccgatgacccaaaggcgcaaacccgccacgttctggaaaccatccgcaaggtcatcgagacggcgggtggcacaatggcggatgtgactttcaacagcatctttattaccgactggaaaaattacgccgcgattaacgaaatctacgccgaatttttcccgggtgacaaaccggcgcgattctgcattcagtgcggactggtaaaacctgacgcgctagtggaaatcgccacaattgcgcatatcgccaagtga

SEQ ID NO: 2594 - protein, 128 aa, Escherichia coli
MPKSVIIPAGSSAPLAPFVPGTLADGVVYVSGTLAFDQHNNVLFADDPKAQTRHVLETIRKVIETAGGTMADVTFNSIFITDWKNYAAINEIYAEFFPGDKPARFCIQCGLVKPDALVEIATIAHIAK

SEQ ID NO: 2595 - DNA, 696 bp, Escherichia coli
atgatgacgaccttaaccgcacgaccggaagccattaccttcgatccgcagcaaactgcgctgatcgtggtggatatgcaaaatgcctatgccacgccaggcggctacttagatctcgccgggtttgatgtctcaaccactcgcccggtcattgccaacattcaaaccgccgtgaccgcagcgcgaacggcagggatgctgatcatctggtttcaaaatggctgggatgaacagtatgtcgaggctggcggccccggctcaccgaattatcataaatcgaacgccctgaaaaccatgcgtaatcagccgctgctgcaggggaaattgctggcgaaaggctcctgggattatcaactggtggatgagctggtgccgcagcctggcgatatagtgctgccgaagccgcgctacagcggtttcttcaatacgccgctggacagcattttgcgcagccgcggaatacgccatctggttttcaccggcatcgctaccaacgtctgcgtagaatcgacgctacgcgacggcttttttctggagtatttcggcgtggtgctggaagacgcaacacaccaggcggggccggaatttgcacagaaagccgcgttgttcaatatcgaaaccttttttggctgggtcagcgacgtcgaaacgttctgcgacgcgctttcttccacgtcctttgctcgtatcgcttaa

SEQ ID NO: 2596 - protein, 231 aa, Escherichia coli
MMTTLTARPEAITFDPQQTALIVVDMQNAYATPGGYLDLAGFDVSTTRPVIANIQTAVTAARTAGMLIIWFQNGWDEQYVEAGGPGSPNYHKSNALKTMRNQPLLQGKLLAKGSWDYQLVDELVPQPGDIVLPKPRYSGFFNTPLDSILRSRGIRHLVFTGIATNVCVESTLRDGFFLEYFGVVLEDATHQAGPEFAQKAALFNIETFFGWVSDVETFCDALSSTSFARIA

SEQ ID NO: 2597 - DNA, 1095 bp, Escherichia coli
atgatgaaaattggcgtattcgtacctattggcaacaacggctggctcatttcgacccacgcgccgcagtacatgccgacatttgaactgaataaagccattgtgcaaaaagcggagcactaccatttcgatttcgccctgtcgatgatcaaactgcgtggctttggcggcaaaactgagttctgggatcacaaccttgagtcgttcaccttgatggcggggctggcagccgtcacctcacgcattcagatatacgcgacagctgccaccttaacgttacctccggcaatcgtcgcccgtatggccgcaaccatcgactccatctctggcgggcgttttggcgtcaacctcgtgactggctggcagaagcccgagtatgagcagatggggatctggcctggcgatgactatttctcccgtcgttacgactatctcaccgaatatgttcaggtgctgcgcgacctgtggggctcggggaaaagcgattttaaaggcgattttttcactatggatgattgtcgcgtcagtccgcaaccgagtgtccccatgaaagtgatctgcgccgggcaaagcgacgctggcatggcgttctccgcccggtatgccgattttaacttctgtttcggcaaaggcgtaaatacacccacggctttcgccccgaccgctgcgcggatgaaacaggccgcagagcaaaccggacgcgacgttggctcttatgtgttgtttatggtgattgccgacgaaaccgacgatgccgctcgtgcaaaatgggaacactacaaagcgggcgcggatgaagaggcgttaagctggctaactgaacaaagtcagaaagatacccgctcaggtactgacaccaacgtccgtcagatggccgatcccacttcggcggtaaacatcaatatggggacgttagtcggttcttacgccagtgtcgcgcgcatgttagatgaagtcgcaagcgtgcctggtgccgaaggcgtgctgttgaccttcgatgattttctgtcgggaatcgaaaacttcggcgagcgcattcaaccactgatgcagtgccgcgcccatctccctgcgctgactcaggaggtggcatga

SEQ ID NO: 2598 - protein, 364 aa, Escherichia coli
MMKIGVFVPIGNNGWLISTHAPQYMPTFELNKAIVQKAEHYHFDFALSMIKLRGFGGKTEFWDHNLESFTLMAGLAAVTSRIQIYATAATLTLPPAIVARMAATIDSISGGRFGVNLVTGWQKPEYEQMGIWPGDDYFSRRYDYLTEYVQVLRDLWGSGKSDFKGDFFTMDDCRVSPQPSVPMKVICAGQSDAGMAFSARYADFNFCFGKGVNTPTAFAPTAARMKQAAEQTGRDVGSYVLFMVIADETDDAARAKWEHYKAGADEEALSWLTEQSQKDTRSGTDTNVRQMADPTSAVNINMGTLVGSYASVARMLDEVASVPGAEGVLLTFDDFLSGIENFGERIQPLMQCRAHLPALTQEVA

SEQ ID NO: 2599 - DNA, 639 bp, Escherichia coli
atgacgcaaggcgcagtgaaaacaacgggtaagcgttcgcgcgcagtaagcgcgaagaaaaaagcgattcttagcgcagcactggacactttttcacaattcggttttcacggcacaaggctggagcagatcgcggaattggcgggtgtttcaaaaaccaatctgctgtattactttccgtcaaaagaggcgctgtatatagccgtactgcggcagattctcgatatctggctggcaccgttaaaagcgtttcgagaagatttcgccccgctggcggcgatcaaagaatacatccgtctgaagctggaagtttcccgcgattatccgcaggcttcgcgcctgttctgtatggagatgctggcaggtgcaccgctgttaatggatgaactgacgggcgatttgaaggcattaattgatgagaaatcggcgctcattgccggttgggttaaaagcggcaaactcgcgccgattgacccgcagcatttgatttttatgatttgggcttccactcaacattacgccgattttgcccctcaggtggaggcggtgacaggcgtgacgttgcgcgatgaggtgtttttcaatcaaacggttgaaaacgtgcagcggattattattgaggggattcgaccacgttaa

SEQ ID NO: 2600 - protein, 212 aa, Escherichia coli
MTQGAVKTTGKRSRAVSAKKKAILSAALDTFSQFGFHGTRLEQIAELAGVSKTNLLYYFPSKEALYIAVLRQILDIWLAPLKAFREDFAPLAAIKEYIRLKLEVSRDYPQASRLFCMEMLAGAPLLMDELTGDLKALIDEKSALIAGWVKSGKLAPIDPQHLIFMIWASTQHYADFAPQVEAVTGVTLRDEVFFNQTVENVQRIIIEGIRPR

SEQ ID NO: 2601 - DNA, 3963 bp, Escherichia coli
atgggaaccaccaccatgggggttaagctggacgacgcgacgcgtgagcgtattaagtctgccgcgacacgtatcgatcgcacaccacactggttaattaaacaggcgattttttcttatcttgaacaactggaaaacagcgatactctcccggagctacctgcgctgctttctggcgcggccaatgagagcgatgaagcaccgactccggcagaggaaccacaccagcctttcctcgactttgccgagcaaatattgccccagtcggtttcccgcgccgcgatcaccgcggcctatcgccgcccggaaaccgaagcggtttctatgctgctggaacaagctcgcctgccgcagccagttgctgaacaggcgcacaaactggcgtatcaactggccgataaactgcgtaatcaaaaaaacgccagtggtcgcgcaggtatggttcaggggttattgcaggagttttcgttgtcatcgcaggaaggcgtggcgctgatgtgtctggcggaagcgttgttgcgtattcccgacaaagccacccgtgacgcgttaattcgcgacaaaatcagtaacggtaactggcagtcacacattggtcgtagcccgtccctgtttgttaatgccgctacctgggggctgctgtttaccggcaaactggtttccacccataacgaagccagcctctcccgctcgctgaaccgcattatcggtaagagcggtgaaccgctgatccgcaaaggtgtggatatggcgatgcgcctgatgggcgagcagttcgtcacgggcgaaaccatcgcggaagcgttagccaatgcccgcaaactggaagagaaaggtttccgttactcttacgatatgctgggcgaagccgcactgactgccgcagatgcacaagcgtatatggtttcctatcagcaggcgattcacgccattggtaaagcgtctaacggtcgtggcatctatgaaggtccgggcatttcaatcaagctgtcggcgctacatccgcgttatagccgcgcccagtatgaccgggtaatggaagagctttacccgcgtctgaaatcactcaccctgctggcgcgtcagtacgatattggtattaacatcgatgccgaagaggccgatcgcctggagatctccctcgatctgctggaaaaactctgtttcgagcctgaactggcaggctggaacggcatcggttttgttattcaggcttatcaaaaacgctgcccgttggtgatcgattacctgattgatctcgccacccgaagccgtcgccgtctgatgattcgcctggtgaaaggcgcgtactgggatagtgaaatcaagcgtgcacagatggacggccttgaaggttatccggtttatacccgcaaggtgtataccgacgtttcttatcttgcctgtgcgaaaaagctgctggcggtgccaaatctaatctacccgcagttcgcgacgcacaacgcccatacgctggcggcaatttatcaactggcgggtcaaaactactacccaggtcagtacgagttccagtgcctgcatggtatgggcgagccactgtatgagcaggtcaccgggaaagttgccgacggcaaacttaaccgtccgtgtcgtatttatgctccggtcggtacacatgaaacgctgctggcatatctggtgcgccgcctgctggaaaacggtgctaacacctcgtttgttaaccgtattgccgacacctctttgccactggatgaactggtcgccgatccagtcactgctgtagaaaaactggcgcaacaggaagggcaaactggattaccgcatccgaaaattcccctgccgcgcgatctttacggtcacgggcgcgacaactcggcagggctggatctcgctaacgaacaccgtctggcctcgctctcttcagccctgctcaatagtgcactgcaaaaatggcagtccttgccaatgctggaacaatcggtcgcggctggtgagatgtcgcccgttattaaccctgcggaaccgaaagatattgtgggctatgtgcgtgaagccacgccgcgtgaagtagaacaggcgctggaaagtgcggttaataacgcgccaatctggtttgccactcctccggctgaacgcgcggcgattttgcatcgcgctgccgtgctaatggaaagccagatgcagcaactgattggtattctggtgcgtgaagccggaaaaaccttcagtaacgccattgctgaagtgcgcgaagcggtcgattttctccactactatgccggacaggtgcgggatgatttcgctaacgaaacccaccgtccattagggcctgtggtatgtatcagtccgtggaacttcccgctggctattttcaccgggcagatcgctgccgcactggcggcaggtaacagcgtgctggcaaaaccggcagaacaaacgccgctgattgccgcgcaagggatcgccattttgctggaagcgggtgtaccgccaggcgtggtgcaattgctgccaggtcggggtgaaaccgtgggcgcgcaactgacgggtgatgatcgcgtgcgcggggtgatgtttaccggttcaaccgaagtcgctacgttactgcagcgcaatatcgccagccgcctggacgctcagggtcgccctattccgctcatcgctgaaaccggcggcatgaacgcgatgattgtcgattcttcagcactgaccgaacaagtcgtaatagatgtgctggcctcggcgttcgacagtgcaggtcagcgttgttcggcactgcgcgtgctgtgcctgcaagatgagattgccgaccacacgctgaaaatgctgcgcggcgcaatggccgaatgccggatgggtaatccgggtcgcctgaccaccgatatcggtccggtgattgatagcgaagcgaaagccaatatcgagcgtcatattcagaccatgcgtagtaaaggccgtcaggtgttccaggcggtgcgggaaaacagcgaagatgcccgtgaatggcaaagcggcacctttgtcgctccgacgctgatcgaactggatgactttgccgaattacaaaaagaggtctttggtccggtgctgcatgtggtgcgttacaaccgtaaccagctcccagagctgatcgagcagattaacgcttccggctatggtctgacgcttggcgttcatacgcgtattgatgaaaccattgcccaggtcactggctcggcgcaggtcggtaatctgtacgttaaccgtaatatggtgggcgcggtggttggggtgcaaccgttcggcggcgaagggttgtccggtaccgggccgaaagcaggcggtccgctctatctctaccgtctgctggcgaatcgcccggaaagtgcgctggcggtgacgctcgcgcgtcaggatgcggagtatccggtcgatgcgcagttgaaagccgcattgactcagccgctaaatgcactgcgggaatgggcggcaaaccgtccagaattgcaggcgttatgtacgcaatatggcgagttggcgcaggcaggaacacaacgattgttgccagggccgacgggtgaacgcaacacctggacgctgctgccgcgtgagcgcgtgttgtgtattgcggatgatgaacaggatgcgctgactcagctcgccgccgtgctggcggtgggtagccagatgctgtggccggatgatgcgctgcatcgtcagttagtgaaggcattgccatcggcagtcagcgaacgtattcaactggcgaaagcggaaaatataaccgctcaaccctttgatgcggtgatcttccacggtgattcggatcagcttcgcgcattgtgtgaagccgttgccgcgcgggatggtgcaattgtttcggtgcagggttttgcccgtggcgaaagcaatatccttctggaacggctgtatatcgagcgttcgctgagtgtgaataccgctgctgctggcggtaacgccagtttaatgacgatcggttaa

SEQ ID NO: 2602 - protein, 1320 aa, Escherichia coli
MGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLRIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADGKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQSLPMLEQSVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLLPGRGETVGAQLTGDDRVRGVMFTGSTEVATLLQRNIASRLDAQGRPIPLIAETGGMNAMIVDSSALTEQVVIDVLASAFDSAGQRCSALRVLCLQDEIADHTLKMLRGAMAECRMGNPGRLTTDIGPVIDSEAKANIERHIQTMRSKGRQVFQAVRENSEDAREWQSGTFVAPTLIELDDFAELQKEVFGPVLHVVRYNRNQLPELIEQINASGYGLTLGVHTRIDETIAQVTGSAQVGNLYVNRNMVGAVVGVQPFGGEGLSGTGPKAGGPLYLYRLLANRPESALAVTLARQDAEYPVDAQLKAALTQPLNALREWAANRPELQALCTQYGELAQAGTQRLLPGPTGERNTWTLLPRERVLCIADDEQDALTQLAAVLAVGSQMLWPDDALHRQLVKALPSAVSERIQLAKAENITAQPFDAVIFHGDSDQLRALCEAVAARDGAIVSVQGFARGESNILLERLYIERSLSVNTAAAGGNASLMTIG

SEQ ID NO: 2603 - DNA, 210 bp, Escherichia coli
atgatgttgcaactttgtgcaaccgtgttaaatgtgacctgcgtagcaagcttaaaaatgaatgaaatgttaataaacgaaatcgatatgacagggattaaaaaaataactcagactttttctctgcggcagttaacatttttgaaaggtgcaaccgcaaaaaatgtgagagagtgcaacctgatgaaaaatagtgtcgctgagcactaa

SEQ ID NO: 2604 - protein, 69 aa, Escherichia coli
MMLQLCATVLNVTCVASLKMNEMLINEIDMTGIKKITQTFSLRQLTFLKGATAKNVRECNLMKNSVAEH

SEQ ID NO: 2605 - DNA, 1509 bp, Escherichia coli
atggctattagcacaccgatgttggtgacattttgtgtctatatctttggcatgatattgattgggtttatcgcctggcgatcaacgaaaaacttcgacgactatattctgggcggtcgtagtcttgggccattcgtgacggcattatcggcgggtgcgtcggatatgagcggctggctgttaatggggttgccaggcgctgtttttctttccgggatttccgaaagctggatcgccattggtctgacattaggcgcgtggatcaactggaagctggtggccgggcggttgcgtgtgcataccgaatacaacaataacgccttaacattgccggattatttcaccgggcgctttgaagataaaagccgcattttgcgcattatctccgcgctggttattttgctgttcttcaccatttattgcgcttcaggcattgtggcaggcgcgcgtctgtttgaaagtacctttggcatgagctacgaaacggctctgtgggcgggggctgcggcgacgatcctttacacctttattggcggtttcctcgcggtgagctggactgacactgtacaggccagtctgatgattttttccctgatcctgacgccagttatcgtcattatcagtgtcggtggctttggtgactcgctggaagtaatcaaacaaaagagcattgaaaacgtggatatgctcaaagggttgaattttgtcgccattatctcgctgatgggttgggggctgggttacttcgggcagccgcacatcctggcgcgttttatggcggcagattctcaccacagcattgtccatgcgcgtcgtattagtatgacctggatgatcctctgcctggcaggggcggtggctgtcggcttctttggtatcgcttactttaacgagcacccggcggtagcaggtgcggtaaaccagaacgccgagcgcgtgtttattgaactggcacaaattctgtttaacccgtggattgccgggattttgctgtcggcgattctggcggcggtaatgtcaacgttaagttgccagctgctggtatgttccagtgcgattaccgaagatttatacaaagcgtttctgcgtaaacaggccagccagaaagagctggtgtgggtagggcgagtgatggtgctggtggtggcgctggtggcgattgcgctggcggcaaacccggaaaaccgcgtgctgggcttagtgagctacgcgtgggcaggctttggcgcagcgtttggtccggtggtgctgttctcggtgatgtggtcacgcatgacgcgcaacggtgcgctggcggggatgatcatcggtgcgctgacggttatcgtctggaaacagttcggctggctgggtctgtacgaaattattccgggctttatcttcggcagtatcgggattgtagtgtttagtttgctgggtaaagcgccatcagcggcgatgcaaaaacgctttgccgaggccgatgcgcactatcattcggctccgccgtcacggttgcaggaagggtaa

SEQ ID NO: 2606 - protein, 502 aa, Escherichia coli
MAISTPMLVTFCVYIFGMILIGFIAWRSTKNFDDYILGGRSLGPFVTALSAGASDMSGWLLMGLPGAVFLSGISESWIAIGLTLGAWINWKLVAGRLRVHTEYNNNALTLPDYFTGRFEDKSRILRIISALVILLFFTIYCASGIVAGARLFESTFGMSYETALWAGAAATILYTFIGGFLAVSWTDTVQASLMIFSLILTPVIVIISVGGFGDSLEVIKQKSIENVDMLKGLNFVAIISLMGWGLGYFGQPHILARFMAADSHHSIVHARRISMTWMILCLAGAVAVGFFGIAYFNEHPAVAGAVNQNAERVFIELAQILFNPWIAGILLSAILAAVMSTLSCQLLVCSSAITEDLYKAFLRKQASQKELVWVGRVMVLVVALVAIALAANPENRVLGLVSYAWAGFGAAFGPVVLFSVMWSRMTRNGALAGMIIGALTVIVWKQFGWLGLYEIIPGFIFGSIGIVVFSLLGKAPSAAMQKRFAEADAHYHSAPPSRLQEG

SEQ ID NO: 2607 - DNA, 831 bp, Escherichia coli
atgtttgttccgtttctcattatgttgcgcgaaggacttgaagccgcgctgattgtcagtttgattgccagctatcttaagcgtacccagcgaggccgatggattggtgtaatgtggattggcgtgttgcttgccgctgcgttgtgtctgggcttgggtatcttcattaacgaaaccaccggcgaatttccgcaaaaagaacaggaactgtttgaaggcattgtggcggtgatcgccgtggtgatccttacctggatggttttctggatgcgcaaagtgtcgcgcaacgtcaaagtacaactggagcaggcggtcgatagcgcattgcagcgtggaaatcatcatggctgggcgctggtgatgatggtcttttttgccgttgcaagggaagggctggagtcggtctttttcctgctggcggcatttcaacaagatgtcgggatctggccgccgctgggtgcaatgcttggtcttgctacagccgtggtgcttggcttcctgctctactggggcggtattcgcctcaatcttggtgcattttttaaatggaccagtctgtttattctcttcgtcgccgcagggctggcagctggtgccattcgcgcatttcatgaagccggattgtggaaccactttcaggaaatcgccttcgatatgagcgcggtgctctcaactcactcgctgtttggcacactgatggaagggatttttggctatcaggaagcaccgagcgtcagcgaagtcgccgtctggtttatttatctcatcccggcgctggtggcatttgttctgccaccacgcgcaggggcgactgcgtcccgctccgtgtag

SEQ ID NO: 2608 - protein, 276 aa, Escherichia coli
MFVPFLIMLREGLEAALIVSLIASYLKRTQRGRWIGVMWIGVLLAAALCLGLGIFINETTGEFPQKEQELFEGIVAVIAVVILTWMVFWMRKVSRNVKVQLEQAVDSALQRGNHHGWALVMMVFFAVAREGLESVFFLLAAFQQDVGIWPPLGAMLGLATAVVLGFLLYWGGIRLNLGAFFKWTSLFILFVAAGLAAGAIRAFHEAGLWNHFQEIAFDMSAVLSTHSLFGTLMEGIFGYQEAPSVSEVAVWFIYLIPALVAFVLPPRAGATASRSV

SEQ ID NO: 2609 - DNA, 1128 bp, Escherichia coli
atgaccattaacttccgccgtaacgcattgcagttgagcgtggctgcgctgttctcttctgcttttatggctaacgccgctgatattccgcaagtcaaagtgaccgtgacggataagcagtgcgagccgatgaccattacggttaacgccgggaaaacacagttcattattcagaaccacagccagaaggcgctggagtgggagatcctcaaaggcgtgatggtggtggaagagcgggaaaatatcgcccctggttttagccagaaaatgacggcgaatttacagcctggcgaatacgatatgacctgcggtctgctgactaacccgaaagggaagttgatcgtcaaaggtgaagcaacggcggatgcggcgcaaagtgatgcgctgttaagtcttggtggtgcaattactgcatataaagcgtatgtcatggcggaaaccacgcaactggtgaccgacaccaaagcctttaccgacgctattaaagcaggcgatatcgaaaaagcgaaagcactgtatgcgccgacgcgccagcactatgagcgcattgaaccgattgctgaactgttctccgatctggatggcagcattgacgcccgtgaagatgattacgagcaaaaagccgccgatccaaaattcaccggtttccaccgtctggaaaaagcattgtttggcgataacaccaccaaagggatggataagtatgctgaccagctttataccgatgtggtcgatttgcaaaaacgcatcagtgaactggctttccctccttcaaaagtggtcggcggtgcagccggactgattgaggaagtggcggccagcaaaatcagcggtgaagaagatcgctacagccacaccgatctgtgggatttccaggctaacgttgaaggctcgcagaaaattgtcgatctgctgcgtccacaactacaaaaagcgaatccggaactgctggcaaaagtcgatgccaacttcaaaaaggtcgataccattctggcgaaataccgtactaaagacggttttgaaaattacgacaaactgaccgatgctgaccggaatgcactgaaaggaccgattactgcgctggcggaagatctggcgcaacttcgcggtgtgctggggctggactaa

SEQ ID NO: 2610 - protein, 375 aa, Escherichia coli
MTINFRRNALQLSVAALFSSAFMANAADIPQVKVTVTDKQCEPMTITVNAGKTQFIIQNHSQKALEWEILKGVMVVEERENIAPGFSQKMTANLQPGEYDMTCGLLTNPKGKLIVKGEATADAAQSDALLSLGGAITAYKAYVMAETTQLVTDTKAFTDAIKAGDIEKAKALYAPTRQHYERIEPIAELFSDLDGSIDAREDDYEQKAADPKFTGFHRLEKALFGDNTTKGMDKYADQLYTDVVDLQKRISELAFPPSKVVGGAAGLIEEVAASKISGEEDRYSHTDLWDFQANVEGSQKIVDLLRPQLQKANPELLAKVDANFKKVDTILAKYRTKDGFENYDKLTDADRNALKGPITALAEDLAQLRGVLGLD

SEQ ID NO: 2611 - DNA, 1272 bp, Escherichia coli
atgcagtatgaagatgaaaacggcgtgaatgaaccgtcacgccgacgtttactgaaagggattggtgcgctggcgctggcgggaagttgtccggtcgctcatgcacaaaaaacgcaaagtgcgccgggtacgctttcaccggatgcacgcaatgagaaacagccgttttatggtgagcatcaggcagggatcctgacaccacaacaggctgcaatgatgctggtggcgtttgatgtgcttgccagcgataaagccgatcttgaacggttgtttcgcttgttgactcagcgttttgcttttctgactcagggcggagcggcaccagaaacgccaaatccgcgcctgccaccactcgattccggcattcttggcggctacattgcgcccgataatctcaccatcacgttatcggtgggtcactcattgtttgatgagcgctttggccttgcgccacagatgccaaaaaagttgcagaagatgacgcgtttccctaacgactcgctggatgcggcgttatgtcatggtgatgtgttgctacaaatttgcgccaacacccaggacacggtgatccatgtgctgcgcgatatcatcaaacacacgccggatttgctcagcgtgcgctggaagcgggaagggtttatttccgaccacgcagcgcgtagtaaaggcaaagagacgccgataaatttgctgggctttaaagacggcaccgccaatcccgatagccagaatgataagttgatgcaaaaagtggtgtgggtgacggcagatcagcaggagcctgcgtggacaatcggtggcagctatcaggcagtacgcttgattcagtttcgagtggaattttgggacagaacgccgctgaaagagcagcagacgatatttggtcgtgataagcaaaccggtgcgccgctgggcatgctgcatgagcatgatgttcccgattacgctagcgatccggaagggaaggtgattgcgctggacagccatatccggctggcgaatccccgcacggcggagagcgagtccagcctgatgctgcgtcgtggctacagttattcgttgggcgtcaccaattccgggcaactcgatatggggctactgtttgtctgctaccaacacgatctggaaaagggcttcctgacagtacaaaaaaggttgaatggcgaggcgctggaggaatatgtcaaacctatcggtggcggctatttctttgcgctgccgggtgtgaaggacgcgaacgattatctcggaagcgcattattgcgggtttaa

SEQ ID NO: 2612 - protein, 423 aa, Escherichia coli
MQYEDENGVNEPSRRRLLKGIGALALAGSCPVAHAQKTQSAPGTLSPDARNEKQPFYGEHQAGILTPQQAAMMLVAFDVLASDKADLERLFRLLTQRFAFLTQGGAAPETPNPRLPPLDSGILGGYIAPDNLTITLSVGHSLFDERFGLAPQMPKKLQKMTRFPNDSLDAALCHGDVLLQICANTQDTVIHVLRDIIKHTPDLLSVRWKREGFISDHAARSKGKETPINLLGFKDGTANPDSQNDKLMQKVVWVTADQQEPAWTIGGSYQAVRLIQFRVEFWDRTPLKEQQTIFGRDKQTGAPLGMLHEHDVPDYASDPEGKVIALDSHIRLANPRTAESESSLMLRRGYSYSLGVTNSGQLDMGLLFVCYQHDLEKGFLTVQKRLNGEALEEYVKPIGGGYFFALPGVKDANDYLGSALLRV

SEQ ID NO: 2613 - DNA, 924 bp, Escherichia coli
gtgcgtagccgtttttcggcattttatccaaaagcaaactatggcttacaaggaagccaaccctctgatgttcgtgcgcataatcgcgctgccaacggcgcgtgtgatgaatacaaacaactcaaggtgctctccatgggaagacaaaaagcagtgatcaaagctcgtcgcgaggcaaaacgtgtgctgagacgggattcgcgcagccataagcagcgtgaagaagaatcggtcacctcgcttgtgcagatgagcggcgtagaagccattggtatggcccgcgacagtcgcgatacctcgcccatcctcgcgcgaaatgaagcgcaattgcactatctgaaggctattgagagtaagcagctgatattcgccacgggcgaagccgggtgcggaaaaacctggatcagcgcagcaaaagcggcagaggccctgatacataaggatgtcgacaggattatcgtcacccgtccagttctgcaagccgatgaagatcttggcttcttacctggagatatcgcagaaaagtttgctccctattttcgtccggtctacgacgtgctggtccggcgcttaggggcttcctttatgcagtactgcctgcgaccggaaatagggaaggtggaaattgcgccgttcgcctatatgcgtggacgtacctttgaaaatgcagtcgtcattcttgacgaggcgcagaatgtgactgccgcgcaaatgaaaatgtttttaacccgcctcggggagaacgtgacggttatcgtcaacggtgatatcacgcaatgcgatttgcctcgcggcgtgcgctccggattaagtgacgcgctggaacgtttcgaagaagatgaaatggtcgggatcgtccgattcggtaaagaggattgcgtacgttcggcactttgccaacgtacgctacatgcatacagttaa

SEQ ID NO: 2614 - protein, 307 aa, Escherichia coli
MRSRFSAFYPKANYGLQGSQPSDVRAHNRAANGACDEYKQLKVLSMGRQKAVIKARREAKRVLRRDSRSHKQREEESVTSLVQMSGVEAIGMARDSRDTSPILARNEAQLHYLKAIESKQLIFATGEAGCGKTWISAAKAAEALIHKDVDRIIVTRPVLQADEDLGFLPGDIAEKFAPYFRPVYDVLVRRLGASFMQYCLRPEIGKVEIAPFAYMRGRTFENAVVILDEAQNVTAAQMKMFLTRLGENVTVIVNGDITQCDLPRGVRSGLSDALERFEEDEMVGIVRFGKEDCVRSALCQRTLHAYS

SEQ ID NO: 2615 - DNA, 414 bp, Escherichia coli
atgaacaatttaattattacgacccgacaatcgccagtacgtttaatggttgattatgttgccacaaccatcttatggacattatttgctttgttcatattcttattcgcaatggatctgctgacgggttattactggcaaagcgaggccagaagccgacttcagttctattttttgctggcagtggcgaatgccgtcgtgttaattgtctgggcgctgtacaataagctacgttttcaaaaacagcagcatcatgcagcctaccaatatacgccgcaagaatatgctgagagcttagcaatacctgatgagctctatcagcaactacaaaaaagccacaggatgagcgtacacttcaccagccaggggcaaataaaaatggtggtttcagaaaaagcgctagtccgggcgtaa

SEQ ID NO: 2616 - protein, 137 aa, Escherichia coli
MNNLIITTRQSPVRLMVDYVATTILWTLFALFIFLFAMDLLTGYYWQSEARSRLQFYFLLAVANAVVLIVWALYNKLRFQKQQHHAAYQYTPQEYAESLAIPDELYQQLQKSHRMSVHFTSQGQIKMVVSEKALVRA

SEQ ID NO: 2617 - DNA, 1326 bp, Escherichia coli
atgattaatcgcatcgtatcgttttttatattatgtctggtgttatgcatccccctatgcgtagcgtactttcactctggtgaactgatgatgaggttcgttttcttctggccgttttttatgtctattatgtggattgttggcggcgtctatttctgggtctatcgtgaacgccactggccgtggggagaaaacgcaccagccccccagttgaaagataatccgtctatctccattatcattccctgttttaatgaggagaaaaacgttgaggaaaccatacacgccgctttagcacagcgttatgagaacattgaagttattgccgtaaatgacggttcaacagacaaaacccgtgccatcctggatcgcatggctgcacaaattccccacctgcgggtcattcatctggcgcaaaaccaggggaaagccattgcgcttaaaaccggagctgccgcggcgaaaagtgaatatctggtgtgcattgatggcgatgcgttattagaccgcgatgcggcggcatatattgtggaaccgatgttgtacaacccgcgtgtgggtgccgtaaccggtaatcctcgtattcgaacacgttctaccctggtgggtaaaattcaggttggcgagtattcctcaattattggtttgatcaagcgaacccagcgtatctatggaaacgtatttaccgtttccggtgttattgccgcatttcgtcgcagcgccctggcagaagtgggttactggagtgacgatatgatcaccgaagatattgatattagctggaagctgcagttgaatcagtgggcgattttttacgagccacgggcgctgtgctggatattaatgcctgaaacgttaaaagggctgtggaaacagcgcctgcgctgggctcagggcggtgcagaagtattcctcaaaaatatgacaaggttgtggcgcaaagaaaactttcgaatgtggccgctgttttttgaatactgcctgacgacaatatgggccttcacttgcctggtcggtttcattatttacgcagtccaacttgccggtgtaccgttaaatattgaattgacacatatcgctgcgacacatactgccggaatattattgtgtacgttatgtttactgcaatttattgtcagcctgatgatcgagaatcgctatgagcataatctgacttcatcgcttttctggattatttggttcccggttattttctggatgctgagtctggcaacgacattggtatcatttacacgagtcatgttgatgcctaaaaagcaacgcgcccgttgggtaagtcccgatcgcgggattctgagaggttaa

SEQ ID NO: 2618 - protein, 441 aa, Escherichia coli
MINRIVSFFILCLVLCIPLCVAYFHSGELMMRFVFFWPFFMSIMWIVGGVYFWVYRERHWPWGENAPAPQLKDNPSISIIIPCFNEEKNVEETIHAALAQRYENIEVIAVNDGSTDKTRAILDRMAAQIPHLRVIHLAQNQGKAIALKTGAAAAKSEYLVCIDGDALLDRDAAAYIVEPMLYNPRVGAVTGNPRIRTRSTLVGKIQVGEYSSIIGLIKRTQRIYGNVFTVSGVIAAFRRSALAEVGYWSDDMITEDIDISWKLQLNQWAIFYEPRALCWILMPETLKGLWKQRLRWAQGGAEVFLKNMTRLWRKENFRMWPLFFEYCLTTIWAFTCLVGFIIYAVQLAGVPLNIELTHIAATHTAGILLCTLCLLQFIVSLMIENRYEHNLTSSLFWIIWFPVIFWMLSLATTLVSFTRVMLMPKKQRARWVSPDRGILRG

SEQ ID NO: 2619 - DNA, 2019 bp, Escherichia coli
atgttacgtaatggaaataaatatatcctgatgctggtgagtataattatgctcactgcgtgcattagccagtcaagaacatcatttataccgccacaggatcgcgaatctttactcgccgagcaaccgtggccgcataatggttttgtggcgatttcatggcataacgttgaagacgaagctgccgaccagcgttttatgtcagtgcggacatcagcactgcgtgaacaatttgcctggctgcgcgagaacggttatcaaccggtcagtattgctcaaattcgtgaagcacatcgaggaggaaaaccgctaccggaaaaagcagtagtgctgacttttgatgacggctaccagagtttttatacccgcgtcttcccaattcttcaggccttccagtggcctgctgtatgggcccccgtcggcagttgggtcgatacgccagcggatgaacaagtaaaatttggcgatgagatggtcgatcgagaatattttgccacgtggcaacaagtgcgagaagttgcgcgttcccggctcgttgaggtcgcttctcatacatggaattctcactacggtattcaggctaatgccaccggcagcttattgcctgtatatgtaaatcgtgcatattttactgaccacgcacggtatgaaaccgcagcagaataccgggaaagaattcgtctggatgctgtaaaaatgacggaatacctgcgtacaaaggctaaggtaaatccacacgtttttgtttggccttatggcgaagcgaatggcatagcgatagaggaattaaaaaaactcggttatgacatgttcttcacccttgaatcaggtttggcaaatgcgtcacaattggattccattccgcgagtattaatcgccaataatccctcattaaaagagtttgcccagcaaattattaccgtacaggaaaaatcaccacaacggataatgcatatcgatcttgattacgtttatgacgaaaaccaccagcaaatggatcgcaatattgatgtgctaattcagcgggtgaaagatatgcaaatatcaaccgtgtatttgcaggcatttgctgatcccgatggtgatgggctggtcaaagaggtctggtttccaaatcgtttgctaccaatgaaagcagatatttttagtcgggttgcctggcaattacgtacccgctcaggtgtaaacatctatgcgtggatgccggtattaagctgggatttagatcccacattaacgcgagtaaaatacttaccgactggggagaaaaaagcacaaattcatcctgaacaatatcgccgtctctctcctttcgatgacagagtcagagcacaagttggcatgttatatgaagatcttgccggacatgctgcttttgatggcatattgttccacgatgatgctttgctttcagattatgaagatgccagtgcaccggctatcacggcttatcagcaagcaggctttagcgggagtctgagcgaaattcgacaaaacccggagcaatttaaacagtggacccgctttaaaagtcgtgcgttaactgacttcactttagaacttagtgcgcgcgtaaaagccattcgcggtccacatgttataactgcacgaaatatttttgcacttccggtaatacaacctgaaagtgaagcgtggtttgcacagaattatgctgatttcctaaaaagctatgactggaccgctattatggctatgccttatatggaaggtgtcgcagaaaaatcggctgaccaatggttaatacaattgaccaatcaaattaaaaacatccctcaggctaaagacaaatctattttagaattacaggcacaaaactggcagaaaaatggtcagcatcaggctatttcttcgcaacaactcgctcactggatgagcctattacaactgaatggagggaaaaactatggttattatcccgacaattttctgcataaccaacctgaaatagacgttattcgtcctgagttttcaacagcctggtatccgaaaaatgattaa

SEQ ID NO: 2620 - protein, 672 aa, Escherichia coli
MLRNGNKYILMLVSIIMLTACISQSRTSFIPPQDRESLLAEQPWPHNGFVAISWHNVEDEAADQRFMSVRTSALREQFAWLRENGYQPVSIAQIREAHRGGKPLPEKAVVLTFDDGYQSFYTRVFPILQAFQWPAVWAPVGSWVDTPADEQVKFGDEMVDREYFATWQQVREVARSRLVEVASHTWNSHYGIQANATGSLLPVYVNRAYFTDHARYETAAEYRERIRLDAVKMTEYLRTKAKVNPHVFVWPYGEANGIAIEELKKLGYDMFFTLESGLANASQLDSIPRVLIANNPSLKEFAQQIITVQEKSPQRIMHIDLDYVYDENHQQMDRNIDVLIQRVKDMQISTVYLQAFADPDGDGLVKEVWFPNRLLPMKADIFSRVAWQLRTRSGVNIYAWMPVLSWDLDPTLTRVKYLPTGEKKAQIHPEQYRRLSPFDDRVRAQVGMLYEDLAGHAAFDGILFHDDALLSDYEDASAPAITAYQQAGFSGSLSEIRQNPEQFKQWTRFKSRALTDFTLELSARVKAIRGPHVITARNIFALPVIQPESEAWFAQNYADFLKSYDWTAIMAMPYMEGVAEKSADQWLIQLTNQIKNIPQAKDKSILELQAQNWQKNGQHQAISSQQLAHWMSLLQLNGGKNYGYYPDNFLHNQPEIDVIRPEFSTAWYPKND

SEQ ID NO: 2621 - DNA, 2424 bp, Escherichia coli
atgtattcaagtagcagaaaaaggtgcccgaaaaccaaatgggctttgaaacttcttactgccgcatttttagcagcgagtcccgcggcgaagagtgctgttaataacgcctatgatgcattaattatcgaagctcgcaagggaaatactcagccagctttgttatggtttgcacaaaaatcagcactcagtaataaccaaattgctgactggttacagattgccttatgggccgggcaagataaacaggttattaccgtttacaaccgctaccgtcatcagcaattaccagcgcgtggttatgcagctgtcgccgtcgcttatcgtaacctgcaacaatggcaaaactcgcttacactgtggcaaaaggcactctctctggagtcgcaaaataaggattatcaacggggacaaattttaaccctggcagatgcgggtcactatgattctgcgctggttaaacttaagcagcttaactctggagcaccggacaaagctaatttactcgcagaagcctatatctataaactggcggggcggcatgaggatgaattacgggcgatgacagggtcattacctgaaaatgccttaacgcaacaatatcccacagaatacgtgcaggcattacggaataatcaacttgctgccgcgattgacgatgccaatttaacgccagatattcgcgctgatattcatgccgaactggtcagactgtcgtttatgcctacgcgcagtgaaagtgaacgttatgccattgccgatcgcgccctcgcccaatacgctgcattagaaattctgtggcatgataactcagaccgcactgcccagtaccagcgtattcaggttgatcatcttggcgcgttattaactcgcgatcgttataaagacgttatttctcactatcagcgtttaaaaaatacgaggcaaattattccgccctgggcgcaatattgggttgcgtcggcttatctcaaagaacagcagccaaaaaaagcacagtcaataatgacagagctcttttatcacaaggagaccattgccccggatttatccgatgaagaacttgcggatctcttttacagccacctggagagtgaaaattatcccggcgcgctaactgtcacccaacataccattaatacttcgccgcctttccttcggttaatgggcacgcctacgagcatcccgaatgatacctggttacaggggcattcgtttctctcaaccgtagcaaaatatagtaatgatcttcctcaggctgaaatgatagccagagagcttgcttataacgcaccaggaaatcagggactgcgcattgattacgcgagtgtgttacaagcccgcggttggcatcgtgcagcagaaaatgaattaaaaaaagcagaagtgatcgagccacgtaatattaatctggaggttgaacaagcatggacagcattaacgttacaagaatggcagcaggcagctgtcttaacgcacgatgttgtcgaacgtgaaccgcaagatcccggcgttgtacgtttaaaacgtgcggttgatgtacataatcttgcagagcttcgtatagctggttcaacaggaattgatgccgaaggcccggatagtggtaaacatgatgtcgacttaaccaccatcgtttattcaccaccgctgaaggataactggcgcggttttgctggattcggttatgccgatggacaatttagcgaaggaaaagggattgttcgcgactggctggcgggtgttgagtggcggtcacgtaatatctggctcgaggcggagtacgctgaacgcgttttcaatcatgagcataaacccggcgcgcgcctgtctggctggtatgattttaatgataactggcgtattggttcgcaactggaacgcctctctcaccgcgttccattacgggcaatgaaaaatggtgttacaggcaacagtgctcaggcttatgttcgctggtatcaaaatgagcggcgtaagtacggtgtctcctgggctttcactgatttttccgacagtaaccagcgtcaggaagtctcacttgagggtcaggaacgcatctggtcttcaccatatttgattgtcgatttcctacccaatctgtattacgaacaaaatacagaacacgacactccatactacaaccctataaaaacgttcgatattgttccggcatttgaggcaagtcatttgttatggcgaagctatgaaaatagctgggagcaaatcttcagcgcaggtgttggtgcctcctggcaaaaacattatggcacggatgtcgtcacccaactcggctacgggcaacgtattagctggaatgacgtgattgatgctggcgcaacgctacgctgggaaaaacgaccttatgacggtgacagagaacacaacttatacgttgaattcgatatgacattcagattttaa

SEQ ID NO: 2622 - protein, 807 aa, Escherichia coli
MYSSSRKRCPKTKWALKLLTAAFLAASPAAKSAVNNAYDALIIEARKGNTQPALLWFAQKSALSNNQIADWLQIALWAGQDKQVITVYNRYRHQQLPARGYAAVAVAYRNLQQWQNSLTLWQKALSLESQNKDYQRGQILTLADAGHYDSALVKLKQLNSGAPDKANLLAEAYIYKLAGRHEDELRAMTGSLPENALTQQYPTEYVQALRNNQLAAAIDDANLTPDIRADIHAELVRLSFMPTRSESERYAIADRALAQYAALEILWHDNSDRTAQYQRIQVDHLGALLTRDRYKDVISHYQRLKNTRQIIPPWAQYWVASAYLKEQQPKKAQSIMTELFYHKETIAPDLSDEELADLFYSHLESENYPGALTVTQHTINTSPPFLRLMGTPTSIPNDTWLQGHSFLSTVAKYSNDLPQAEMIARELAYNAPGNQGLRIDYASVLQARGWHRAAENELKKAEVIEPRNINLEVEQAWTALTLQEWQQAAVLTHDVVEREPQDPGVVRLKRAVDVHNLAELRIAGSTGIDAEGPDSGKHDVDLTTIVYSPPLKDNWRGFAGFGYADGQFSEGKGIVRDWLAGVEWRSRNIWLEAEYAERVFNHEHKPGARLSGWYDFNDNWRIGSQLERLSHRVPLRAMKNGVTGNSAQAYVRWYQNERRKYGVSWAFTDFSDSNQRQEVSLEGQERIWSSPYLIVDFLPNLYYEQNTEHDTPYYNPIKTFDIVPAFEASHLLWRSYENSWEQIFSAGVGASWQKHYGTDVVTQLGYGQRISWNDVIDAGATLRWEKRPYDGDREHNLYVEFDMTFRF

SEQ ID NO: 2623 - DNA, 1491 bp, Escherichia coli
ttgcattctgcaactatcatcatcggtattgtttgtgggtggattttcatattgacaacagtacagttcttatatctattaataataaaaagggatctacaacctacaggttggtgtagctttatggaaaaagactatttgggaattagtagtactgtattagtgagcttattgtttgggcttgcattggttttggttaatagttggttcaatcagccaaccgttgaggaagttgttccacgatcaacctatctgatggttatgattgctttattttttatcgatactgttgcatttatttttatgcagttgtatttcatttatgaccgtaggcaattttcaaactgtatacttagtttggcttttctaagttgtttgatttactttattaaaaccgtcattatcattcagcaaattattgaggggcgtttgacaagcagtgttgttcaaaatgacattgcaatctattatttgtttcgtcagatgagtttgtgcatattaatatttctggcattggtgaataaagttagtgaaaacacaaaacagcgcaatttattttccaaaaaaatgactttgtgcataagtttgttttttgttgttggggggccgatagttgctcacatactttctagtcattatgagagctacaatttacacattgccgagttaaccaatgaaaatgatcaggtggtttggaaaacatcatatgttaccataatgattttcatgtggttaaccttgctttcagttaatctatactttaatggtttacgctgtgatatctggaatggagtgacggtgattgctttttgtgccgtactgtacaatgtctctcttttatttatgagcaggtatagcgtgtccatttggtatattagtcgcactattgaagtagtcagtaagttaaccgttatggtaatatttatgtgccatatattcagtgcgctacgagtaacaaaggacattgcacatcgcgattccttaaccaatatatttaacagaaattatttttttaatgaactgacagttcaatcagcatcggccaaaaaaacgccttattgcgtcatgattatggatatcgaccacttcaaaaaagtcaacgacacctgggggcatccggttggcgatcaggtgataaaaacagtggtgagtatcattgggaaaagcatacggccagatgacctttttgcgcgcgtcggcggcgaagagtttggcgtcttgctgacggacatcgatactgaacgtgcgaaagctttagcggaaaggattcgggaaaatgttgagcgtttaactggtgataatcctgaatacgccataccacaaaaagtgacgattagtattggcgctgttgtaacgcagaaaaatgagttaaaccctaaggagatctatcaactggctgataacgcactttacgaggcgaaagagaccgggcgtaataaggtggtagtaaaagaggcagaaattcttatcaaccgcaaggatgatgaatga

SEQ ID NO: 2624 - protein, 496 aa, Escherichia coli
MHSATIIIGIVCGWIFILTTVQFLYLLIIKRDLQPTGWCSFMEKDYLGISSTVLVSLLFGLALVLVNSWFNQPTVEEVVPRSTYLMVMIALFFIDTVAFIFMQLYFIYDRRQFSNCILSLAFLSCLIYFIKTVIIIQQIIEGRLTSSVVQNDIAIYYLFRQMSLCILIFLALVNKVSENTKQRNLFSKKMTLCISLFFVVGGPIVAHILSSHYESYNLHIAELTNENDQVVWKTSYVTIMIFMWLTLLSVNLYFNGLRCDIWNGVTVIAFCAVLYNVSLLFMSRYSVSIWYISRTIEVVSKLTVMVIFMCHIFSALRVTKDIAHRDSLTNIFNRNYFFNELTVQSASAKKTPYCVMIMDIDHFKKVNDTWGHPVGDQVIKTVVSIIGKSIRPDDLFARVGGEEFGVLLTDIDTERAKALAERIRENVERLTGDNPEYAIPQKVTISIGAVVTQKNELNPKEIYQLADNALYEAKETGRNKVVVKEAEILINRKDDE

SEQ ID NO: 2625 - DNA, 1203 bp, Escherichia coli
atggcagtattgacggatacgaaagcaagacatatcaaacctgatgacaaaccattgccccatgggggaattaccggactgacccttcatccttcttcagtaaaggggcgggggaaatgggtttttcgttatgtaagtccggtgacacaaaaaagacgtaatgctggattgggaacttacccggaggtcagtattgctgaagctgcacgtactgcccggataatgcgagagcaacttgctgcaggtgatgatcctctggagattaaaaaggctgaatctgagaaagtcgttatcccaacatttgccgatgcagccaggcgtgtacatgcagaactgtctcctggatgggaaaatccaaagcatgtaaggcagtggttatcgacgcttgagaattacgcgtttcctcaactgggagcaaaaacgctggattcgattacggctgcggacgtggcagaaacactgcgtccagtctggttaaccttgtcagaaacggcaagccgggttaaacagcgcattcatgttgttatgcagtggggatgggcgcacggtttttgtgtagcaaatcctgttgatgtggttgaccatttgcttcctcagcagacaagaggacgtgatgaacaccaacccgcaatgccctggaggcagttaccgctttttgtggcgaccagtgtgtataccgatgaaccttataatgttacccgcgcactgttattaatggtgatacttacagcaactcgctcgggcgaagccaggggaatgcgctgggctgaaattgattttcataagcgggtatggactatacctgcagaaagaatgaaagctaggctacagcatcgtgttcctttatcccggcaggctatttacattctggaaaatatacgtggcctgcatgatgaactggtgttcccttcacccagaaagcagcagatcctttccgatatggtgttgacaagttttctgcgtaaaaagaaagccgtcagtgacattccggggcgagttgccacggcacatggttttcgctcaacattcagggactggtgtagcgaacaggggtattcgcgggatctggcggaaagggcgctcgctcatacgctgaaaaataaggttgaggcggcatatcatcgtactgatctactggagcagcgtgtaccgatgatgcaggcatgggcggattatgtgatgtctcaaattgtgaataaataa

SEQ ID NO: 2626 - protein, 400 aa, Escherichia coli
MAVLTDTKARHIKPDDKPLPHGGITGLTLHPSSVKGRGKWVFRYVSPVTQKRRNAGLGTYPEVSIAEAARTARIMREQLAAGDDPLEIKKAESEKVVIPTFADAARRVHAELSPGWENPKHVRQWLSTLENYAFPQLGAKTLDSITAADVAETLRPVWLTLSETASRVKQRIHVVMQWGWAHGFCVANPVDVVDHLLPQQTRGRDEHQPAMPWRQLPLFVATSVYTDEPYNVTRALLLMVILTATRSGEARGMRWAEIDFHKRVWTIPAERMKARLQHRVPLSRQAIYILENIRGLHDELVFPSPRKQQILSDMVLTSFLRKKKAVSDIPGRVATAHGFRSTFRDWCSEQGYSRDLAERALAHTLKNKVEAAYHRTDLLEQRVPMMQAWADYVMSQIVNK

SEQ ID NO: 2627 - DNA, 1818 bp, Escherichia coli
atgtataattttatcactataatgtatgatgttttttcatgttttggtgttctggctaaaaaccagaatacccgtgacatccgaaatattaaaaatttttcctcacatcaacattcactgggcgacatgtttgatgaattaataaacattattgataaagaacaagtattgagtacagaacaacgaaaagttatatttaggagatatgaagatctctatgttaagctaatgcactattctgtttttacagacaaaacacatcaaataataaaacaaaaatattttaatgacattgtaccaatgattctcgcactcgacatcaggaacacatatcgcccggataatgagatggcattttactatcatattcattcttttctcactcagataccggataatgaggatgatatatatcatgctgcaaggacatatctgcgaaattacgttaagttatgtttatctggatacacaccagcgaatgcgcatttcaaagatatctttgatggcgtatatgaattcattcgtaatattcgcaaaaacagtacaccaggaaaaacaaaacttatcgcaactatcaacacatgcaaagaaacctgtaaacatctgctttatttaagtaatgaagacaaggaaaaaataatttctgacttagataaaattcaggttgcatgttattatctcactatattactggctttcgaaagacgaacttcattaacaagcaccctggcaactttatataaaatgctgataagcgaaagagaagtttcagaatatgaatgccagttattatatttaaccaacccaatagatgtaatgaatatactgaacaaatacatatattactttcctaatgagaactcaccattttatacactgaaaattgacagtgcattatcgtgggatgccattgacgcaatacgagactatagtatttctgatatttatctttatcctgaacaaaaaacaataaattgtgtcgttgagattgaaaacattgtctttggcggttacatttatacattgaacaacggcgtcacattacaaaacatagaaaacactttaaaagattcttcatgccattatgtcttaaatggctatacagaatttgttaactgtttgagacaacttacttcaggaaagactgaaagtgttcatcgcaccatcaataaactgaactatgagaaattaccttttggatttatcattgccgcgtttgctatactaaagatagcatttaaaataaaattcagtaaaaatcatgtaaatatccgagcattattaaatgacatcaattattttatgacttatcagggcgagtccattaaccttatttcactggatcacgaatacccagagtcctgtcttcaaaatgacacaaacacatatttattaggaagagtaatatttctgtataactcaatgatttataagttcataaactgtcaggaacatgaaaccaataacattcactcagctatgataaataacctattacaggaagttgatatagcccttggtaaaataaatgacattatagacagcagaaacatatcagccccccatgaactggcaaatattcttacccgcgaaaaaatacttacaacacgggaaaaaaaaggaaacctgataagcctgtttgatggattcactttattccattgtgttggaatgataacctttcttatccattatctcagaacacctgaagaaaaagttgaaaatatatttatgttatatggtgcagataaaaacaataaactacgcagaagactgatttatgacgcactaggaataattcagtctcagcaggagtga

SEQ ID NO: 2628 - protein, 605 aa, Escherichia coli
MYNFITIMYDVFSCFGVLAKNQNTRDIRNIKNFSSHQHSLGDMFDELINIIDKEQVLSTEQRKVIFRRYEDLYVKLMHYSVFTDKTHQIIKQKYFNDIVPMILALDIRNTYRPDNEMAFYYHIHSFLTQIPDNEDDIYHAARTYLRNYVKLCLSGYTPANAHFKDIFDGVYEFIRNIRKNSTPGKTKLIATINTCKETCKHLLYLSNEDKEKIISDLDKIQVACYYLTILLAFERRTSLTSTLATLYKMLISEREVSEYECQLLYLTNPIDVMNILNKYIYYFPNENSPFYTLKIDSALSWDAIDAIRDYSISDIYLYPEQKTINCVVEIENIVFGGYIYTLNNGVTLQNIENTLKDSSCHYVLNGYTEFVNCLRQLTSGKTESVHRTINKLNYEKLPFGFIIAAFAILKIAFKIKFSKNHVNIRALLNDINYFMTYQGESINLISLDHEYPESCLQNDTNTYLLGRVIFLYNSMIYKFINCQEHETNNIHSAMINNLLQEVDIALGKINDIIDSRNISAPHELANILTREKILTTREKKGNLISLFDGFTLFHCVGMITFLIHYLRTPEEKVENIFMLYGADKNNKLRRRLIYDALGIIQSQQE

SEQ ID NO: 2629 - DNA, 165 bp, Escherichia coli
gtgctaatcctgcaaacgtgtgtatttcaactgaattacatctacgaaacccgaaaaccagacattaaagagcaaattgttgaaatggttcataacggagtcggggttcgcgatagctccagaacgctgaaggtggatatcaacaccgtcattctcactttataa

SEQ ID NO: 2630 - protein, 54 aa, Escherichia coli
MLILQTCVFQLNYIYETRKPDIKEQIVEMVHNGVGVRDSSRTLKVDINTVILTL

SEQ ID NO: 2631 - DNA, 465 bp, Escherichia coli
gtgacgcttatctgcgaacttgatgaacaatggagttttgtcgaaaacaaagctcgtcagcagtggcactggtatgcgtataacaccaaatctggaggtgtgctggcttacacttttggtcctcgcactgatgaaacatgccgtgagttgccggaattcctgaagccattctccgcaggcatgataaccagagacaaccggagcagttataccagagaaatgccacaggataagcatcttgtcggcaaggtatttacccggcgcattgagcgcaacaatctgacacttcgtactcacatcaaacgacctgcccggaaaacgatttgctttttacgctccttggaaatttacgaaaagccattggttcatttatcgaaaacacatgtactactgactggagtcattaccagggcctcttttgctgtttttttaccaatgaatgataatgagaatcgacagcgataa

SEQ ID NO: 2632 - protein, 154 aa, Escherichia coli
MTLICELDEQWSFVENKARQQWHWYAYNTKSGGVLAYTFGPRTDETCRELPEFLKPFSAGMITRDNRSSYTREMPQDKHLVGKVFTRRIERNNLTLRTHIKRPARKTICFLRSLEIYEKPLVHLSKTHVLLTGVITRASFAVFLPMNDNENRQR

SEQ ID NO: 2633 - DNA, 111 bp, Escherichia coli
ttgatctggcattttatcccccatagtgtggtgaactgtcgttacagtttgtattccccgggtaaatttgtctgcgtaaaaaaatgggctgagcaaaaagacaataaataa

SEQ ID NO: 2634 - protein, 36 aa, Escherichia coli
MIWHFIPHSVVNCRYSLYSPGKFVCVKKWAEQKDNK

SEQ ID NO: 2635 - DNA, 264 bp, Escherichia coli
tcacgcatcttacggatgcctgaactgagccaattgttaggtatatctcgttcgacaatttacgaaaaaatgaatccgttatcgaaatactacgatgcaaccttccccaggccggtacgtcttggtagtggttctgtgggctggcgttcatcagctattgacaaatggcttactttacatactgtacctgccagatcagcagtcaaaggtgttaatgacgaagtgcgacatacgctttcttcagatatgaccatgaacagataa

SEQ ID NO: 2636 - protein, 87 aa, Escherichia coli
SRILRMPELSQLLGISRSTIYEKMNPLSKYYDATFPRPVRLGSGSVGWRSSAIDKWLTLHTVPARSAVKGVNDEVRHTLSSDMTMNR

SEQ ID NO: 2637 - DNA, 1434 bp, Escherichia coli
atgtgcttacttgcaccagaaaatccttatccgatatatgcactaccaccgctggtgagaaatgcaataattgaaactcaaaaaaatacacaggcacctttggctatggtggcaacatccgcattaacagcgacctcaattgcctgtcagaatcaggttgacgtgtgcagacctggaaatttacgtgggcctgttaatctttactctctgattctggctgattccggtgaaaggaaaacgaccgtggataaagtgtttatgaaagcattttatctcagggatgaagccctggcggaagaatacgcgaaactggttgagaattacagtacagaaaaggaaatatgggagcaaaagcaaaaagcactggagtcaaaattgcataaagaaattcgcgccggtaaaggttgtaaggcaacagagtcagagcttaaaagacatctgaataaatgtcctgttccgccgcagatacgccggacaattttcaatgagacaacgatagagggaatgttaaaatattattccgacagcaatcgctcttttgctcttgtatccagtgaaggaggaataatttttgatggccgggcaatgagtaaacttggaatacttaactctttgtgggatggtggttctcttttcatcgacaggaaatcatctcccggaattattttgaaggatccaagactgacggtatcggtgatgattcagcctgatgtttaccagaaaggtttttgtacgcgaaaaaaagaacttgtgaaaacgtcaggacatcatgcaaggtttttgatgtgtcaaccaacatcaacgcaggggacaaggataataaccggagataattattcatcacagtatcaggatttgtttgaacagaggatcaatgagcttattgatgaaagtctggcgatgagtggtgaacgacgttgccttcacttttctcctcaggctgccagaatctggacggattattacaacgatgtggaatcgaagctggggggattggggcctttaagacattgccgggaatatgctgctaaaaatgcagagtatatggcaagactggcaggacttattcaccattcgagcggtgaagagggggacatttccccttacactgcagaaatggcgagagaattagcaatatggtacggtaatgagtatgtgcggttatctaatccgttaacttttgacaaccctgccctgaccgtacctgtgcgactcattccagaggagcttgaacttttcaactggataaaaagctattgcattgagaaggggatcccctgtatgaaaaaaaatgacattttacagcgtggtccgaaccgtttccggaaaaaggataaaatcaactggttactggatttactgtatgaacaaaacagagttgtaccggttattgagggaaaaacgttgtgtgtcgcacctaactttgacctctga

SEQ ID NO: 2638 - protein, 477 aa, Escherichia coli
MCLLAPENPYPIYALPPLVRNAIIETQKNTQAPLAMVATSALTATSIACQNQVDVCRPGNLRGPVNLYSLILADSGERKTTVDKVFMKAFYLRDEALAEEYAKLVENYSTEKEIWEQKQKALESKLHKEIRAGKGCKATESELKRHLNKCPVPPQIRRTIFNETTIEGMLKYYSDSNRSFALVSSEGGIIFDGRAMSKLGILNSLWDGGSLFIDRKSSPGIILKDPRLTVSVMIQPDVYQKGFCTRKKELVKTSGHHARFLMCQPTSTQGTRIITGDNYSSQYQDLFEQRINELIDESLAMSGERRCLHFSPQAARIWTDYYNDVESKLGGLGPLRHCREYAAKNAEYMARLAGLIHHSSGEEGDISPYTAEMARELAIWYGNEYVRLSNPLTFDNPALTVPVRLIPEELELFNWIKSYCIEKGIPCMKKNDILQRGPNRFRKKDKINWLLDLLYEQNRVVPVIEGKTLCVAPNFDL

SEQ ID NO: 2639 - DNA, 228 bp, Escherichia coli
gtggacgcatgctgccagttaatggctccgctgaatgatgccctgtaccgttatgtgatgaacacccgcctgggaaccatccacggcatgtcggtcggcgaactgctggcgtggatcaaagaagatgaaaaccctagcaaaggcgagatggtgctgattattgaaggccataaagcccaggatgacgaactgcccgccgatgcgctgcgtacgctggcgctgttgtag

SEQ ID NO: 2640 - protein, 75 aa, Escherichia coli
MDACCQLMAPLNDALYRYVMNTRLGTIHGMSVGELLAWIKEDENPSKGEMVLIIEGHKAQDDELPADALRTLALL

SEQ ID NO: 2641 - DNA, 96 bp, Escherichia coli
gtgccgttgaagcaagcggcggcgttggcagcagaaatccacggaatgaagaagaatgcgttgtataagtatgcgcaggaacagcagggggactaa

SEQ ID NO: 2642 - protein, 31 aa, Escherichia coli
MPLKQAAALAAEIHGMKKNALYKYAQEQQGD

SEQ ID NO: 2643 - DNA, 2001 bp, Escherichia coli
atgtacaaaacggtgaaaactacctacagattaattttggctctcagcgctactggctggagcgatccaccaaccgaatgcagtaacattacagataaggatcttacaccaatgaagaaagtgctcactctctcactactggctctgtgtgtgtctcatagtgcagtagcagcaaactatacgttcaataacgataatattgccctctcgtttgatgatacaaactcgacgattgtgctgaaggaccgtagaactaaccatccgatcacaccacaggaattgttctttctgacactaccggatgagacaaaaatccacaccgcagatttcaaaatcaagcacatcaaaaaacaggacaatgcgattgtcatcgactttacgcgcccagattttaacgtaacagtgcagttgaaccttgtgaagggaaaatatgccagcatcgactacactattgccgccgttgggcaaccacgagacgtcgccaagattaccttcttcccgaccaaaaaacagtttcaggctccttacgtagacggcgcaatcactagctcaccgatcattgcggactcgttctttatcctgccgaataaaccgatcgtgaatacctacgcctatgaagcaacaaccaatctcaacgtagaactgaaaactccaattcagccagagacgccggttagctttaccacctggttcggtactttcccggaaaccagccagttgcgacgcagtgtgaaccagtttattaatgccgtacgtccacgtccgtacaagccttatttgcattacaacagttggatggatatcggctttttcactccgtacaccgaacaggatgttctgggacgcatggacgaatggaacaaggaattcattagcggccgcggagtggcgttagacgcttttctgctggacgatggctgggacgatcttaccggacgctggttatttggcccggcattcagcaacggttttagcaaagtacgagagaaagccgatagcctgcacagctccgttgggctatggctttcaccgtgggggggttacaataagccgcgcgacgttcgcgtttcgcatgcaaaagagtatgggttcgaaaccgtggacggcaagctggcgctttcgggagcgaactactttaaaaacttcaatgagcagatcattaatcttatcaaaaatgaacacattacctcgtttaaactcgacggaatggggaacgccagttcacatataaagggtagcccgttcgcctcggattttgatgcgtcaatagctctgctgcacaatatgcgcagagcaaacccgaatctatttatcaacctgaccaccggcaccaacgccagcccgtcctggttgttctatgctgattctatctggcgtcagggggatgatataaacctgtatggccccggcacgccggtgcagcagtggataacataccgtgatgccgagacataccgctctattgtacgtaaaggcccgctgttcccgctgaactcgctgatgtaccacgggatagtcagcgccgagaatgcctattacgggttagagaaggtgcaaacggacagcgactttgccgatcaggtctggagctacttcgcgaccggcacccagctgcaggagctgtatattaccccgtccatgctgaacaaggtgaagtgggatacgctggcgaaggctgcaaaatggtcgaaggaaaatgccagcgtgctggttgatacccactggattggcggcgacccaacggcgcttgccgtgtacggctgggcatcctggagcaaagacaaagccattctcggtttgcgcaacccatcggataagccacagacctactatctggatttggcgaaggatttcgaaataccggcaggaaacgcggcgcagtttagtctgaaagcggtatacggcagcaataaaacagtgcccgttgagtataaaaacgcgacggtgattacgttgcagccgctggaaacgctggtgtttgaggcggtgcccattaactaa

SEQ ID NO: 2644 - protein, 666 aa, Escherichia coli
MYKTVKTTYRLILALSATGWSDPPTECSNITDKDLTPMKKVLTLSLLALCVSHSAVAANYTFNNDNIALSFDDTNSTIVLKDRRTNHPITPQELFFLTLPDETKIHTADFKIKHIKKQDNAIVIDFTRPDFNVTVQLNLVKGKYASIDYTIAAVGQPRDVAKITFFPTKKQFQAPYVDGAITSSPIIADSFFILPNKPIVNTYAYEATTNLNVELKTPIQPETPVSFTTWFGTFPETSQLRRSVNQFINAVRPRPYKPYLHYNSWMDIGFFTPYTEQDVLGRMDEWNKEFISGRGVALDAFLLDDGWDDLTGRWLFGPAFSNGFSKVREKADSLHSSVGLWLSPWGGYNKPRDVRVSHAKEYGFETVDGKLALSGANYFKNFNEQIINLIKNEHITSFKLDGMGNASSHIKGSPFASDFDASIALLHNMRRANPNLFINLTTGTNASPSWLFYADSIWRQGDDINLYGPGTPVQQWITYRDAETYRSIVRKGPLFPLNSLMYHGIVSAENAYYGLEKVQTDSDFADQVWSYFATGTQLQELYITPSMLNKVKWDTLAKAAKWSKENASVLVDTHWIGGDPTALAVYGWASWSKDKAILGLRNPSDKPQTYYLDLAKDFEIPAGNAAQFSLKAVYGSNKTVPVEYKNATVITLQPLETLVFEAVPIN

SEQ ID NO: 2645 - DNA, 1164 bp, Escherichia coli
atgtttgatttcgacaaaatcattgagcgtcaaagtgataagtgccgtaaatgggaccatgcctttgtttgctcgcgtttcggtgacgtcccggagtcctttatccccctgtggatagccgatatggatttcacctcaccgcctgcggtgattgacggtttccggcgcatcgtggagcacggcacctttggttatacctggtgctttgacgaattctacgacgcagtcatcgccttccagcgcaaacgtcatcaggttgaggtggaaaaatcgtggatcacgttgacctacggcacggtatccacgctgcactacacgattcaggcgtactgcaaaccgggtgacagcgtgatgatgaacacgccggtctacgatccttttgcgatggcggcacagcgccagggcgtgcaggtactggctaacccgctgcgcgtggaggaaaaccgctatcagcttgattttaatctgatagaagaacagctcaaaacctaccgtccaacgctgtggttcttctgctcgccgcataacccgtccggcaggatctggcgcgaggaagaaatacgccaggtgtccgatctctgtcaacgctacagcacgattctggtggtcgatgaggttcacgctgaacacattctggatggcaaattcgtcagttgtctcacctctggctgtgccgcccaggacaacctgatcgtgctcacatcgcccaacaaagcgttaaagctgggcgggctgaaaacctcctactccatgattccagacgactcgctgcgccagcgcttccgccagcagcttgagaagaactccattacctcgcccaatttgttcggggtatggggaatcattctggcctatcaacacggtctgccctggctcgacgcgctgaacggttatctgcaaggcaacgcccggtatctggcggatgccctccagacctacttcccggcgtggaagatgatgaccccggaatcgtcgtatctggcgtggatagacgtaagcgcggatgagagtagcgcaacgcagctaacccaacatttcgcacggcaggcaggcgtggtcatagaagacggcagccactatgtacaaaacggtgaaaactacctacagattaattttggctctcagcgctactggctggagcgatccaccaaccgaatgcagtaa

SEQ ID NO: 2646 - protein, 387 aa, Escherichia coli
MFDFDKIIERQSDKCRKWDHAFVCSRFGDVPESFIPLWIADMDFTSPPAVIDGFRRIVEHGTFGYTWCFDEFYDAVIAFQRKRHQVEVEKSWITLTYGTVSTLHYTIQAYCKPGDSVMMNTPVYDPFAMAAQRQGVQVLANPLRVEENRYQLDFNLIEEQLKTYRPTLWFFCSPHNPSGRIWREEEIRQVSDLCQRYSTILVVDEVHAEHILDGKFVSCLTSGCAAQDNLIVLTSPNKALKLGGLKTSYSMIPDDSLRQRFRQQLEKNSITSPNLFGVWGIILAYQHGLPWLDALNGYLQGNARYLADALQTYFPAWKMMTPESSYLAWIDVSADESSATQLTQHFARQAGVVIEDGSHYVQNGENYLQINFGSQRYWLERSTNRMQ

SEQ ID NO: 2647 - DNA, 96 bp, Escherichia coli
atgccgctagcactgcatctcgatcatcacgaatcgttggatgacattcgccgtaaggttcacgccggcgtacgcagcgcgatgatcgatgcttga

SEQ ID NO: 2648 - protein, 31 aa, Escherichia coli
MPLALHLDHHESLDDIRRKVHAGVRSAMIDA

SEQ ID NO: 2649 - DNA, 624 bp, Escherichia coli
gtgaaacatctgacagaaatggtgaggcagcacaaagcgggcaaaacaaatgggatttatgccgtttgttccgcacatccgctggtgctggaagctgcaatccgctacgccagtgcaaaccaaacgccgttactgattgaagcaacctccaatcaggtggaccagttcagcggttataccggaatgacgcccgccgattttcgcggctttgtttgtcagctcgccgactcgttgaatttcccgcaggatgcgctgattctgggtggtgatcatctgcgaccaaaatcgctggtcgatagcgaaacgcttatcgtggtgtacatctccagccacccttacacgcgccagtacgacctgggtctgctgacagaactgcgccgcgatcgtcaggcaatgcgcgtgatcgcaattgcggtggaaacggatgccatcatcgaagcgggcccgcatatcctgttgcctccttcccgttcgtttatcgacatggaacaggcgttctgcttcctgatgtacgcccaggtctttgcgctggctcagtcgattcatgttggcaatacgccagatctcccctctgccagcggcacgattaaccgtgtggtgcaaggtgtgattattcatccatag

SEQ ID NO: 2650 - protein, 207 aa, Escherichia coli
MKHLTEMVRQHKAGKTNGIYAVCSAHPLVLEAAIRYASANQTPLLIEATSNQVDQFSGYTGMTPADFRGFVCQLADSLNFPQDALILGGDHLRPKSLVDSETLIVVYISSHPYTRQYDLGLLTELRRDRQAMRVIAIAVETDAIIEAGPHILLPPSRSFIDMEQAFCFLMYAQVFALAQSIHVGNTPDLPSASGTINRVVQGVIIHP

SEQ ID NO: 2651 - DNA, 252 bp, Escherichia coli
atgagtaataccgacgcttcaggtgagaagcgagtgacaggcaccagcgagcgacgagaacagatcattcagcgtctgcgacagcaagggagtgtgcaggttaacgatctgtcggcattgtatggcgtatctactgtgacgatccgcaacgatctggcgtttctggaaaagcaggggatcgctgtgcgtgcctatggtggcgcgttgatctgcgatagcacgacgccgtcagtcgcaatctttttacggtga

SEQ ID NO: 2652 - protein, 83 aa, Escherichia coli
MSNTDASGEKRVTGTSERREQIIQRLRQQGSVQVNDLSALYGVSTVTIRNDLAFLEKQGIAVRAYGGALICDSTTPSVAIFLR

SEQ ID NO: 2653 - DNA, 282 bp, Escherichia coli
atgctgtttcttggtgtagatgcgatcgatctggagtgcggcatcagcacgcataatgaagatgaagcccgtttaaaccgtcggatgtgcgaagttgcggaacggatcatcgtggtcaccgattccagtaagttcaatcgttccagtttacataagatcattgatactcaacgtatcgacatgatcattgttgatgaaggcattcctgcggatagtctggaaggcctgcgaaaggctggggttgaagtgattctggtcggggagctcgcgtcttcgctgtga

SEQ ID NO: 2654 - protein, 93 aa, Escherichia coli
MLFLGVDAIDLECGISTHNEDEARLNRRMCEVAERIIVVTDSSKFNRSSLHKIIDTQRIDMIIVDEGIPADSLEGLRKAGVEVILVGELASSL

SEQ ID NO: 2655 - DNA, 501 bp, Escherichia coli
atgggcaaaaccgaccgcagcgccaacccttcgccgggcaacaaaaagggcggcctcgccaacgtggtaaagaaggcactcggctccattgctaaatcgggtaaaaccgcaattgttgaagtgctgtcgcccggtcaacacccgactaaacgcggattaatttacgccgcgacgccagccagcgattttatctgtggcacgcaacaggtggcttcgggtatcaccgtgcaagtgtttacgaccggccgtggtacgccgtacggcctgatggcggtacccgtcattaaaatggcgacccgcaccgggcaggcgaaccgctggtttgatttaatggatattaacgcgggcactatcgctaccggcgaagagaccattgaagaggtgggctggaagttgttccactttattctcgacgtcgccagcgggaagaagaaaaccttctcggatcaatggggattgcgtaaccagctggcagtgtttaacccggcaccggtggtctga

SEQ ID NO: 2656 - protein, 166 aa, Escherichia coli
MGKTDRSANPSPGNKKGGLANVVKKALGSIAKSGKTAIVEVLSPGQHPTKRGLIYAATPASDFICGTQQVASGITVQVFTTGRGTPYGLMAVPVIKMATRTGQANRWFDLMDINAGTIATGEETIEEVGWKLFHFILDVASGKKKTFSDQWGLRNQLAVFNPAPVV

SEQ ID NO: 2657 - DNA, 207 bp, Escherichia coli
gtggtgggcatgcactgcggtggcagcgacgcgttctccggcgttaccgctaaccccgctgtcggctacgcctctgacctgctggtgcgctgcggcgcaacggtgatgttctccgaagtcactgatgtacacgacgccattcatctgttaacgccgcgcgccatcaatgaagaagtgggcaggtgtctgctcgaagagatggcctga

SEQ ID NO: 2658 - protein, 68 aa, Escherichia coli
MVGMHCGGSDAFSGVTANPAVGYASDLLVRCGATVMFSEVTDVHDAIHLLTPRAINEEVGRCLLEEMA

SEQ ID NO: 2659 - DNA, 264 bp, Escherichia coli
gtgcagagcatcccggtcgacagagccagcatcgtacgcctacaggacgaacagcacgttggctttaaatcaatggtcgacgatatcctgcaggttgccgcacaccatctggaaaaactcaaccaggccagcgcgtcacctgcccggcctccgagctggtggtgggcatgcactgcggtggcagcgacgcgttctccggcgttaccgctaaccccgctgtcggctacgcctctgacctgctggtgcgctgcggcgcaacggtga

SEQ ID NO: 2660 - protein, 87 aa, Escherichia coli
MQSIPVDRASIVRLQDEQHVGFKSMVDDILQVAAHHLEKLNQASASPARPPSWWWACTAVAATRSPALPLTPLSATPLTCWCAAAQR

SEQ ID NO: 2661 - DNA, 342 bp, Escherichia coli
gtgccggagccgctgccgccgctggaagattacacctttgaaggttaccgcaacgccgacggcagcgtgggcaccaaaaacctgttgggtattaccaccagcgtgcactgcatggcagacgttgtgaactacgtggttaaaattatcgaacgcaacctgctgccgaaatacccgagcatcgacggagtggtcgacttgaaccacctctacggctgtggcgtagcgattaatgcaccgaccgccgtggtgccaattcgcaccatccataatattgcgctgaacccaaacttcggtggcgaagtgatggtggtgggtctcggttgcgaaaagctacagccatag

SEQ ID NO: 2662 - protein, 113 aa, Escherichia coli
MPEPLPPLEDYTFEGYRNADGSVGTKNLLGITTSVHCMADVVNYVVKIIERNLLPKYPSIDGVVDLNHLYGCGVAINAPTAVVPIRTIHNIALNPNFGGEVMVVGLGCEKLQP

SEQ ID NO: 2663 - DNA, 117 bp, Escherichia coli
ttgcgaacattcttcatcaactgtggcactgacccgcagatggcaaatgctcgcctggctgagcagcaacaggcatcgtattgttgctcctccatgttgttcccgcaaccagcgtaa

SEQ ID NO: 2664 - protein, 38 aa, Escherichia coli
MRTFFINCGTDPQMANARLAEQQQASYCCSSMLFPQPA

SEQ ID NO: 2665 - DNA, 570 bp, Escherichia coli
gtggattacgtcaccagttttgaactgccttttcgtctgcttttaacccggacgtcacagctgattgttacacttcgggaagcatgggatatcagccagaaaaatgtggtgttcaacgataaacggtttggctgcgtgtacagcctgaaagccagtctttctggtgtgccggatatattccggtatcatctgtctcatcgtattcgccggatggttgggagtgaaaatacatcatcgccatggcagcaaattgcccgggaagtgaaagcgccccgtgaacgactgaagtatgcgctggaaacgggattgcaggtgatcgcactgaacggcctgttttggtcagacagtcagcgtctggtggtggatattctgaggctaagcgccaacagacgtgatacaggaaatcgtccgcatccccatttaccgtcttatatcactggcgctgacactgaaagcatggtcgtcagagactctgtctggcaaccaagggagcagaggccggaggtaattgacaggagccttgcgccgggatgcgtatgttctccccggacagacagtctcagttcgtag

SEQ ID NO: 2666 - protein, 189 aa, Escherichia coli
MDYVTSFELPFRLLLTRTSQLIVTLREAWDISQKNVVFNDKRFGCVYSLKASLSGVPDIFRYHLSHRIRRMVGSENTSSPWQQIAREVKAPRERLKYALETGLQVIALNGLFWSDSQRLVVDILRLSANRRDTGNRPHPHLPSYITGADTESMVVRDSVWQPREQRPEVIDRSLAPGCVCSPRTDSLSS

SEQ ID NO: 2667 - DNA, 285 bp, Escherichia coli
ttgaattgccaaaaacaagtcagccacttattatccttttgcttatatagagaggatgatgatatgcagaatgaaataatgggttttctgagcagacataatggagggaaaaccgcagaaattgcggaggcgctggcggtaacggattatcaggcacgctattacctgttattactggaaaaagaaggtatggttcagcgctctccattaaggcgaggcatggcaacatactggtttctgaaaggagagatgcaggcgggacagagctgttcttccacaacttaa

SEQ ID NO: 2668 - protein, 94 aa, Escherichia coli
MNCQKQVSHLLSFCLYREDDDMQNEIMGFLSRHNGGKTAEIAEALAVTDYQARYYLLLLEKEGMVQRSPLRRGMATYWFLKGEMQAGQSCSSTT

SEQ ID NO: 2669 - DNA, 324 bp, Escherichia coli
cagcatgaagttattacccggggaggggatgcttttttactaaaattacgtgagagcgcgctgtcatccggctccatgtctgaagaacaattttttttactgataggtatttcttctattcacagtgacagagttattctcgctatgaaggattatctggtcagtggtcattcccgtaaagatgtctgcgagaaataccagatgaataatggatatttcagtacaacgcttgggcgccttaccaggttgaatgtcctcgttgccagacttgctccttattatactgatagtgtatcagctatagctgaaactgcttccctgtaa

SEQ ID NO: 2670 - protein, 107 aa, Escherichia coli
QHEVITRGGDAFLLKLRESALSSGSMSEEQFFLLIGISSIHSDRVILAMKDYLVSGHSRKDVCEKYQMNNGYFSTTLGRLTRLNVLVARLAPYYTDSVSAIAETASL

SEQ ID NO: 2671 - DNA, 93 bp, Escherichia coli
gtgttgcgacaagtgcgtctgccgcacctgctactgtcaatggtggcactgttcattttaagggggaagtggttaatgctgcatgtgctgtaa

SEQ ID NO: 2672 - protein, 30 aa, Escherichia coli
MLRQVRLPHLLLSMVALFILRGKWLMLHVL

SEQ ID NO: 2673 - DNA, 447 bp, Escherichia coli
atgcgcttccagggaaaaataattgctgaagcatgcagtcttgccctgtcagacaggcagatgactgtggatatggggcaactcagcagcaatcgatttcacgccgccggtgagtatggggaccctgtgggctttgatattcaccttcaggactgcagcactgtcgtcagtcagcgggtggggatttccttttatggcgtatcagatattcacgaaccggagttgctgtcggtggaagaggagaatgatgcctcagacggaatcgctatcgctttatttaatgaaagcggagagctggtaaaacttaatcagcctccggagaactgggtgcatcttacccgcggagatatgaaactgcatatgcaggcgaggtataaggccacacattatcccgtcaccgggggaaaggcaaatggacaggtatggttttctctgacctatctgtaa

SEQ ID NO: 2674 - protein, 148 aa, Escherichia coli
MRFQGKIIAEACSLALSDRQMTVDMGQLSSNRFHAAGEYGDPVGFDIHLQDCSTVVSQRVGISFYGVSDIHEPELLSVEEENDASDGIAIALFNESGELVKLNQPPENWVHLTRGDMKLHMQARYKATHYPVTGGKANGQVWFSLTYL

SEQ ID NO: 2675 - DNA, 696 bp, Escherichia coli
atgatgaagcacatgcgtatatgggccgttctggcatcatttttagtctttttttatattccgcagagctatgccggggttgctctgggtgccacccgtgtgatttaccctgaagggcaaaaacaggtacaactggcggtaacaaataatgatgataaaagtagttaccttattcaatcatggattgaaaatgttgaaggaaaaaaggatgccaggtttgtaattactcctccgttattttccatgcagggaaagaaagagaataccctgagaattattgatgccacaaacggacagatgccggaagacagggaaagtttgttctgggtgaatgtcaaggccatcccggccatggataaggcgaaaaccggcgagaattatctgcagtttgcaattgtcagcagaattaaactgctctaccgtccacagggactggttattccgccagaacaggcaccaggtaaattagagttcacccgtgaaaacggagggctgactctgtttaatccgacgccgtattatctgacagtgactgacttaaaggccggaaataaaagtcttgaaaacaccatggtacccccacagggaaaggtcactgttaatatccctggaggatacaccggaggagatattacttataaaacaattaacgattatggtgctctgactgaacaggtgaggggtgtggtgaagtaa

SEQ ID NO: 2676 - protein, 231 aa, Escherichia coli
MMKHMRIWAVLASFLVFFYIPQSYAGVALGATRVIYPEGQKQVQLAVTNNDDKSSYLIQSWIENVEGKKDARFVITPPLFSMQGKKENTLRIIDATNGQMPEDRESLFWVNVKAIPAMDKAKTGENYLQFAIVSRIKLLYRPQGLVIPPEQAPGKLEFTRENGGLTLFNPTPYYLTVTDLKAGNKSLENTMVPPQGKVTVNIPGGYTGGDITYKTINDYGALTEQVRGVVK

SEQ ID NO: 2677 - DNA, 2631 bp, Escherichia coli
atgttttccggagatggcggacaactcctgtctgataaatcactgaccggctctgctggcgggggtaataacagaatgaaatttaatatactgccgctggcattttttatcgggataattgtttctccggcccgggctgagctctattttaacccgcgttttctgtctgatgacccggatgcggttgcggacctgtctgcatttacacaggggcaggagcttccgcccggtgtgtaccgggtggatatttatctgaatgatacgtatatctcaacccgtgacgtgcagtttcagatgagtcaggacgggaagcaacttgccccctgcctgagtccggagcatatgagtgcgatgggggtaaaccgttatgccgtgccgggtatggagagactgccggctgacacctgcacatcactgaattccatgattcagggtgccacattccggtttgatgtcgggcagcagcgattgtacctgaccgttcctcagttatatatgagtaatcaggcccgtggttatattgcgccggaatactgggataacggaattacagcggcattgctgaattatgacttcagtggtaatcgggtgcgcgacagctatggtggcaccagcgattatgcctatctgaatctgaaaacaggactgaatatcgggagctggcgtcttcgggacaacaccagctggagttacagtgccggaaaggggtacagccagaataactggcagcacattaacacctggctggagcgggatatagttcccctgcgctcccgtctgacgatgggggacagttatacccggggggatatttttgacggtgtaaatttcaggggtattcaactggcctctgatgacaatatggttccggacagccagagagggtatgcaccgacaattcacggtatttcccggggaacatcccggattagtatccgccagaacgggtatgaaatttaccagagtacgctacctccaggcccgttcgagataaacgatatttatccggccgggagtggaggtgacttacaggtaaccctgcaggaagctgatggcagtgtacagcgatttaatgtgccatggtcttcggtgcctgtactgcaacgtgaagggcatctgaaatatgctctcagtgccggagagtttcgcagtggcggacatcagcaggataatccccgttttgctgaaggaacgctgaagtatggtctgccggcaggctggacggtgtatggaggagcctggatagctgaacgctaccgtgccttcaatctggggatgggtaaaaacatgggctggctgggcgctgtttcactggatgccacccgtgcgaatgcccggttaccggatgaaagccggcatgacggtcagtcatatcgttttctgtataacaagtcactgacggaaacagggacaaatatccagttaatcggataccgctactccacacggggctatttcagctttgctgataccgcctggaagaaaatgagtggttacagtgttcttacccaggacggagtgatacagatacagccgaagtatacggattactacaatctggcttacaacaagcggggaagggtgcaggtgagtatcagccagcagacgggggaatcgtcaacgttgtatctgagtggcagccaccagagttactggggaacggacaggacggaccgtcagcttaatgctggctttaactcatctgtgaatgacatcagctggtccctaaactacagcctgtcccggaatgcatggcaacatgaaactgaccggatactgtcatttgatgtcagcattccgttcagccactggatgcgttcggacagcacatctgcatggagaaacgccagtgcccgttacagtcagaccctggaggctcacggacaggctgccagtacagcagggctgtatggcacatcgctgggggacaataatctgggatacagcatccagagtggttatacccggggagggtatgaggggagcagtaaaacaggatatgcctctctgaattacagagggggatacggtaatgccagtgcaggatacagtcacagtgggggttaccggcaactgtattatgggctgagtggcggtattctggcacatgccaatggtctgacactgagccagcctctgggagatacgctgattcttgtccgtgcaccaggtgcatctgatacgcgcattgaaaaccagacgggggtgtctacagactggagggggtatgctgtactgccttatgcaacagactatcgtgaaaaccgggtggcactggataccaacacccttgcagataatgttgatatagagaataccgtggtcagcgtcgtgcccacgcatggtgccgttgtgcgggctgactataaaacccgtgtgggtgtgaaagtgctgatgacgctgatgagaaacgggaaagcagttccttttggctctgtcgttacggccagaaatggggggagcagtatcgccggagagaatggtcaggtttatctgagcggaatgcctctgtcaggacaggttagtgtgaaatgggggagtcagaccacggaccagtgtactgcagattataaattaccgaaggaaagcgccggacagatattaagtcatgtcacggttagttgcaggtaa

SEQ ID NO: 2678 - protein, 876 aa, Escherichia coli
MFSGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVPLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGMGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTSLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTVSCR

SEQ ID NO: 2679 - DNA, 528 bp, Escherichia coli
atggtgaaggatattattaaaacagtgacattctcctgcatgctggccggcagtatgttcgttacctgtcatgtctgtgcagcgggttctgtggtgaatattacaggcaatgttcaggataacacctgcgatgttgacattaactcccgaaactttgatgtcagtctgggaagttatgacagccgacagtttaccgcagctggtgatatcacacctgcgtcggtatttcatgtcgggttaacctcctgcggcagtgctgtccgtgcagtgaagctgacatttacgggcacaccagataatcaggaggcggggcttattcagattaacagcataaatggagcacggggtgtggggattcagcttcttgataaggataaacatgagctgaaaattaatgtgccgacaacaattgcgttaatgccgggaacacagaccatagcgttttatgcccgtctgaaagccacttatcttccggtaaaggccggtaatgttgatgcggtggttaattttgtacttgactatcagtaa

SEQ ID NO: 2680 - protein, 175 aa, Escherichia coli
MVKDIIKTVTFSCMLAGSMFVTCHVCAAGSVVNITGNVQDNTCDVDINSRNFDVSLGSYDSRQFTAAGDITPASVFHVGLTSCGSAVRAVKLTFTGTPDNQEAGLIQINSINGARGVGIQLLDKDKHELKINVPTTIALMPGTQTIAFYARLKATYLPVKAGNVDAVVNFVLDYQ

SEQ ID NO: 2681 - DNA, 420 bp, Escherichia coli
acgacgattactgtgacgggtaatgttttgcaaagaacatgtaatgtaccagggaatgtggatgtttctttgggtaatctgtatgtatcagactttcccaatgcaggaagtggatctccatgggttaattttgatctgtctctcaccggatgccagaatatgaatactgttcgggcaacatttagtggtactgcggatgggcagacatactatgcgaatacagggaatgctggcggtatcaagattgaaattcaggacagggatggaagtaatgcatcatatcacaatggtatgttcaagacgcttaatgtacaaaataataatgcaacctttaatcttaaagcccgtgcagtgagtaaaggccaggttactcctggaaatatcagttctgttataaccgtcacctatacctatgcgtaa

SEQ ID NO: 2682 - protein, 139 aa, Escherichia coli
TTITVTGNVLQRTCNVPGNVDVSLGNLYVSDFPNAGSGSPWVNFDLSLTGCQNMNTVRATFSGTADGQTYYANTGNAGGIKIEIQDRDGSNASYHNGMFKTLNVQNNNATFNLKARAVSKGQVTPGNISSVITVTYTYA

SEQ ID NO: 2683 - DNA, 969 bp, Escherichia coli
atgcgtaaatattatcccctctttaagaaaagcaccgtccttaagggcggtgttttattcacacttataatggcatattcccagccatcgtttgcactgttgtgcagaaataaccagaccgggcaagtatttaactccggggatacatcctttcgggttaatgtcagtcctgttgtgcaatatgataaatccatatctgtattggacctttcccaactggtatcatgtcagaatgaggactcgacaggccaaaactatgattatctgaaaatattgaaaggcagtggtttttctcctgctctggataccaaaacatacggacgactcgattttacaagtcgtccaacggggtatgccaggcaattaccacttcagtttgatttgcaggtgacagaggcgttttatcaatatggtgtctggaaaccattccctgctaaattatatctgtaccctgcaccgggtgtatttgggaaggtaattaacaacggagatttactggcaacgttatatgtgaataagttttccacaaaggggcaggaggcaggggagagaaatttcacctggcgtttctatgcaacgaatgatgtccatatccagacaggtacatgcagggtctcatcgaacaatgtcaaagttgaccttccgtcctatcccggagggccggtaacagtccctcttactgtacgttgcgaccagacacagtcggtcagctataccctgtcaggtcctgtaacaggaagtggtaatactgtattcgcaaatacggcagcatcagggtctggcggtgtgggtatacagttgtcggataacgtggggccggttccggccggacaaccgaggtctctgggacaggtaggcagctctcctgtgagtctggggctgaaggcctcttatgctctgaccggtcaggcaagtccgacgcccggtgctgtccagtcagtgataaatgtgacttttagctacaactag

SEQ ID NO: 2684 - protein, 322 aa, Escherichia coli
MRKYYPLFKKSTVLKGGVLFTLIMAYSQPSFALLCRNNQTGQVFNSGDTSFRVNVSPVVQYDKSISVLDLSQLVSCQNEDSTGQNYDYLKILKGSGFSPALDTKTYGRLDFTSRPTGYARQLPLQFDLQVTEAFYQYGVWKPFPAKLYLYPAPGVFGKVINNGDLLATLYVNKFSTKGQEAGERNFTWRFYATNDVHIQTGTCRVSSNNVKVDLPSYPGGPVTVPLTVRCDQTQSVSYTLSGPVTGSGNTVFANTAASGSGGVGIQLSDNVGPVPAGQPRSLGQVGSSPVSLGLKASYALTGQASPTPGAVQSVINVTFSYN

SEQ ID NO: 2685 - DNA, 741 bp, Escherichia coli
atgtcaggggcagttaacagtatactggaggtgaaatcaggcagaacagaatatatcctctcaccggtttttgagcctgtatgggatcagaccgggaaaatatttgcttttgaaatgctctcggatatccgttcagcaaaagacgggaggaaaatctgcgcatctgtttttttcagaagtgcgtctccggatattcagtacaaaatactcatcagtcagttgaagactgcggaaacgcttcataaatggtgtctgcagaagaaaataatgctgagtgtcaatatttcccgggtggtagccctgtatctgagaaaacatggcatcccggggcggccgggaacacatatcaggcttgaggtcagtgaggactttccggcagtggcgttaaaacccggtgatgaccccctgttacgttttttgtcagaacgtttcaccctctggctggatgatttcggctcaggaaatgcaggcttaatgtggggactgtccgggatgtttgaacgggtaaaaataagtcatgagttttttcattatgccctgaaaaacaggtgtgcaatgccgcttctccatgctgtggcagacactgttgcctgttataaccggggcgtgatacttgaaggtgttgaaaatgaagcgttgttccgtattgccagagacatgaatgtccagggctgtcagggatggctctacaggcgtgtggaagctgatgaattatccgcgattattgagctgcatggataa

SEQ ID NO: 2686 - protein, 246 aa, Escherichia coli
MSGAVNSILEVKSGRTEYILSPVFEPVWDQTGKIFAFEMLSDIRSAKDGRKICASVFFRSASPDIQYKILISQLKTAETLHKWCLQKKIMLSVNISRVVALYLRKHGIPGRPGTHIRLEVSEDFPAVALKPGDDPLLRFLSERFTLWLDDFGSGNAGLMWGLSGMFERVKISHEFFHYALKNRCAMPLLHAVADTVACYNRGVILEGVENEALFRIARDMNVQGCQGWLYRRVEADELSAIIELHG

SEQ ID NO: 2687 - DNA, 348 bp, Escherichia coli
ataaatcactcagtgtacatggttctcaccacattattcacagcggagagtcattgtctgtcaccttcagagataagccagaaactgcagtttaccagaactaatattacccgcattacagattttttagaaaaaaccggatatgtaaaaaggacggatagcagggaggatcgccgtgctaaaaaaatcagtctgacatctgaaggtatgttttttattcagaggctcactcttgcacaaagcatgtatctgaaagaaatctggggttatctgacccatgatgaacaggaactgtttgaagtcattaataaaaaattactggcgcatcttgatgatgtcagctcataa

SEQ ID NO: 2688 - protein, 115 aa, Escherichia coli
INHSVYMVLTTLFTAESHCLSPSEISQKLQFTRTNITRITDFLEKTGYVKRTDSREDRRAKKISLTSEGMFFIQRLTLAQSMYLKEIWGYLTHDEQELFEVINKKLLAHLDDVSS

SEQ ID NO: 2689 - DNA, 108 bp, Escherichia coli
gtgacaaaattcccgatgatcgacaagcgcaccgattttccagtggcaacatcagtacaaaagatgaacggtactgactttgccggaatgagtcaaaaagaaagctga

SEQ ID NO: 2690 - protein, 35 aa, Escherichia coli
MTKFPMIDKRTDFPVATSVQKMNGTDFAGMSQKES

SEQ ID NO: 2691 - DNA, 2178 bp, Escherichia coli
atgagaattaacaaaatcctctggtcgctaactgtgctcctggttgggttgaatagccagatatcagtagccaaatactccgacgatgataatgacgagactctggtggtggaagccaccgctgagcaggtattaaaacagcagccgggcgtgtcggttattaccagcgaggatattaaaaagacccctccggtaaacgacctttcagatattattcgtaaaatgcctggtgtcaatcttaccggcaatagcgcctcgggcacacgcggtaataaccgccagatcgatattcgaggtatggggccggaaaacaccttaattttaattgatggtgtaccggtgacgtcacgtaactccgtgcgttatagctggcgtggggagcgtgatacccgcggtgacaccaactgggtgccaccggaacaggttgagcgtattgaagtgatccgcggccctgcggcggcgcgctacggttcgggggccgccgggggggtggtgaacatcattaccaaacgtcccaccaacgactggcacggttcgctgtcgttatacaccaaccagccggaaagtagcgaagagggcgctacgcgtcgcgccaatttcagccttagtgggcctctggctggtgatgctcttaccacgcgtttgtatggtaacctgaataaaacggatgctgacagttgggatattaattctccggtcggtacgaaaaacgcagccgggcatgaaggggtacgtaacaaagatattaacggcgttatctcgtggaaattaaatccgcagcagattctcgatttcgaagccggatatagccgccaggggaatatctatgcgggcgatacgcagaacagttcttccagtgcagttaccgaaagcctggcaaaatccggcaaagagacgaaccgcctgtaccgacagaattatggcattacgcataatggtatctgggactggggacaaagtcgctttggtgtttattacgagaaaaccaataatacccgcatgaatgaaggattatccggcggtggtgaaggacgtattttagcgggtgaaaagtttacgaccaatcgcctgagttcctggcgaaccagcggtgagcttaatattcctttgaatgtgatggttgatcaaacgctgaccgttggtgcagagtggaaccgcgataagctcgatgatccttcctctaccagcctgacggtgaatgacagagatatcagcggtatttctggttctgctgcggatcgcagcagtaaaaatcattctcaaatcagtgcgctgtatattgaagataacattgagccggttcctggcacgaatatcattcccggcctgcgctttgattatctcagcgactccggcgggaacttcagccccagtctgaatctttcgcaggaattgggcgattatttcaaagtcaaagcaggggttgcccgaacctttaaagccccaaacctgtatcaatccagtgaaggctatctgctctactcgaaaggcaatggctgtccaaaagatattacatcaggcgggtgctacctgatcggtaataaagatctcgatccggaaatcagcgtcaataaagaaattggactggagttcacctgggaagattaccacgcaagtgtgacctacttccgcaatgattaccagaataagatcgtggccggggataacgttatcgggcaaaccgcttcaggcgcatatatcctcaagtggcagaatggcgggaaagctctggtggacggtatcgaagccagtatgtctttcccgctggtgaaagatcgtctgaactggaataccaatgccacatggatgatcacttcggagcaaaaagacaccggtaatcctctgtcggtcatcccgaaatatactatcaataactcgcttaactggaccatcacccaggcgttttctgccagcgtcaactggacgttatatggcagacaaaaaccgcgtactcatgcggaaacccgcagtgaagatactggcggtctgtcaggtaaagagctgggcgcttattcactggtggggacgaacttcaattacgatattaataaaaatctgcgtcttaatgtcggcgtcagtaatatcctcaataaacagatcttccgatcttctgaaggggcgaatacctataacgagccaggccgggcttattatgccggagttaccgcatcattctga

SEQ ID NO: 2692 - protein, 725 aa, Escherichia coli
MRINKILWSLTVLLVGLNSQISVAKYSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSEEGATRRANFSLSGPLAGDALTTRLYGNLNKTDADSWDINSPVGTKNAAGHEGVRNKDINGVISWKLNPQQILDFEAGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 2693 - DNA, 957 bp, Escherichia coli
atgtatgcccgcgagtatcgctcaacacgcccgtataaagcgattttctttcatctttcttgcctcacccttatctgtagtgcgcaagtttatgcgaagccggatatgcggccactggggccgaatatagccgataaaggctccgtgttttaccatttcagcgtcacctctttcgactctgtcgatggcacacgccattatcgggtatggacggccgtgccgaatacaaccgcaccggcatcgggttacccgattttatatatgcttgacggtaacgcagttatggaccgcctggatgacgaactgctcaaacaattatcagaaaaaacaccgccagtgatcgtggctgtcgggtatcagaccaacctccctttcgatctcaacagcagggcttacgactatacgccagcagcagaaagcagaaaaacagatctccactcagggcgttttagccgtaagagtggtggcagcaacaacttccgccagttactggaaacgcgtattgccccaaaagtggaacagggactgaatatcgatcggcaacgccgcggcttatgggggcactcctacggcggcctcttcgtgctggattcctggctgtcctcctcttacttccggtcgtactacagcgccagcccgtcgttgggcagaggttatgatgctttgctaagccgcgttacggcggttgagcctctgcaattctgcgccaaacacctggcgataatggaaggctcggcgacacagggtgataaccgggaaacgcatgctgtcggggtgctgtcgaaaattcataccaccctcactatactgaaagataaaggcgtcaatgccatattatgggatttccccaacctgggacacgggccgatgttcaatgcctcctttcgccaggcactgttagatatcagtggtgaaaacgcaaattacacagcaggttgtcatgagttaagccactaa

SEQ ID NO: 2694 - protein, 318 aa, Escherichia coli
MYAREYRSTRPYKAIFFHLSCLTLICSAQVYAKPDMRPLGPNIADKGSVFYHFSVTSFDSVDGTRHYRVWTAVPNTTAPASGYPILYMLDGNAVMDRLDDELLKQLSEKTPPVIVAVGYQTNLPFDLNSRAYDYTPAAESRKTDLHSGRFSRKSGGSNNFRQLLETRIAPKVEQGLNIDRQRRGLWGHSYGGLFVLDSWLSSSYFRSYYSASPSLGRGYDALLSRVTAVEPLQFCAKHLAIMEGSATQGDNRETHAVGVLSKIHTTLTILKDKGVNAILWDFPNLGHGPMFNASFRQALLDISGENANYTAGCHELSH

SEQ ID NO: 2695 - DNA, 1230 bp, Escherichia coli
atgctgaacatgcaacaacatccctctgctatcgccagcctgcgcaaccaactggcagcgggccacattgctaaccttactgacttctggcgcgaagctgagtcgctgaatgttcctcttgtgacgccagtcgaaggagcggaagatgagcgagaagtgacctttctgtggcgcgcccgacatcctctgcagggcgtttatctgcgtctgaaccgggtgacggataaagagcacgtagaaaaaggaatgatgagcgcccttcccgaaacggatatctggacactgacactgcgtttacccgcaagttactgcggctcctattcgctgctggaaatcccccccggcactacggctgagacgattgcactgtccggaggccgttttgccaccctcgccggaaaggccgatccgctaaacaaaatgccggagatcaacgttcggggaaacgcaaaggaatcagtgctgacacttgataaagctcccgccctgtcggaatggaacggcggcttccacaccggacaactgcttacctccatgcgcattatcgccgggaaatctcgccaggttcggctctatattccggacattgatatttctcagcccctcgggctggtcgtgctgcccgatggtgaaacctggtttgatcaccttggcgtatgcgcggcaattgacgccgccataaataacaggcgcatcgtgcccgtggctgtactgggcattgacaacattaatgaacatgaacgcactgagatactcggcgggcgcagcaagctgataaaggatatcgcaggacatctgctgccgatgatccgcgctgaacaaccgcagcgtcagtgggcagaccgttcgcgcacagtgctggccgggcagagcctcggcgggatcagtgcgctaatgggggctcgttacgcaccggaaacgttcggtctggtgctcagccactctccttcaatgtggtggacgccagaaagaaccagtcgaccaggcttgttcagcgaaaccgatacctcatgggtgagtgagcatctgctttctgccccaccgcagggcgtgcgtatcagcctgtgcgtgggatcgctggaaggttcgacagtgcctcacgttcagcaacttcaccagcggctgattaccgctggcgtcgaaagccattgcgcaatctacaccggtggtcacgattacgcatggtggcgcggtgcactgattgacgggattggtttactacagggttga

SEQ ID NO: 2696 - protein, 409 aa, Escherichia coli
MLNMQQHPSAIASLRNQLAAGHIANLTDFWREAESLNVPLVTPVEGAEDEREVTFLWRARHPLQGVYLRLNRVTDKEHVEKGMMSALPETDIWTLTLRLPASYCGSYSLLEIPPGTTAETIALSGGRFATLAGKADPLNKMPEINVRGNAKESVLTLDKAPALSEWNGGFHTGQLLTSMRIIAGKSRQVRLYIPDIDISQPLGLVVLPDGETWFDHLGVCAAIDAAINNRRIVPVAVLGIDNINEHERTEILGGRSKLIKDIAGHLLPMIRAEQPQRQWADRSRTVLAGQSLGGISALMGARYAPETFGLVLSHSPSMWWTPERTSRPGLFSETDTSWVSEHLLSAPPQGVRISLCVGSLEGSTVPHVQQLHQRLITAGVESHCAIYTGGHDYAWWRGALIDGIGLLQG

SEQ ID NO: 2697 - DNA, 3660 bp, Escherichia coli
atgcctgcgaatcacactcccacaccggctcagtcatggatagttcgcctggcgcgcgtgtgctgggaacgtaagaaacttagtgtcatcgtggtggtagcgtcagtatcgactattttgctggctgcgctgacgccactgctgacaagacaggctgtgaatgacgcactggcgggcaatccggcccgcctgccgtggctggcctgcgggttactgttgatcgctttttttgatttcatcggtaactatgtgcgccgtggttatgccgggatgctctcactctgggtgcagcataccctcagaggacgggtattcgacagtattcagaaacttgacggcgcaggccaggatgcgctgcgcaccgggcaggtgatttcacggaccaacagcgatctgcagcaggtgcataccctgctgcagatgtgcccggtgccgctggcagtgttcacttattacattgccggcattgccgtgatgctgtggatgtcccctgccatgacgcttatcgtcgtgtgcgtactggtatgcctggcgatcaccgcgcttcgtgcgcgtcgtagggtcttcgcgcaaaccgggctggcctcggaccaactggcgaatctcaccgaacatatacgcgaggtgctggcacagatctcagtggtaaaatcctgtgtggcagagatgcgtgaaacgcactggctcgataggcagtcgcggcagattgtgcgtgtacgcatcggtgcggttatctcgcaggcgatgcctggggccaccatgctggcgctaccggtgctcgggcaaatcgtcctgctgtgctacggcgggtggtcggtcatgcacgggcggatcgatctcggtaccttcgttgcattcgccagcttcctcgcgatgctgaccgggccaacccgcgtactggcatcgtttctggttatcgcacagcgcactcaggcgtccgtggagcgggtgtttgcactgatcgacacccgttcacagatggaggacgggacggagtcgattaacagtcaggttgtcggactggaactggagaatatgagctttgactaccaccatggcgacagacatatcctcagcaatatctccttttccctgcgcgccggtgaaaccgtggcggtggtgggcgcatcgggttcaggaaaatcgaccctgttgatgctactggcgcgtttttatgatccctgctccggaaagatatggctcaacaccagcgaaggccgacaaaatcttcgcgatatcagactggaggcgcttcgtcgccgggtaggcatcgtatttgaagatgcttttctgtttgccggtacggtggcggaaaatatcgcctatggccaccctcaggcaacggcggacgacattcgccgtgcggcagctgctgcaggagccagcgattttattaacgccctgccgaaaggcttcgatagcctgttaaccgaacggggtacgaatctttccggcgggcagaggcagcgaatagcgctggcgcgggcgctcattactgcaccggacgtgttaatcctggatgatactacctcagcggttgatgctgttacggaagcggagattaataccgcgctgggtcgctatgctgacgaagggcatatgctgctggtgattgcccgacggcgttcaacacttcagctagccagccgggttgtggtgctggataagggccgtatggtggataccggaaccccggcagaacttgaagcgcgctgtccggcgttccgcgcactgatgaccggcgacagcgattttctggccacgtcccacaatagccacaacgaattgtggccggctgaaccagcgacacaagacgatgtaacggatacgggggataaaggttttgtcgcccgtatgacccgcgtaccggaaaatgcagtacagcaggcgctggccggtaaaggtcgcaaagtcacgtcactactgaagcctgtggcgtggatgttcgtcatcgccgctctgctgatcgcactcgattctgcggcaggcgtaggggtactgatactgttgcagcacggcattgactccggtgtcgccgcaggcgatatgtcgatcatcggcctctgtgccctgctcgccctgtgcctggtcattgtgggctggtgcagttattctctgcagacggtcttcgccgccagagcggcggaatcagttcagcattcggtgcgcttgcgcagcttcggccatatgctgcgtcttggactcccctggcatgaaaagcatgccgattcgcgtcttacccgcatgaccgttgatgtggactctctcgcccgctttctgcaaaacggccttgccggtgcggccaccagtctggtgacgatgttcgcaatcgccgccaccatgttctggctcgacccgttcctggcgctgacggcattaagcgcagtgccagtggccgcactggcaaccatgatttatcgccgcctcagtacccctgcttatgcacaggcacggctggaaataggcaaagtcaacagcaccctgcaggaaaaagtctctggcctgcgtgtcgtgcaatcgcatggtcagcaggaactggagggcgcccggctgcgcgcgttatcggagcgtttccgcgcaacccgtgtgcgagcacaaaaataccttgcagtctattttccgttcctgacattctgcaccgaggcctcctatgccgctgttctgttagtgggagcttcgcaggtcgccgctggagaaatgactgccggggtactggcggctttcttcctgttgctggggcaattctatgggccagtgcagcagttatcagggattgtcgacgcctggcagcaggcgacagccagcggcaaacatattgatgaactactggcgacagaaggcactgagaacctcgggtcctcttcggtcctccctgtcaccggtgcactgcatcttgatgaggtcacgttcagttatcccgacagtcacgagccagctctgaacaaacttaccctgacgatcccagagggaatggttgtcgcggtcgtcggtcgcagcggtgcgggtaagtcgacgctgattaagctgattgccgggttgtatttccccacgcacggcaacatcagaatcggtgtgcaaatgctcgatgatgcctcgctcactgagtatcgtcgccagattgggcttgtcgatcaggatgtagcactgtttagtagtgatattgcagaaaacattcgttattcacggccatccgccaccaatgaagacgttgaaattgcctcacagcgggcagggctgtatgagatggtgtgcaatctgccgcagggattccggacaccggtgaataacggcggagccgatctgtccgcaggtcagcgccagttgattgcgctggcccgcgcgcaactggcgaatgctcacatcctgctgctcgacgaagccacgtcatgtctggatcgcacatccgaagaacgactgatgtcatcgttaacagatgtcgtgcatgccgggaagcactcggcgctgattgttgcacatcgtctgaccaccgcgcaacgctgcgatctgattgccgttattgataaggggttacttgcggaatacggaacccacgaacagctgttatctgcaggcggcctctatacccgcttatggcatgacagcgtcagcagtactgcgctccatcgccagcacaacatgaaggaggaaaccccgggatag

SEQ ID NO: 2698 - protein, 1219 aa, Escherichia coli
MPANHTPTPAQSWIVRLARVCWERKKLSVIVVVASVSTILLAALTPLLTRQAVNDALAGNPARLPWLACGLLLIAFFDFIGNYVRRGYAGMLSLWVQHTLRGRVFDSIQKLDGAGQDALRTGQVISRTNSDLQQVHTLLQMCPVPLAVFTYYIAGIAVMLWMSPAMTLIVVCVLVCLAITALRARRRVFAQTGLASDQLANLTEHIREVLAQISVVKSCVAEMRETHWLDRQSRQIVRVRIGAVISQAMPGATMLALPVLGQIVLLCYGGWSVMHGRIDLGTFVAFASFLAMLTGPTRVLASFLVIAQRTQASVERVFALIDTRSQMEDGTESINSQVVGLELENMSFDYHHGDRHILSNISFSLRAGETVAVVGASGSGKSTLLMLLARFYDPCSGKIWLNTSEGRQNLRDIRLEALRRRVGIVFEDAFLFAGTVAENIAYGHPQATADDIRRAAAAAGASDFINALPKGFDSLLTERGTNLSGGQRQRIALARALITAPDVLILDDTTSAVDAVTEAEINTALGRYADEGHMLLVIARRRSTLQLASRVVVLDKGRMVDTGTPAELEARCPAFRALMTGDSDFLATSHNSHNELWPAEPATQDDVTDTGDKGFVARMTRVPENAVQQALAGKGRKVTSLLKPVAWMFVIAALLIALDSAAGVGVLILLQHGIDSGVAAGDMSIIGLCALLALCLVIVGWCSYSLQTVFAARAAESVQHSVRLRSFGHMLRLGLPWHEKHADSRLTRMTVDVDSLARFLQNGLAGAATSLVTMFAIAATMFWLDPFLALTALSAVPVAALATMIYRRLSTPAYAQARLEIGKVNSTLQEKVSGLRVVQSHGQQELEGARLRALSERFRATRVRAQKYLAVYFPFLTFCTEASYAAVLLVGASQVAAGEMTAGVLAAFFLLLGQFYGPVQQLSGIVDAWQQATASGKHIDELLATEGTENLGSSSVLPVTGALHLDEVTFSYPDSHEPALNKLTLTIPEGMVVAVVGRSGAGKSTLIKLIAGLYFPTHGNIRIGVQMLDDASLTEYRRQIGLVDQDVALFSSDIAENIRYSRPSATNEDVEIASQRAGLYEMVCNLPQGFRTPVNNGGADLSAGQRQLIALARAQLANAHILLLDEATSCLDRTSEERLMSSLTDVVHAGKHSALIVAHRLTTAQRCDLIAVIDKGLLAEYGTHEQLLSAGGLYTRLWHDSVSSTALHRQHNMKEETPG

SEQ ID NO: 2699 - DNA, 1164 bp, Escherichia coli
gtgcgtcgactgcctgatttagatcgtcaagcggagagggattttctcatgcgtattttgtttgtaggcccgcctctctatgggctgttgtatcctgtgctgtctctggcgcaggcatttcgcgttaacggtcatgaagtgctgatcgccagtggaggacaattcgcacaaaaagcggcagaggccgggttggtggtgtttgacgccgcacccggtctggattccgaagctggttaccgccaccatgaggcacagcggaaaaaaagtaatatcggaacccaaatgggcaacttctcattcttcagcgaagaaatggccgaccatctggtggagtttgccggacactggcggcctgacctcatcatctaccctccgctcggagtcatcgggccgctgattgccgccaaatatgatataccggtcgtgatgcaaaccgtaggcttcggccataccccctggcatatcaggggtgtaacgcgttcgctcacggacgcctatcgtcgccacaatgtgggggccacaccacgtgatatggcctggatcgacgtaacaccgccgagtatgagcattctggaaaacgacggtgaacccattattccgatgcagtacgtcccgtataacggtggcgcggtgtgggaaccatggtgggagagaaggcccgagcgtaaacgtctgctggtgagtctcggcactgtcaaaccgatggttgacggccttgatctaatcgcctgggttatggattctgccagtgaggtcgatgccgagatcatcctgcatatttcagccaatgcgcggtccgatttgcgctcgctgccgtcaaatgttcgcctggttgactggatacccatgggtgtcttcctcaacggcgcagatggtttcattcatcatggcggagcaggcaataccctgacagcgctacacgctggtattccacaaatcgtcttcggccagggagccgatcgcccggtaaatgcccgcgttgttgccgaacgcggctgcgggattatccctggcgacgtcggcctgtcgagtaacatgatcaatgctttcctcaacaatcgctcacttcgcaaagcctctgaagaggtagcagcggaaatggcggcgcaaccctgcccaggtgaagtggcgaaaagcctgatcacaatggtacagaaagggtaa

SEQ ID NO: 2700 - protein, 387 aa, Escherichia coli
MRRLPDLDRQAERDFLMRILFVGPPLYGLLYPVLSLAQAFRVNGHEVLIASGGQFAQKAAEAGLVVFDAAPGLDSEAGYRHHEAQRKKSNIGTQMGNFSFFSEEMADHLVEFAGHWRPDLIIYPPLGVIGPLIAAKYDIPVVMQTVGFGHTPWHIRGVTRSLTDAYRRHNVGATPRDMAWIDVTPPSMSILENDGEPIIPMQYVPYNGGAVWEPWWERRPERKRLLVSLGTVKPMVDGLDLIAWVMDSASEVDAEIILHISANARSDLRSLPSNVRLVDWIPMGVFLNGADGFIHHGGAGNTLTALHAGIPQIVFGQGADRPVNARVVAERGCGIIPGDVGLSSNMINAFLNNRSLRKASEEVAAEMAAQPCPGEVAKSLITMVQKG

SEQ ID NO: 2701 - DNA, 315 bp, Escherichia coli
ttgaaacctacgctgctccagaccgtggagaatatttgcctgcaaattctgttcgtgctgttccagttcaccggaacgctgatagacgttgaggtattggtgagctgttcttccgttgccaaaaatgtacagagaactccggccagcagcgtttcatcctctgtctatagcgcaagcgtgtcgagaactgctgctgatattatgctgttgtcgaataatccgctttttgctccgggtcaggtgagttttttcggctgttcgttggcagcgtcaggtattcacgtcaccattactggagtaatgccagtcaattaa

SEQ ID NO: 2702 - protein, 104 aa, Escherichia coli
MKPTLLQTVENICLQILFVLFQFTGTLIDVEVLVSCSSVAKNVQRTPASSVSSSVYSASVSRTAADIMLLSNNPLFAPGQVSFFGCSLAASGIHVTITGVMPVN

SEQ ID NO: 2703 - DNA, 132 bp, Escherichia coli
atggtgggggcggagctggtgttgatgatgtggccagaagcctgttttgctgttacagtcatcgttatattccttattggatggggagcaggtattgttttctttctgggaattaaacaaaaaacaatatga

SEQ ID NO: 2704 - protein, 43 aa, Escherichia coli
MVGAELVLMMWPEACFAVTVIVIFLIGWGAGIVFFLGIKQKTI

SEQ ID NO: 2705 - DNA, 459 bp, Escherichia coli
gtggcgagtgccgccgatgcgcgacgtatcgtcagccattacgagcgacgctggctgatagaggaataccacaaggcgtggaaaagtggtggtacatgtgtggaatcgctgcgaatgcagacccgagataaccttgagcgcatggtggttatcaaggcgtttatcgcggtacgggtgctgggcctgcggcaggaaggtatcagtgaagaaacacaaaatgacagctgtaagaaaatactgacgccgacagagtggaaactgctgtgggttaagctggaaggaaaacagcttccgtcacagacgccgacactgaaatgggcctgtctgaaactggggcgatggcatgacagcaaacgcacaggccgccctggttgggtagttatgtgggatggctggttcagacttcaggatatggttgagggttacctggtgatgaagtctcttgatcaggagatctga

SEQ ID NO: 2706 - protein, 152 aa, Escherichia coli
MASAADARRIVSHYERRWLIEEYHKAWKSGGTCVESLRMQTRDNLERMVVIKAFIAVRVLGLRQEGISEETQNDSCKKILTPTEWKLLWVKLEGKQLPSQTPTLKWACLKLGRWHDSKRTGRPGWVVMWDGWFRLQDMVEGYLVMKSLDQEI

SEQ ID NO: 2707 - DNA, 894 bp, Escherichia coli
atggtactttctgattgttattcatgggataacgagcagtctggacatgcccgtctcggtgatccgcgtcgtacacgacgccttgtgtcactgacctcttctctcgctcagcatgcaggtctttctattgtgaaatcatcccagtccactgctcaggttgaaggtgcgtaccgcctgatacataacccgtctgtgtccccgcaagccattgccgaagccggatttaccgccactgtaagggtatgtgaggctcatccgctgctcctcgcactggaagacaccaccaccattaacttcagccacagtacggcatctgatgaccaggggaataccaccactaacccgaagacgcgcgggctgctggctcactctgtcctgatgtacgcccctgacagcgccctgccagtcggttttatcgaacagcagcgctggagtcgggtcacggacacctacggtgttaagcaccagcgaaaagaacgtccctgtgaagaaaaagaaagttaccgctggcagcaggcttcggagcgtatggccgaacggctgggggagatacagaaacgggtaatcactgtctgtgaccgggaagcggatatctggcattacctgcattataaagtcagccacggacagcgcttcgtggtgcgtgctgcacagaatagccggctggaagaagcacccggcaagctcttcgaactgccggaagtcctggcaaccgcgggaagccacacgctgaatgtgatgcaaaaaggagggcgggcagcccgccaggcccggatgttcatcaggtacagcgaagtcagcataaaaatcgcgacaacagcggccaggcgctcccgctcacgtatgtctgttgccgggagcaggcagaggacggtgcctgctggcatctgctga

SEQ ID NO: 2708 - protein, 297 aa, Escherichia coli
MVLSDCYSWDNEQSGHARLGDPRRTRRLVSLTSSLAQHAGLSIVKSSQSTAQVEGAYRLIHNPSVSPQAIAEAGFTATVRVCEAHPLLLALEDTTTINFSHSTASDDQGNTTTNPKTRGLLAHSVLMYAPDSALPVGFIEQQRWSRVTDTYGVKHQRKERPCEEKESYRWQQASERMAERLGEIQKRVITVCDREADIWHYLHYKVSHGQRFVVRAAQNSRLEEAPGKLFELPEVLATAGSHTLNVMQKGGRAARQARMFIRYSEVSIKIATTAARRSRSRMSVAGSRQRTVPAGIC

SEQ ID NO: 2709 - DNA, 1971 bp, Escherichia coli
atgtatatgaatgtaatcagaactgtcatttgtacattaattatacttccggtgggactacaggcagcgaccagtcattcttctatggttaaagatacaatcaccattgtcgcgacaggaaatcagaacacggtatttgaaacgccgtcgatggtcagtgtcgtcacgaatgacactccgtggagtcagaatgcggttacatcggccggcatgctgaaaggtgttgccggtctcagccagactggtgcaggacggaccaatgggcagacctttaatttacgcggctatgacaaaagcggggtacttgttcttgttgacggcgttcgccaactcagtgacatggcaaaaagcagtggcacttatctggatccggcactcgtcaaacgtatcgaagttgtccgcgggccaaactccagtctgtacggcagtggcgggctgggaggtgtagtggacttcagaactgccgatgcagcagattttcttccccccggagagacaaacggtttaagtctgtggggaaatatcgccagtggtgaccacagcacaggctcggggctcacctggtttggtaaaactggaaaaacagatgcgctcctttctgtcattatgcgtaaaagaggtaatatctatcaaagtgatggtgagcgcgcacctaacaaggaaaaacctgcagccctgtttgcgaaaggctctgtcggtataacagacagtaacaaagcaggtgccagcttgcgtctctaccggaataacaccactgaaccgggcaattccactcagacacatggtgacagcggcctgcgtgacagaaaaacagtacaaaatgacgtacagttctggtaccagtacgctcctgtggataacagcctcatcaatgtaaagtcaacgttatatctcagtgatatcactatcaagacaaacggtcacaacaaaacggcagaatggagaaacaacagaacctccggtgttaatgttgtcaacagaagtcatactctgatttttccgggagcccatcagttaagttatggcgctgaatattaccgtcagcagcagaagccagaaggctctgccacactatatccggaaggaaacattgactttacatcgttgtatttccaggatgaaatgacaatgaaaagctacccggttaacattatcgtcggttcccgctatgaccggtacaagagcttcaatccccgtgccggagaactgaaagccgaacgcctgtccccaagggcggcgatttcagtctcaccgacagactggctgatgatgtacggctccatatcctctgcattccgagcgcccacaatggcagaaatgtacagggatgatgtacatttttaccgcaagggtaaacccaattactgggttcctaaccttaatctgaaaccagaaaataacatcacccgtgagattggcgcaggtattcaactggatggcctgcttacagacaatgaccggctgcagttaaaaggcggatatttcggaacggatgccagaaactatattgccacacgcgtggatatgaaacggatgcgttcttattcttataatgtatcccgggcccgtatctggggatgggatatgcagggtaattaccagtctgattatgttgactggatgctttcttataaccggacggaaagtatggatgccagcagcagggaatggctgggctccggcaatcctgacacacttatcagtgacatcagcataccttttggtcatagaggcgtttatgccggatggcgtgctgaactttcagcatcagccacgcatgtgaaaaaaggcgatccccatcaggctggttataccatacattccttttcactgtcttataagcctgtaagtgttaaaggctttgaggcgtcagtaactctggataatgccttcaacaagcttgccatgaatggcaaaggtgtgccgctttcaggcagaactgtcagtctttatacccgttatcagtggtaa

SEQ ID NO: 2710 - protein, 656 aa, Escherichia coli
MYMNVIRTVICTLIILPVGLQAATSHSSMVKDTITIVATGNQNTVFETPSMVSVVTNDTPWSQNAVTSAGMLKGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGERAPNKEKPAALFAKGSVGITDSNKAGASLRLYRNNTTEPGNSTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYQSDYVDWMLSYNRTESMDASSREWLGSGNPDTLISDISIPFGHRGVYAGWRAELSASATHVKKGDPHQAGYTIHSFSLSYKPVSVKGFEASVTLDNAFNKLAMNGKGVPLSGRTVSLYTRYQW

SEQ ID NO: 2711 - DNA, 792 bp, Escherichia coli
atgatgaaaaatacaggctatatcttagctctttgtctgacagcatcggggcatgtcctggcccatgatgtctggattacaggtaaacagtcagagaacaacgttaccgcagagattggttatggtcataatttcccctcaaaggggacaattcctgacagaagggatttctttgaaaatccccggctttataacgggaaagagacaataacactgaagccagcgtccacggattatgtctataaaactgagtctgcaagcaaagataatggttacgttctgtcaacgtatatgaaaccaggatactggtcgagaacctcgtcaggatggaaaccggtcagccgggagggcagaaatgatgtggcttactgtgaatttgtcactaaatatgcaaaatcttttattcttggtgaacagcagatgccagcacaactctatcagtctccaacagggcatgagcttgaaatcattccgttatccgatataagtcgtttcagtgaaaatgtgaagctgaaagttctgtataaaacgtccccgctcgccggagctatcatggagcttgactcggtcagttatctgacatcatcccgtcatactcatgcagttgagcacaaacatcctgttcataaagcagaactcacctttgtaactaatgaggatggtatcgtcacagtaccttctcttcatatcggacagtggctggcgaaagtccaaaataagaaaagttttcaggacaaaagcctgtgtgatgaaactgtcgatgtggcaaccttaagcttctcccgaaattaa

SEQ ID NO: 2712 - protein, 263 aa, Escherichia coli
MMKNTGYILALCLTASGHVLAHDVWITGKQSENNVTAEIGYGHNFPSKGTIPDRRDFFENPRLYNGKETITLKPASTDYVYKTESASKDNGYVLSTYMKPGYWSRTSSGWKPVSREGRNDVAYCEFVTKYAKSFILGEQQMPAQLYQSPTGHELEIIPLSDISRFSENVKLKVLYKTSPLAGAIMELDSVSYLTSSRHTHAVEHKHPVHKAELTFVTNEDGIVTVPSLHIGQWLAKVQNKKSFQDKSLCDETVDVATLSFSRN

SEQ ID NO: 2713 - DNA, 1263 bp, Escherichia coli
ttggcatggagtcagttccccgtcatcttaggtatcactttaactcacaggtgtccagtaaatatgaacaggatcccagtaatcattatcaatggtttccttggcgcaggaaaaaccactcttatgaaaaacctgctcacacaggcaaacaggaatcacttagctgtatctgtcattgtcaatgatatgagcgatctggatgttgatggtgtacttattgcaaatacagaaatcgttaatattgcgaacaataatttcgtgagtatcacatctgatagtatcagcagccagagtgggattaagacggtcgacaaggcaattaaaaatatgctcaggcattatttgcctgacgttatatttgtcgaaacatccggaggtagccacccactgccattaattaagtatctgcagactcatgagcgattacagctaaaatcacttttatcacttgtcgataccgttatgctcaatgatgactataacggagggaaagcactgatacctgcatttcaggagaatcttttccatggcaagcgcagaatagagaatttactggctgagcaaatcatgttttgtagcactttgctgttaaccaaaaaggatcgactgtcattcgacattgtcaccgatgtggcgaaagcaatccatcctctgaatccttacgtaaatgtgatagctgtgtcatgggggaaccttaaactagcagaattactaacccttccggattacgattttaaccgggtcggattacttatcagagaactggaagacacaatcacagtagaagaagcaaaaatttcagcccaaaatggcgaaataatttcgcgagtgattaaagatgacaggccattccacccacaaagattatgggaaacctatcattattttatgggaatgggtatttatcgtagcaaaggctttttctggctaccaggaagacctgacatggctctgctctggaaccaggccgcaggaagtatcaatctggagtttatcagctactggaattccggtgtattggcagaccctgataatcacctgacccacgaagagcgctctgttttgcagaaaaaagtcaataaaactatggggcggtttggagacaggagatgccatttaacgattatagggcgttctgatgaagtccatgattttacctccgccttaattaactgttttctttctgaagaagaaattgtctggtggcaatcaggtggcgttttcgcggatccctggcccgttaatatatcccggctgaactga

SEQ ID NO: 2714 - protein, 420 aa, Escherichia coli
MAWSQFPVILGITLTHRCPVNMNRIPVIIINGFLGAGKTTLMKNLLTQANRNHLAVSVIVNDMSDLDVDGVLIANTEIVNIANNNFVSITSDSISSQSGIKTVDKAIKNMLRHYLPDVIFVETSGGSHPLPLIKYLQTHERLQLKSLLSLVDTVMLNDDYNGGKALIPAFQENLFHGKRRIENLLAEQIMFCSTLLLTKKDRLSFDIVTDVAKAIHPLNPYVNVIAVSWGNLKLAELLTLPDYDFNRVGLLIRELEDTITVEEAKISAQNGEIISRVIKDDRPFHPQRLWETYHYFMGMGIYRSKGFFWLPGRPDMALLWNQAAGSINLEFISYWNSGVLADPDNHLTHEERSVLQKKVNKTMGRFGDRRCHLTIIGRSDEVHDFTSALINCFLSEEEIVWWQSGGVFADPWPVNISRLN

SEQ ID NO: 2715 - DNA, 183 bp, Escherichia coli
atgttcttcggcaacgatcacggtggagagcgtagtgcgctgctgtacgggctgatcggcgcctgccgactgaacggtatcgatccggaagcgtatctgcgccatatcctcaacgtcctgccggaatggccttctaaccgtgttgatgaactcctgccatggaacgtcgtactcacccaataa

SEQ ID NO: 2716 - protein, 60 aa, Escherichia coli
MFFGNDHGGERSALLYGLIGACRLNGIDPEAYLRHILNVLPEWPSNRVDELLPWNVVLTQ

SEQ ID NO: 2717 - DNA, 1137 bp, Escherichia coli
atgggaaaaataaaatattggctaatagtaggatttattatactttttgcgattttttacattgctattagtgacagggattctacgctttctaggttgaaatcagcaggtgaaaacggagatgtagaagctcagtatgctttggggctcatgtatttgtatggagaaattctggatgttgattatcagcaggcaaagatttggtatgaaaaagccgctgaccaaaatgatccgcgtgcgcaggccaaactcggtgtgatgtatgcaaatggtctcggggtaaatcaggattatcagcaatcaaaattatggtatgaaaaggcggctgcgcaaaatgatgttgatgcgcaatttttgcttggggagatgtatgacgatggtctcggggtaagccaagactaccagcatgcaaagatgtggtatgaaaaagcggctgctcaaaatgatgagcgtgctcaggtcaatctcgctgttctatacgcaaagggtaatggtgttgaacaggattatcgacaggccaaaagctggtatgaaaaggctgcagctcaaaatagtcctgatgcgcagttcgctcttggaattctgtatgccaatgctaatggtgtagagcaggactatcagcaggcaaaagactggtatgagaaggcagcagaacaaaatttcgccaatgctcagtttaatcttggtatgctctattacaaaggtgagggtgttaaacaaaactttcggcaagccagagaatggtttgaaaaagccgcatctcaaaatcagctgaatgcccaatataatttaggtcagatttattactacggtcagggtgtgactcagagctatcgacaggcgaaatactggtttgaaaaagcggcagagaaaggtcatgtcgatgctcaatataatctcggtgtaatatacgaaaatggtgaaggtgtgagtcagaactatcaacaggcaaaggcttggtatgaaaaggcagcctcacaaaatgatgcgcaggcgcagttcgaacttggcgttatgaatgagctgggtcagggtgaaagcatagacctgaaacaagcaagacattactatgagcggtcatgtaataatgggcttaagaaaggttgtgaacggttaaaagagttattagacaaatag

SEQ ID NO: 2718 - protein, 378 aa, Escherichia coli
MGKIKYWLIVGFIILFAIFYIAISDRDSTLSRLKSAGENGDVEAQYALGLMYLYGEILDVDYQQAKIWYEKAADQNDPRAQAKLGVMYANGLGVNQDYQQSKLWYEKAAAQNDVDAQFLLGEMYDDGLGVSQDYQHAKMWYEKAAAQNDERAQVNLAVLYAKGNGVEQDYRQAKSWYEKAAAQNSPDAQFALGILYANANGVEQDYQQAKDWYEKAAEQNFANAQFNLGMLYYKGEGVKQNFRQAREWFEKAASQNQLNAQYNLGQIYYYGQGVTQSYRQAKYWFEKAAEKGHVDAQYNLGVIYENGEGVSQNYQQAKAWYEKAASQNDAQAQFELGVMNELGQGESIDLKQARHYYERSCNNGLKKGCERLKELLDK

SEQ ID NO: 2719 - DNA, 327 bp, Escherichia coli
ttgatgcatctattctttaagttaataaggtcagaaaaatttcaacttattcatttaataatttcccgtttagagtgtaagtacagcacttacataattattggtatgcctgatgcctttaaatctggagaaaacatttcaagtaaccattctcatcaacatacagcccattgtaataactggatttgccgcaccgaacaaaatttctttggtctgtttcgtgtagagcaactagcaagaaggttggatcaggcagatcgagtcgtagaatcgctttactataaacttaatccgatttttcacctgtttttcttagtagaaacatga

SEQ ID NO: 2720 - protein, 108 aa, Escherichia coli
MMHLFFKLIRSEKFQLIHLIISRLECKYSTYIIIGMPDAFKSGENISSNHSHQHTAHCNNWICRTEQNFFGLFRVEQLARRLDQADRVVESLYYKLNPIFHLFFLVET

SEQ ID NO: 2721 - DNA, 243 bp, Escherichia coli
ttgggcgcacttttctaccgttttatcagcgaaaaattttccagccatatggaatattgtcgatcaagatgttgtaaaaatatccagaaaaaatatttcaaaggcatgaaagaacttgctgacaagaagtttattgcagagaccatgatacagaactattactttattaacccaggctatatgtttaatggtcatcgcttgacctatatgaagacctattacctgaaggataaaaacgaataa

SEQ ID NO: 2722 - protein, 80 aa, Escherichia coli
MGALFYRFISEKFSSHMEYCRSRCCKNIQKKYFKGMKELADKKFIAETMIQNYYFINPGYMFNGHRLTYMKTYYLKDKNE

SEQ ID NO: 2723 - DNA, 792 bp, Escherichia coli
atgaggtgtttgtgtcatgttttcagttggttaacgcaatgtaatcaggcatttcccctggcagagtgttcagaagaaaatccagttccatacagcgcgggcaacagagaccaccgtgtcacggacggcacgcagaaccgtgcatgcaacagaggcaatacagacgctctccgccgtgtcaaatatccggtccaccgcaccggtaaactgttcacgggcctgagcgcggacagattccgtgcgcagctcgtcctgcaggcgggtcatcaggggactggcggcatggtcgggaagcgctgtcatgagcgcactgaccagcgtatccagttcccagccggtgcggaccgatacggcaacaaccggatgtacgggccggaacagacggaataccgcctccgttttttcgcgaatgttctgtgcctgtgcaggagaaggctgaataccggccatatcccattcatggcagggctccgttttgtcggcctgcgtcaccacaaacagcacctgctgatgtccccggtgcaggatgtgtcgccagaaatactcatccacagacagggcacggtcatcggctttaatcagccacagtaccaggtccagttcaggcagaatgtcacggtacagggcttcatactctgcatccctgtcccggctctcgcccaccccgggcaggtcagtgataaccatgttgtgaccatggccactcagacggaagcgccgcacttcccgggtgccggcgtgaacatcactgaccggggtgacctccccctgaaacagtgcattacagagtga

SEQ ID NO: 2724 - protein, 263 aa, Escherichia coli
MRCLCHVFSWLTQCNQAFPLAECSEENPVPYSAGNRDHRVTDGTQNRACNRGNTDALRRVKYPVHRTGKLFTGLSADRFRAQLVLQAGHQGTGGMVGKRCHERTDQRIQFPAGADRYGNNRMYGPEQTEYRLRFFANVLCLCRRRLNTGHIPFMAGLRFVGLRHHKQHLLMSPVQDVSPEILIHRQGTVIGFNQPQYQVQFRQNVTVQGFILCIPVPALAHPGQVSDNHVVTMATQTEAPHFPGAGVNITDRGDLPLKQCITE

SEQ ID NO: 2725 - DNA, 873 bp, Escherichia coli
atgaatccgtctgatgccattgaggcaattgaaaaaccactttcttccctgccttactcgctttcccgtcacatcctggaacatctgcgcaaactcaccagtcacgaacccgtgattggcattatggggaaaagcggggccggtaaatcctcactctgtaatgcactgtttcagggggaggtcaccccggtcagtgatgttcacgccggcacccgggaagtgcggcgcttccgtctgagtggccatggtcacaacatggttatcactgacctgcccggggtgggcgagagccgggacagggatgcagagtatgaagccctgtaccgtgacattctgcctgaactggacctggtactgtggctgattaaagccgatgaccgtgccctgtctgtggatgagtatttctggcgacacatcctgcaccggggacatcagcaggtgctgtttgtggtgacgcaggccgacaaaacggagccctgccatgaatgggatatggccggtattcagccttctcctgcacaggcacagaacattcgcgaaaaaacggaggcggtattccgtctgttccggcccgtacatccggttgttgccgtatcggtccgcaccggctgggaactggatacgctggtcagtgcgctcatgacagcgcttcccgaccatgccgccagtcccctgatgacccgcctgcaggacgagctgcgcacggaatctgtccgcgctcaggcccgtgaacagtttaccggtgcggtggaccggatatttgacacggcggagagcgtctgtattgcctctgttgcatgcacggttctgcgtgccgtccgtgacacggtggtctctgttgcccgcgctgtatggaactggattttcttctga

SEQ ID NO: 2726 - protein, 290 aa, Escherichia coli
MNPSDAIEAIEKPLSSLPYSLSRHILEHLRKLTSHEPVIGIMGKSGAGKSSLCNALFQGEVTPVSDVHAGTREVRRFRLSGHGHNMVITDLPGVGESRDRDAEYEALYRDILPELDLVLWLIKADDRALSVDEYFWRHILHRGHQQVLFVVTQADKTEPCHEWDMAGIQPSPAQAQNIREKTEAVFRLFRPVHPVVAVSVRTGWELDTLVSALMTALPDHAASPLMTRLQDELRTESVRAQAREQFTGAVDRIFDTAESVCIASVACTVLRAVRDTVVSVARAVWNWIFF

SEQ ID NO: 2727 - DNA, 2847 bp, Escherichia coli
atgaaacgacatctgaacaccagctacaggctggtatggaatcacattacaggcaccctggtggtggcttccgaactggcacgctcacggggaaaaggcgccggtgtggcggttgctctgtctcttgctgctgtcacgtcagtcccggcactggctgctgacacggttgtacaggcgggagaaaccgtgaacggcggaacactgacaaatcatgacaaccagattgtcctcggtacggccaacggaatgaccatcagtaccgggctggagtatgggccggataacgaggccaataccggcgggcaatggatacaaaatggcggtatcgccaacaacactactgtcaccggtggtggtcttcagagagtgaatgccggaggaagcgtttcagacacggttatcagtgccggaggcggacagagccttcaggggcaggcagtgaacaccactctgaacggcggtgagcagtgggtacatgaaggcgggattgcaacgggtaccgtcattaatgagaagggctggcaggccgtcaaatccggtgcaatggcaaccgacacggttgtgaataccggcgcggaaggaggaccggatgcggaaaatggtgataccgggcagaccgtctacggagatgccgtacgcaccaccatcaataaaaatggtcgtcagattgtggctgctgaaggaacggcaaataccactgtggtttatgccggcggcgaccagactgtacatggtcacgcactggataccacgctgaatggggggtaccagtatgtgcacaacggaggtacagcatctgacactgttgttaacagtgacggctggcagattatcaaggaaggtggtctggcggatttcaccaccgttaaccagaaaggtaaactgcaggtgaacgccggtggtacagccacgaatgtcaccctgacgcagggcggcgcactggtcaccagtacggcggcaaccgtcaccggcagcaaccgtctgggcaatttcactgtggaaaacggtaatgctgacggtgttgttctggagtccggtggtcgcctggatgtactggagggccattcagcctggaaaacactggtggatgacggcggtaccctggcagtgtctgccggtggtaaggcaacagatgtcaccatgacatccggtggtgccctgattgcagacagtggtgccactgttgaggggaccaatgccagcggtaagttcagtattgatggcatatccggtcaggccagcggcctgctgctggaaaatggcggcagctttacggttaatgccggaggactggccagcaacaccactgtcggacatcgtggaacactgacgctggccgccgggggaagtctgagtggcagaacacagctcagtaaaggcgccagtatggtactgaatggtgatgtggtcagtaccggcgatattgttaacgccggagagattcgctttgataatcagacgacaccggatgccgcactgagccgtgctgttgcaaaaggcgactccccggtaacgttccataaactgaccaccagtaacctcaccggtcagggtggcaccatcaatatgcgtgttcgccttgatggcagcaatgcctctgaccagctggtgattaatggtggtcaggcaaccggcaaaacctggcttgcgtttacaaatgtcggaaacagtaacctcggggtggcaacctccggacagggtatccgggttgtggatgcacagaatggtgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatgcctccatgctgacacaggcaatggactatgaccggattctggcaggctcccgcagccatcagagcggtgtaagcggtgaaaataacagcgtccgtctcagcattcagggcggtcatctcgggcacgataacaacggtggtattgcccgtggggccacgccggaaagcaacggcagctatggcttcgtccgtctggagggtgacctgctcagaacagaggttgccggtatgtcactgacgacaggagtgtatggtgctgcaggccattcttccgttgatgttaaggatgatgacggctcccgcgccggcacggtccgggatgatgccggcagcctgggcggatacctgcatctggtacacacgtcctccggcctgtgggctgacattgtggcacagggaacccgccacagcatgaaagcgtcatcggacaataacgacttccgcgcccggggctggggctggctgggctcactggaaaccggtctgcccttcagtatcactgacaacctgatgctggagccacaactgcagtacacctggcagggactctccctggatgacggccaggataacgccggttatgtgaagttcgggcatggcagtgcacaacatgtgcgtgccggcttccgtctgggcagccacaacgatatgaactttggtaaaggcacctcatcccgtgacaccctgcacgacagtgcaaaacacagtgtgcgtgaactgccggtgaactggtgggtacagccttctgttatccgcaccttcagctcccggggagacatgagcatgggtacagccgcagccggcagtaacatgacgttctcaccgtcccggaatggcacgtcactggacctgcaggccggactggaagcccgtgtccgggaaaatatcaccctgggcgttcaggccggttatgcccacagtgtcagcggcagcagcgctgaaggttataacggtcaggccacactgaacgtgactttctga

SEQ ID NO: 2728 - protein, 948 aa, Escherichia coli
MKRHLNTSYRLVWNHITGTLVVASELARSRGKGAGVAVALSLAAVTSVPALAADTVVQAGETVNGGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQTVYGDAVRTTINKNGRQIVAAEGTANTTVVYAGGDQTVHGHALDTTLNGGYQYVHNGGTASDTVVNSDGWQIIKEGGLADFTTVNQKGKLQVNAGGTATNVTLTQGGALVTSTAATVTGSNRLGNFTVENGNADGVVLESGGRLDVLEGHSAWKTLVDDGGTLAVSAGGKATDVTMTSGGALIADSGATVEGTNASGKFSIDGISGQASGLLLENGGSFTVNAGGLASNTTVGHRGTLTLAAGGSLSGRTQLSKGASMVLNGDVVSTGDIVNAGEIRFDNQTTPDAALSRAVAKGDSPVTFHKLTTSNLTGQGGTINMRVRLDGSNASDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQSGVSGENNSVRLSIQGGHLGHDNNGGIARGATPESNGSYGFVRLEGDLLRTEVAGMSLTTGVYGAAGHSSVDVKDDDGSRAGTVRDDAGSLGGYLHLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMNFGKGTSSRDTLHDSAKHSVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 2729 - DNA, 849 bp, Escherichia coli
gtgcctgaatcacgccttcagggacatgctgcatcagcgcaggctctccagcagcgtttctgccattacccacaatgcgcggttgagcttaatatcggtgtcgatgctgtgaatggcacgggtgtggatacgttttccttttgcactgcgaccggaaatcccgcctttcagcatattctcctggatggtctgataagtactccacaggtccttaccgtaatcctcccggcgtcgtggcgtcagaatgtcggcggtggtgacgggccgatgttcgtcaccataacggtaagtcagtgccgcctgtgccagcgcctggcgtgccggtggcggcagaatcagcgactgcatggcatcacgcttctcctctatccggtcaaacacgcccaccacctcgtaagccccttcaatgactctgtccaccacatttccccggtgcggaacacgcacttcccccagagactgaccacagacgcatccgttctggcagacgaacctgaagtaacccggcagcatctggtagctggaggtaccgtcatgagagttgagcagaataatttcagggacatgttctccgtttatctctccgttacggcgcaggcgcagcatgtgttttgtgtatccccggcggcccgggtcgcgcacacaggtctggcaggcgaagaatggctgaaagccttcccgctgcagactttccagcacggtgatggtgggaatgtacgcataccgtttactgcgggaagtatgccggtctttaccgaaaatactgggaacatagtgcatcagttcttcgtgtgtcagcggacggtcacggcgtatctggtttgcagcataaccaaaacgactggctag

SEQ ID NO: 2730 - protein, 282 aa, Escherichia coli
MPESRLQGHAASAQALQQRFCHYPQCAVELNIGVDAVNGTGVDTFSFCTATGNPAFQHILLDGLISTPQVLTVILPASWRQNVGGGDGPMFVTITVSQCRLCQRLACRWRQNQRLHGITLLLYPVKHAHHLVSPFNDSVHHISPVRNTHFPQRLTTDASVLADEPEVTRQHLVAGGTVMRVEQNNFRDMFSVYLSVTAQAQHVFCVSPAARVAHTGLAGEEWLKAFPLQTFQHGDGGNVRIPFTAGSMPVFTENTGNIVHQFFVCQRTVTAYLVCSITKTTG

SEQ ID NO: 2731 - DNA, 822 bp, Escherichia coli
atgcgactagccagtcgttttggttatgctgcaaaccagatacgccgtgaccgtccgctgacacacgaagaactgatgcactatgttcccagtattttcggtaaagaccggcatacttcccgcagtaaacggtatgcgtacattcccaccatcaccgtgctggaaagtctgcagcgggaaggctttcagccattcttcgcctgccagacctgtgtgcgcgacccgggccgccggggatacacaaaacacatgctgcgcctgcgccgtaacggagagataaacggagaacatgtccctgaaattattctgctcaactctcatgacggtacctccagctaccagatgctgccgggttacttcaggttcgtctgccagaacggatgcgtctgtggtcagtctctgggggaagtgcgtgttccgcaccggggaaatgtggtggacagagtcattgaaggggcttacgaggtggtgggcgtgtttgaccggatagaggagaagcgtgatgccatgcagtcgctgattctgccgccaccggcacgccaggcgctggcacaggcggcactgacttaccgttatggtgacgaacatcggcccgtcaccaccgccgacattctgacgccacgacgccgggaggattacggtaaggacctgtggagtacttatcagaccatccaggagaatatgctgaaaggcgggatttccggtcgcagtgcaaaaggaaaacgtatccacacccgtgccattcacagcatcgacaccgatattaagctcaaccgcgcattgtgggtaatggcagaaacgctgctggagagcctgcgctga

SEQ ID NO: 2732 - protein, 273 aa, Escherichia coli
MRLASRFGYAANQIRRDRPLTHEELMHYVPSIFGKDRHTSRSKRYAYIPTITVLESLQREGFQPFFACQTCVRDPGRRGYTKHMLRLRRNGEINGEHVPEIILLNSHDGTSSYQMLPGYFRFVCQNGCVCGQSLGEVRVPHRGNVVDRVIEGAYEVVGVFDRIEEKRDAMQSLILPPPARQALAQAALTYRYGDEHRPVTTADILTPRRREDYGKDLWSTYQTIQENMLKGGISGRSAKGKRIHTRAIHSIDTDIKLNRALWVMAETLLESLR

SEQ ID NO: 2733 - DNA, 246 bp, Escherichia coli
atgcagcatgtccctgaaggcgtgattcaggcaccagaatcacccgacgccccggaggcgctgccggggtgtcgttccatttctgatgatgacctgtgcgcctggtgtacccgtctgctttaccgtcccggagaaatcagtctgtgcagactgagtacaggcaatggcatctggccatccgtctgtgaccggaacggttacgcgtacggctgtccggaatttcagccgaatatcattcatccctga

SEQ ID NO: 2734 - protein, 81 aa, Escherichia coli
MQHVPEGVIQAPESPDAPEALPGCRSISDDDLCAWCTRLLYRPGEISLCRLSTGNGIWPSVCDRNGYAYGCPEFQPNIIHP

SEQ ID NO: 2735 - DNA, 546 bp, Escherichia coli
gtgatgaacgtgatgttgccagctcccgacctttactccctctcatttattcacattacaaggatttcatacatgaaaacattgtctcagaacaccacctcttcggcctgtgcaccggagactggcctgcaacaactggttgccaccatagtccctgatgaacagcgcatcagcttctggccgcagcattttggcctcattccacagtgggtgaccctggagccccgtgtcttcggctggatggaccgtctgtgcgaaaactactgcggtggtatctggaatctgtacaccctgaacaacggcggggcatttatggcccctgaaccggatgactatgatgacgaaacatgggtactgttcaatgccatgaacggtaaccgcgctgaaatgagcccggaagccgccggcattgccgcctgtctgatgatgtacagtcatcacgcctgccgtacggagtgttatgccatgacggttcattattaccgtctgcgggattacgccctgcagcatccggaatgcagcgccattatgcgcattattgactga

SEQ ID NO: 2736 - protein, 181 aa, Escherichia coli
MMNVMLPAPDLYSLSFIHITRISYMKTLSQNTTSSACAPETGLQQLVATIVPDEQRISFWPQHFGLIPQWVTLEPRVFGWMDRLCENYCGGIWNLYTLNNGGAFMAPEPDDYDDETWVLFNAMNGNRAEMSPEAAGIAACLMMYSHHACRTECYAMTVHYYRLRDYALQHPECSAIMRIID

SEQ ID NO: 2737 - DNA, 477 bp, Escherichia coli
atgcaacagctttcctttctgcccggagagatgacgcccggcgagcgcagtctcattctgcgggccctgaaaaccctggaccgccatcttcatgaacccggcgtggccttcacctccacccgtgcggcacgggaatggctgattctgaacatggcgggactggagcgtgaagagttccgggtgctgtatctgaataaccagaatcagctgattgccggtgaaaccctcttcaccggcaccatcaaccgcacggaagtccatccccgggaagtgattaaacgcgccctgtatcacaatgccgcagccgtggtgctggcacacaatcacccgtccggtgaagtcacccccagtaaggcagaccgccttatcacggaacgtctggtacaggcactgggcctggtggatatccgggtgccggaccatctgatagtcggtggcagccaggttttctcctttgccgaacatggtctgctttaa

SEQ ID NO: 2738 - protein, 158 aa, Escherichia coli
MQQLSFLPGEMTPGERSLILRALKTLDRHLHEPGVAFTSTRAAREWLILNMAGLEREEFRVLYLNNQNQLIAGETLFTGTINRTEVHPREVIKRALYHNAAAVVLAHNHPSGEVTPSKADRLITERLVQALGLVDIRVPDHLIVGGSQVFSFAEHGLL

SEQ ID NO: 2739 - DNA, 222 bp, Escherichia coli
atgaaaatcatcacccgtggtgaagccatgcgtattcaccaacagcatcctgcatcccgtctttttccgttctgtaccggcaaataccgctggcacggcagcactgaaacgtataccggtcgtgaagtgcaggatattcccggtgtgctggccgtgtttgctgaacgccgtaaggacagttttggcccgtatgtccggctgatgagcgtcactctgaactga

SEQ ID NO: 2740 - protein, 73 aa, Escherichia coli
MKIITRGEAMRIHQQHPASRLFPFCTGKYRWHGSTETYTGREVQDIPGVLAVFAERRKDSFGPYVRLMSVTLN

SEQ ID NO: 2741 - DNA, 645 bp, Escherichia coli
atgagcagaattatcaccaccaccgtgtatacactgcatgagctatcctccaccgcacaggaaaaagcccgcgactggtaccgtcagcatcatgctgacagcaactggtatgaaaacgtgtatgaggacttcagggaggtctgtggcattttcggaattgacctccgccagcgcgttttccggctcagcaacggcaggtttatggaagagccgtgcatctggttcagcggattctgcagtcagggggacggagcctgttttgaagggcgctggcactggcagccagcgacaccccggaaaatcagggaatatgcccctcaggaccgtgagcttcatcgtatcgcggatgccctgcaggcggtacagaagcgtaacttctggcagttacaggctgaaatcagtcaccggggacgttactgccatccgtacagcatggatatcaccgtcacccggaacagtccgactggtcaggcactgacagccgatgcggaagccgctgtcagcgaagccctgcgcgacctggccttctggctgtaccgccagctggaaaacgagtacgactggctgacctcagacgccgctgtagatgaggccattcacatcaatgcatataccttcaccgaagccggtctccacgccggctga

SEQ ID NO: 2742 - protein, 214 aa, Escherichia coli
MSRIITTTVYTLHELSSTAQEKARDWYRQHHADSNWYENVYEDFREVCGIFGIDLRQRVFRLSNGRFMEEPCIWFSGFCSQGDGACFEGRWHWQPATPRKIREYAPQDRELHRIADALQAVQKRNFWQLQAEISHRGRYCHPYSMDITVTRNSPTGQALTADAEAAVSEALRDLAFWLYRQLENEYDWLTSDAAVDEAIHINAYTFTEAGLHAG

SEQ ID NO: 2743 - DNA, 336 bp, Escherichia coli
cacgaccgcccctggtgggggctgccctgcaccgtgacgccctgtttcggggcacgtctggtgcaggagggtaaccggttgcattaccttgcagaccgcaccggtatcagaggccggttcagcaatgcggatgcataccatctggaccaggcttttccactgctgatgaaacaactggaactcatgctcaccagcggtgaactgaatccccgccatcagcataccgtcacgctgtatgcgaaagggctgacctgcgaagctgatacccttggcagttgtggttacgtttatctggctgtttatccgacaccggcagcacccgcaatcaccgtataa

SEQ ID NO: 2744 - protein, 111 aa, Escherichia coli
HDRPWWGLPCTVTPCFGARLVQEGNRLHYLADRTGIRGRFSNADAYHLDQAFPLLMKQLELMLTSGELNPRHQHTVTLYAKGLTCEADTLGSCGYVYLAVYPTPAAPAITV

SEQ ID NO: 2745 - DNA, 489 bp, Escherichia coli
ttggcagttgtggttacgtttatctggctgtttatccgacaccggcagcacccgcaatcaccgtataaccccggatatctcccctttatcaccacctgttacagagaacttaagatgaatacattacccgacactcacgtacgggaggcatcgggctgcccgtctcccgtcaccatctggcagacactgctcacccgactgctggaccagcactacggcctcacgctgaatgacacaccgttcgctgatgaacgtgtgattgagcagcatattgaggcaggtatttcactgtgtgatgcggtgaactttctcgtggaaaaatacgcgctggtgcgtaccgaccagccgggattcagcgcctgtacccgctctcagttaataaacagcatcgatatcctccgggctcgcagggcgaccggcctgatgacccgcgacaattacagaacggtaaataacataaccctgggtaagcatccggaggcgaaatga

SEQ ID NO: 2746 - protein, 162 aa, Escherichia coli
MAVVVTFIWLFIRHRQHPQSPYNPGYLPFITTCYRELKMNTLPDTHVREASGCPSPVTIWQTLLTRLLDQHYGLTLNDTPFADERVIEQHIEAGISLCDAVNFLVEKYALVRTDQPGFSACTRSQLINSIDILRARRATGLMTRDNYRTVNNITLGKHPEAK

SEQ ID NO: 2747 - DNA, 492 bp, Escherichia coli
atgatgaaactggccctgacgctggaagccgacagcgttaacgtacaggcactgaacatggggcgcattgtcgttgacgtcgatggtattgagcttgctgaactgattaacgtggtctgcgataacggtcactcccttcgtgttgttgatgaatctgaccgagcctcaacagactgcacgccaccatttgctgccctgaccggcatacgctgcagtaccgcgcatatcacggcaaaagacaacgcctggctgtactcgctgtcgcatcagacgaatgacaccggcgaatcagaatggattcattttacaggcagcggatatctgttacgtaccgatgcgtggtcatacccggttctgcggcttaaacgcctgggcctgtcaaaaacgttccgccgcctggttgtcacactcatccgacgttatggcgtcagtctcattcatctggatgccagcgctgaatgcctgccgggtttacccactttcgactggtaa

SEQ ID NO: 2748 - protein, 163 aa, Escherichia coli
MMKLALTLEADSVNVQALNMGRIVVDVDGIELAELINVVCDNGHSLRVVDESDRASTDCTPPFAALTGIRCSTAHITAKDNAWLYSLSHQTNDTGESEWIHFTGSGYLLRTDAWSYPVLRLKRLGLSKTFRRLVVTLIRRYGVSLIHLDASAECLPGLPTFDW

SEQ ID NO: 2749 - DNA, 207 bp, Escherichia coli
atgaacaacatgaaatcattaaccacggaaaccgcactggatattctgattgcgtggctgcaggacaatatcgactgcgaatcgggaattatctttgacaacgatgaggataaaacagattcggcagcactgttgccctgtatcgaacaggccagggagggtatccgtaccctgtgccaactgcagcttctgcaccagaaccgatga

SEQ ID NO: 2750 - protein, 68 aa, Escherichia coli
MNNMKSLTTETALDILIAWLQDNIDCESGIIFDNDEDKTDSAALLPCIEQAREGIRTLCQLQLLHQNR

SEQ ID NO: 2751 - DNA, 939 bp, Escherichia coli
atgagtcttactcattcactcaccagacttcattccaatgacgtcagcctgaacagggctggcgttttcgtttataaaccaaaaggaaaaacgatgatgtcagatatcacaatctcccgcctggaagtggtcaacggacatacggacattatctgctccacctcagtcagccacattctggctgtgcgaaagactacactgctgcaaatcgacacacttatccggcaactgactgaaatatcagcaatgacagaaagtattggcggtaaaaccgcactggactgggccatgaaacaggattttcgctgcggctgctggctcatggataaacctgatacagcaatgaaagctatcacccgcaatctcgatcgcgaaatctggcgtgacctgatgcaatgctccgggatgctttccttaatggatgcacaggcccgtgatacatggtaccgatcactggagtacgataattttccggaaatcagtgaagagaatattctgagtacgtttgagcagctacaccagaataaggatgaagtgtttgagcgaggagtgatcaacctcttcagagggttgagctggaattacaaaaccaattgcccctgtaaatttggcaataaaattatcgtcaacaatctggtgaggtgggaccggtggggattgcatcttatcaccgggcaacaggcagatagacttgccgacctggaaagaatgctgcatctgttcagcggcaaaccgatccccgacaacagggaaaacataactattcatctggacgaacatatccggtctcttcagggaaaagaatgctatgaagatgagatgttcattattaaatactttaagaagggctctgcgcacatcacgttcaggaagccagaactggttgacagactgaatgatattatcgcaaaacactatcctgatatgctggcagtatag

SEQ ID NO: 2752 - protein, 312 aa, Escherichia coli
MSLTHSLTRLHSNDVSLNRAGVFVYKPKGKTMMSDITISRLEVVNGHTDIICSTSVSHILAVRKTTLLQIDTLIRQLTEISAMTESIGGKTALDWAMKQDFRCGCWLMDKPDTAMKAITRNLDREIWRDLMQCSGMLSLMDAQARDTWYRSLEYDNFPEISEENILSTFEQLHQNKDEVFERGVINLFRGLSWNYKTNCPCKFGNKIIVNNLVRWDRWGLHLITGQQADRLADLERMLHLFSGKPIPDNRENITIHLDEHIRSLQGKECYEDEMFIIKYFKKGSAHITFRKPELVDRLNDIIAKHYPDMLAV

SEQ ID NO: 2753 - DNA, 939 bp, Escherichia coli
atggatatcatcttttatcacccaacgttcgatacccaatggtggattgaggcactgcgcaaagctattcctcaggcaagagtcagagcatggaaaagcggagataatgactctgctgattatgctttagtctggcatcctccagttgaaatgctggcagggcgcgatcttaaagcggtgttcgcactcggggccggtgttgattctattttgagcaagctacaggcacaccctgaaatgctgaagccttctgttccactttttcgcctggaagataccggtatgggcgagcaaatgcaggaatatgctgtcagtcaggtgctgcattggtttcgacgttttgacgattaccgcatccagcaaaatagttcgcattggcaaccgcttcctgaatatcatcgggaagattttaccatcggcattttgggcgcaggcgtactgggcagtaaagttgcacagagtctgcaaacctggcgcttcccgctgcgttgctggagtcgaacccgtaaatcgtggcctggcgtgcaaagctttgccggacgagaagaactgtctgcatttctgagccaatgccgggtattgattaatctgttaccgaatacacctgaaaccgtcggcattattaatcaacaattactcgaaaaattaccggatggcgcgtatctcctcaacctggcgcgtggtgttcatgtcgtggaagatgacctgctcgcggcgctggatagcgggaaagttaaaggcgcaatgttggatgtttttaatcgtgaacccttaccgccggaaagtccgctctggcaacatccacgcgtgacgataacaccacatgtcgccgcgattacccgtccagctgaagctgtggagtacatttctcgcaccattgcccagctcgaaaaaggggagaggctctgcgggcaagtcgaccgcgcacgcggctactaa

SEQ ID NO: 2754 - protein, 312 aa, Escherichia coli
MDIIFYHPTFDTQWWIEALRKAIPQARVRAWKSGDNDSADYALVWHPPVEMLAGRDLKAVFALGAGVDSILSKLQAHPEMLKPSVPLFRLEDTGMGEQMQEYAVSQVLHWFRRFDDYRIQQNSSHWQPLPEYHREDFTIGILGAGVLGSKVAQSLQTWRFPLRCWSRTRKSWPGVQSFAGREELSAFLSQCRVLINLLPNTPETVGIINQQLLEKLPDGAYLLNLARGVHVVEDDLLAALDSGKVKGAMLDVFNREPLPPESPLWQHPRVTITPHVAAITRPAEAVEYISRTIAQLEKGERLCGQVDRARGY

SEQ ID NO: 2755 - DNA, 738 bp, Escherichia coli
atgtatcccgtcgaccttcatatgcataccgttgccagcacgcatgcatatagcacattgagtgattacattgcccaggccaaacaaaagggcattaaactttttgcgatcaccgatcatggcccggatatggaagatgcgccgcatcactggcacttcattaacatgcgtatctggccgcgagtggttgatggggttgggatcctacgcggcatcgaagctaacattaaaaatgttgacggtgaaattgactgcagtggcaaaatgtttgattcgctggatctgattattgccggttttcatgagccggtgtttgcgccgcatgacaaagcgaccaatacgcaagcgatgatcgccactatcgccagcggcaatgtgcatataataagccatcccggaaatccgaaatatgaaatagatgttaaagccgttgctgaagcagccgcgaaacatcaggtggcgctggaaatcaataattcctcttttttacactcacgtaagggaagtgaagacaattgtcgtgcggtagccgcagcggtacgtgacgctggaggttgggtggcattaggctcggattctcacaccgcgtttaccatgggtgaatttgaagagtgtcttaaaatcctcgacgcggtagattttccgccagagcgcattttgaatgtttctccgcgccgcttactgaacttccttgaatctcgcggtatggcaccgattgcggaatttgcagacctttaa

SEQ ID NO: 2756 - protein, 245 aa, Escherichia coli
MYPVDLHMHTVASTHAYSTLSDYIAQAKQKGIKLFAITDHGPDMEDAPHHWHFINMRIWPRVVDGVGILRGIEANIKNVDGEIDCSGKMFDSLDLIIAGFHEPVFAPHDKATNTQAMIATIASGNVHIISHPGNPKYEIDVKAVAEAAAKHQVALEINNSSFLHSRKGSEDNCRAVAAAVRDAGGWVALGSDSHTAFTMGEFEECLKILDAVDFPPERILNVSPRRLLNFLESRGMAPIAEFADL

SEQ ID NO: 2757 - DNA, 555 bp, Escherichia coli
atgaacgagttttctatcctctgtcgtgtgctgggttcgctctattaccgccaaccgcaagatcctttactggtgccgctgtttaccctgattcgtgaggggaaactggctgcgaactggccactggagcaggatgagttactgacgcgtttacagaaaagctgtgatatggcgcaagtctctgccgattacaatgcgttgtttatcggcgatgaatgtgctgtgccgccatatcgtagcgcatgggttgagggcgcgacggaagcggaagtgcgcgcttttctttccgaacgggggatgccattagcggatacgccagccgatcacatcggcacattgctgctcgcggcttcctggctggaagatcagtcaacggaagatgagagcgaagcactggaaacactgttcagtgagtatctgttaccctggtgtggtgcgttccttggcaaagtggaggcccatgcaactacgcctttctggcgcaccatggcaccgctaacccgcgatgctattagtgcaatgtgggacgagctggaagaagattctgaagagtaa

SEQ ID NO: 2758 - protein, 184 aa, Escherichia coli
MNEFSILCRVLGSLYYRQPQDPLLVPLFTLIREGKLAANWPLEQDELLTRLQKSCDMAQVSADYNALFIGDECAVPPYRSAWVEGATEAEVRAFLSERGMPLADTPADHIGTLLLAASWLEDQSTEDESEALETLFSEYLLPWCGAFLGKVEAHATTPFWRTMAPLTRDAISAMWDELEEDSEE

SEQ ID NO: 2759 - DNA, 540 bp, Escherichia coli
gtgtgctcgatctcattcatggccgcgttttctgctatcatgcgcggcatgaacatacttctctctattgcaatcacaacaggcattctctccggtatctggggatgggtggctgtttccctgggcttactaagctgggcgggcttcctgggctgtacggcctactttgcctgcccgcaaggtgggctgaaagggctggcgatctccgctgcaaccctgcttagtggcgtggtgtgggcgatggtcattatttacggtagtgcactggcaccacatctggaaattctcggttatgtcataaccggtattgtcgcgtttctgatgtgtattcaggccaaacagctgctgctttcatttgttccgggaacgtttataggcgcatgcgcgacgtttgccgggcagggtgactggaaactggtgttaccttcgctggcgctcggactggtatttggttacgcaatgaaaaacagcggcctgtggctggcggcgcgtagtacgaagaccgctcaccgtgagcagcaaatcaaaaataaagcgtga

SEQ ID NO: 2760 - protein, 179 aa, Escherichia coli
MCSISFMAAFSAIMRGMNILLSIAITTGILSGIWGWVAVSLGLLSWAGFLGCTAYFACPQGGLKGLAISAATLLSGVVWAMVIIYGSALAPHLEILGYVITGIVAFLMCIQAKQLLLSFVPGTFIGACATFAGQGDWKLVLPSLALGLVFGYAMKNSGLWLAARSTKTAHREQQIKNKA

SEQ ID NO: 2761 - DNA, 834 bp, Escherichia coli
atgcagcgcttatttcttttggttgccgtcatgttactgagcggatgcttaaccgccccgcctaaagaagccgccagaccgacattaatgcctcgtgctcagagctacaaagatttgacccatctgccagcgccgacgggtaagatctttgtttcggtatacaacatccaggacgaaaccgggcaatttaaaccctacccggcaagtaacttctccactgctgttccgcaaagcgccacggcaatgctggtcacggcattgaaagattctcgctggtttataccgctggagcgccagggcttacaaaacctgcttaacgagcgcaagattattcgtgcggcacaagaaaacggcacggttgccattaataaccgaatcccgctgcaatctttaacggcggcaaatatcatggttgaaggttcgattatcggttatgaaagcaacgtcaaatcgggcggtgttggggcaagatattttgggatcggtgcagacacgcaataccagcttgatcagattgccgtgaacctgcgtgtcgtcaatgtgagtaccggtgagatcctctcctcggtgaacaccagtaagacgatactttcctatgaagttcaggccggggttttccgctttattgactaccagcgcttgctggaaggggaagtgggttacacctcgaacgaacccgttatgctgtgcctgatgtcggctatcgaaacaggggtcattttcctgattaatgatggtattgaccgtggtctgtgggatttgcagaacaaagcagaacggcagaatgacattctggtgaaataccgccatatgtcggttccaccggaatcctga

SEQ ID NO: 2762 - protein, 277 aa, Escherichia coli
MQRLFLLVAVMLLSGCLTAPPKEAARPTLMPRAQSYKDLTHLPAPTGKIFVSVYNIQDETGQFKPYPASNFSTAVPQSATAMLVTALKDSRWFIPLERQGLQNLLNERKIIRAAQENGTVAINNRIPLQSLTAANIMVEGSIIGYESNVKSGGVGARYFGIGADTQYQLDQIAVNLRVVNVSTGEILSSVNTSKTILSYEVQAGVFRFIDYQRLLEGEVGYTSNEPVMLCLMSAIETGVIFLINDGIDRGLWDLQNKAERQNDILVKYRHMSVPPES

SEQ ID NO: 2763 - DNA, 417 bp, Escherichia coli
atgcgtgtcaaacatgcagtagttctactcatgcttatttcgccattaagttgggctggaaccatgactttccagttccgtaatccaaactttggtggtaacccaaataatggcgcttttttgttaaatagcgctcaggcccaaaactcttataaagatccgagctataacgatgactttggtattgaaacgccctcggcgttagataactttactcaggccatccagtcacaaattttgggtgggctactgtcgaatattaataccggtaaaccgggccgcatggtgaccaacgattatattgttgatattgctaaccgcgatggtcaattgcagttgaacgtgacagatcgtaaaaccggacaaacctcgaccatccaggtttcgggtttacaaaataactcaaccgatttttaa

SEQ ID NO: 2764 - protein, 138 aa, Escherichia coli
MRVKHAVVLLMLISPLSWAGTMTFQFRNPNFGGNPNNGAFLLNSAQAQNSYKDPSYNDDFGIETPSALDNFTQAIQSQILGGLLSNINTGKPGRMVTNDYIVDIANRDGQLQLNVTDRKTGQTSTIQVSGLQNNSTDF

SEQ ID NO: 2765 - DNA, 390 bp, Escherichia coli
atgaaacgttatttacgctggattgtggcggcagaatttctgttcgccgcagggaatcttcacgccgttgaggtagaagtcccgggattgttaactgaccatactgtttcatctattggccatgatttttaccgagcctttagtgataaatgggaaagtgactatacgggtaacttaacgattaatgaaaggcccagtgcacgatggggaagctggatcacaataacggtgaatcaggacgttattttccagacttttttatttccgttgaaaagagacttcgagaaaactgtcgtctttgcactgattcaaactgaagaagcactaaatcgtcgccagataaaccaggcgttattaagtacgggcgatttggcgcatgatgaattttaa

SEQ ID NO: 2766 - protein, 129 aa, Escherichia coli
MKRYLRWIVAAEFLFAAGNLHAVEVEVPGLLTDHTVSSIGHDFYRAFSDKWESDYTGNLTINERPSARWGSWITITVNQDVIFQTFLFPLKRDFEKTVVFALIQTEEALNRRQINQALLSTGDLAHDEF

SEQ ID NO: 2767 - DNA, 651 bp, Escherichia coli
atgtttaatgaagtccatagtattcatggtcatacattattgttgatcactaaaccttctttgcaggcgacagctctcttgcagcaccttaaacaatcgctggcaattacaggaaaattacataatattcaacgttctctggacgatatatcttcaggctctattattcttctggatatgatggaagcggataaaaagcttatccattattggcaggatactttgagcaggaaaaacaacaatatcaaaatattgttgctaaatacgcctgaagattacccgtaccgcgacattgaaaactggcctcatatcaacggcgttttttatgccatggaggatcaagaacgtgttgtcaatgggttgcaaggcgtcctgcgcggcgaatgctactttacgcaaaagcttgccagttacctgattacgcattcaggtaactatcgttataacagcacggaatcagccctccttactcatcgggaaaaagagatcctgaataagctgcgtatcggcgcgtctaataacgagatcgctcgttcgttgttcatcagcgaaaatacggttaaaacgcatctttataatcttttcaagaagatagccgtaaaaaaccggacacaagcggtttcctgggcaaacgataacctcaggcgataa

SEQ ID NO: 2768 - protein, 216 aa, Escherichia coli
MFNEVHSIHGHTLLLITKPSLQATALLQHLKQSLAITGKLHNIQRSLDDISSGSIILLDMMEADKKLIHYWQDTLSRKNNNIKILLLNTPEDYPYRDIENWPHINGVFYAMEDQERVVNGLQGVLRGECYFTQKLASYLITHSGNYRYNSTESALLTHREKEILNKLRIGASNNEIARSLFISENTVKTHLYNLFKKIAVKNRTQAVSWANDNLRR

SEQ ID NO: 2769 - DNA, 456 bp, Escherichia coli
atgaaaaacaaattgttatttatgatgttaacaatactgggtgcgcctgggattgcagccgcagcaggttatgatttagctaattcagaatataactttgcggtaaatgaattgagtaagtcttcatttaatcaggcagccataattggtcaagctgggactaataatagtgctcagttacggcagggaggctcaaaacttttggcggttgttgcgcaagaaggtagtagcaaccgggcaaagattgaccagacaggagattataaccttgcatatattgatcaggcgggcaatgccaacgatgccagtatttcgcaaggtgcttatggtaatactgcgatgattatccagaaaggttctggtaataaagcaaatattacacagtatggtactcaaaaaacggcaattgtagtgcagagacagtcgcaaatggctattcgcgtgacacaacgttaa

SEQ ID NO: 2770 - protein, 151 aa, Escherichia coli
MKNKLLFMMLTILGAPGIAAAAGYDLANSEYNFAVNELSKSSFNQAAIIGQAGTNNSAQLRQGGSKLLAVVAQEGSSNRAKIDQTGDYNLAYIDQAGNANDASISQGAYGNTAMIIQKGSGNKANITQYGTQKTAIVVQRQSQMAIRVTQR

SEQ ID NO: 2771 - DNA, 456 bp, Escherichia coli
atgaaacttttaaaagtagcagcaattgcagcaatcgtattctctggtagcgctctggcaggtgttgttcctcagtacggcggcggcggtaaccacggtggtggcggtaataatagcggcccaaattcagagctgaacatttaccagtacggtggcggtaactctgctcttgctctgcaagctgacgcccgtaactctgatctgaccattacccagcacggcggcggtaacggcgcagatgttggccaaggttctgatgacagctcaatcgatctgactcagcgtggtttcggcaacagcgctactcttgatcagtggaatggtaaagattctactatgactgttaaacagttcggtggcggtaacggtgctgctgttgaccagactgcatctaactccagcgttaacgtcactcaggttggctttggtaacaacgcgaccgctcatcagtactaa

SEQ ID NO: 2772 - protein, 151 aa, Escherichia coli
MKLLKVAAIAAIVFSGSALAGVVPQYGGGGNHGGGGNNSGPNSELNIYQYGGGNSALALQADARNSDLTITQHGGGNGADVGQGSDDSSIDLTQRGFGNSATLDQWNGKDSTMTVKQFGGGNGAAVDQTASNSSVNVTQVGFGNNATAHQY

SEQ ID NO: 2773 - DNA, 312 bp, Escherichia coli
atgttcagaccttttttagactctctaatgctcggcagtatgttttttccttttattgccatcgcaggaagcaccgcgcaagggggcgtgatccacttttatggccaaattgtggaaccggcatgtgacgtcagcacccagtcaacacccgtagaaatgaactgcccgcagaatggctctgttccgggcagaacctattccagcaaagcgttaatgagcggcaatgttaaaaacgcgcaaatagcctcagtaaaagtgcagtatcttgataaacagaaaaagctggctgtaatgaacatcgaatataactaa

SEQ ID NO: 2774 - protein, 103 aa, Escherichia coli
MFRPFLDSLMLGSMFFPFIAIAGSTAQGGVIHFYGQIVEPACDVSTQSTPVEMNCPQNGSVPGRTYSSKALMSGNVKNAQIASVKVQYLDKQKKLAVMNIEYN

SEQ ID NO: 2775 - DNA, 534 bp, Escherichia coli
atgaaaacgcgtattcatgttgtgcagggtgatattaccaaactggccgttgatgtgattgtgaatgcggctaatccgtcattaatgggaggcggcggcgtcgatggggccattcatcgcgcagcgggtccggccctgctggatgcctgtttaaaagtcaggcagcagcagggcgattgccctacggggcatgccgttattacgcttgcaggcgatcttcccgcgaaagccgtagtgcacaccgtcgggccagtctggcgtggtggtgaacaaaacgaagaccagcttttgcaggatgcctatctcaatagcctgcgactggtggcggcaaacagctatacgtcagtggcttttcctgcaatcagtactggagtttatggttaccctcgtgcggcagcggctgaaatcgcagtaaaaaccgtttcagaatttattacccgtcacgctttacccgaacaggtatactttgtctgttatgatgaagaaaacgcccacctctacgaaagactccttactcaacaaggagatgaatga

SEQ ID NO: 2776 - protein, 177 aa, Escherichia coli
MKTRIHVVQGDITKLAVDVIVNAANPSLMGGGGVDGAIHRAAGPALLDACLKVRQQQGDCPTGHAVITLAGDLPAKAVVHTVGPVWRGGEQNEDQLLQDAYLNSLRLVAANSYTSVAFPAISTGVYGYPRAAAAEIAVKTVSEFITRHALPEQVYFVCYDEENAHLYERLLTQQGDE

SEQ ID NO: 2777 - DNA, 1431 bp, Escherichia coli
atgaatgatttgccccggctggcgagtgcggtgctgccactgtgttcgcaacatcccggtcagtgtggcctttttcctctggagaaaagtctggatgcgtttgccgcccggtatcgtctggccgaaatggcagagcatacgctggatgttcagtattacatctggcaggacgatatgtcgggtcggttactcttttccgccctgttagccgcagcaaagcgtggcgttcgcgtccgtttgttgctggacgacaacaatacgcccggacttgacgacattttacgcttgcttgacagtcatccccgcattgaagtccggctttttaatcctttctcgtttcgcttgctacgtccgcttggttatatcaccgacttttcccgtctcaatcgccgtatgcacaataaaagtttcactgtcgatggcgtggttaccctggtaggggggcgaaatattggtgatgcctattttggggcaggggaagagccacttttttcggatttagatatcatggcaataggaccagttgtagaggacgttgccgatgatttcgcccgctactggtattgcaaatcggtttcacccctacagcaggtgctggatgtcccggaaggtgaaatggcggatcgcatcgagttacccgcctcctggcatgacgatgccatgacgcatcgttatttacgcaaaatggaatccagcccgtttgtaaatcatctggttgatggaacgttgccgcttatctgggcgaaaacacgtttattaagtgatgatccggccaaaggggaaggcaaggcaaaacggcattcactgttaccgcagcgcctgttcgatatcatgggctcacccagtgaacgcatcgatattatctcttcctattttgtaccgacacgcgcaggtgtggcgcaactcttacgtatggtgagaaaaggggtaaagattgcgatcctaaccaattctcttgccgctaacgatgttgctgtcgtccatgccggatacgcgcgctggcgcaaaaaattgctccgctatggcgtggaattatatgaactcaagccgacgcgtgaacaaagtagtacgttacacgatcgcggcataaccggtaattccggtgccagcctgcatgctaaaacctttagcatcgatggtaaaacggtgtttatcggctctttcaatttcgatccgcgttcaacattgctcaatactgaaatgggtttcgtgatagagagcgaaacgctggcacagttaattgataaacgctttattcagagccagtatgatgcggcctggcagctccgtctggacaggtggggacggatcaactgggttgatcgtcatgcaaagaaagagattgttctcaaaaaagaacccgccaccagtttctggaagcgggttatggtcagactggcgtcgatattgcctgtggaatggttattgtaa

SEQ ID NO: 2778 - protein, 476 aa, Escherichia coli
MNDLPRLASAVLPLCSQHPGQCGLFPLEKSLDAFAARYRLAEMAEHTLDVQYYIWQDDMSGRLLFSALLAAAKRGVRVRLLLDDNNTPGLDDILRLLDSHPRIEVRLFNPFSFRLLRPLGYITDFSRLNRRMHNKSFTVDGVVTLVGGRNIGDAYFGAGEEPLFSDLDIMAIGPVVEDVADDFARYWYCKSVSPLQQVLDVPEGEMADRIELPASWHDDAMTHRYLRKMESSPFVNHLVDGTLPLIWAKTRLLSDDPAKGEGKAKRHSLLPQRLFDIMGSPSERIDIISSYFVPTRAGVAQLLRMVRKGVKIAILTNSLAANDVAVVHAGYARWRKKLLRYGVELYELKPTREQSSTLHDRGITGNSGASLHAKTFSIDGKTVFIGSFNFDPRSTLLNTEMGFVIESETLAQLIDKRFIQSQYDAAWQLRLDRWGRINWVDRHAKKEIVLKKEPATSFWKRVMVRLASILPVEWLL

SEQ ID NO: 2779 - DNA, 1158 bp, Escherichia coli
atgaacccagtacccgcgcaacgtgaatatttcctcgactccatccgcgcctggctgatgttgttagggatcccttttcatatttctttaatctattcgagccatacatggcatgtgaatagcgccgaaccgtcattatggctgaccctttttaatgacttcatccactcgttccgcatgcaggtatttttcgttatatccgggtacttttcctacatgctttttttacgctatcccttgaaaaaatggtggaaagtacgtgtcgaacgtgtaggtatcccgatgttaacagccatccccctactgacattgccgcaatttattatgctgcaatacgtcaaagggaaagcggaaagttggcctggactgtcattgtatgacaaatataatacgttggcctgggaattaatatcacacctgtggtttttactggtgttagtggtcatgacgacgctgtgcgtctggatattcaaacgtatcagaaataatttagaaaattctgataaaacgaataaaaaattctcgatggtaaaactatcggtgatttttttgtgcctcggcatcggttatgcggtaataagaagaacaatttttattgtgtatccgcccattctgagtaacggcatgttcaattttattgtcatgcaaacgctattttatttgccgttctttatcctcggcgcactggctttcattttccctcatcttaaagccttgtttaccacgccgtctcgtggctgtaccttcgcagcagcattggcatttgtcgcttacttactcaaccagcgctatggcagtggcgatgcctggatgtacgaaaccgagtctgtgatcaccatggtcctcggtctgtggatggtgaatgtggtcttctccttcggccaccgtttgcttaacttccagtcagcgcgggtgacttactttgttaacgcatcgctgtttatctatctggttcaccacccgttaacgctgtttttcggcgcgtacattacaccgcacatcacctccaactggcttggttttctctgtggcctgatattcgtagtagggattgcgataattctgtatgaaattcatttacgcatcccgttactgaagtttttgttctctggtaaaccggttgttaagcgtgagaacgataaagcaccagcccgttaa

SEQ ID NO: 2780 - protein, 385 aa, Escherichia coli
MNPVPAQREYFLDSIRAWLMLLGIPFHISLIYSSHTWHVNSAEPSLWLTLFNDFIHSFRMQVFFVISGYFSYMLFLRYPLKKWWKVRVERVGIPMLTAIPLLTLPQFIMLQYVKGKAESWPGLSLYDKYNTLAWELISHLWFLLVLVVMTTLCVWIFKRIRNNLENSDKTNKKFSMVKLSVIFLCLGIGYAVIRRTIFIVYPPILSNGMFNFIVMQTLFYLPFFILGALAFIFPHLKALFTTPSRGCTFAAALAFVAYLLNQRYGSGDAWMYETESVITMVLGLWMVNVVFSFGHRLLNFQSARVTYFVNASLFIYLVHHPLTLFFGAYITPHITSNWLGFLCGLIFVVGIAIILYEIHLRIPLLKFLFSGKPVVKRENDKAPAR

SEQ ID NO: 2781 - DNA, 144 bp, Escherichia coli
ttgccagcaaatttatttatcaaccgtcttacagacgcttccattctggttagtggtagcgatgatgctatgcataaaaaccttgaagcctgcgcctggcgcggtcaggtcggtgtcgctatggcaacaagcctaaaggcataa

SEQ ID NO: 2782 - protein, 47 aa, Escherichia coli
MPANLFINRLTDASILVSGSDDAMHKNLEACAWRGQVGVAMATSLKA

SEQ ID NO: 2783 - DNA, 1527 bp, Escherichia coli
atgcgttggttgagtgctgcagtaatgttaaccctgtatacatcttcaagctgggctttcagtattgatgatgtcgcaaagcaagctcaatccttagccgggaaaggctatgaggcgcccaaaagcaacttgccctccgttttccgcgatatgaaatacgcggactatcagcagatccagtttaatcatgacaaagcgtactggaacaatctgaagaccccattcaaactcgagttctaccatcagggtatgtacttcgataccccggtcaaaataaatgaagtgactgccaccgcagtcaaacgaatcaaatacagcccggattatttcactttcggcgatgttcagcatgacaaagacacggtaaaagaccttggttttgccggtttcaaagtgctttacccgatcaacagcaaagataaaaacgatgaaatcgtcagcatgctcggggccagctatttccgcgtgattggtgcaggtcaggtttatggcctttctgcacgcggcctggcaattgataccgccttgccatcgggtgaagaatttccacgcttcaaagagttctggatcgagcgtccaaaaccgactgataaacgtttaaccatttatgcattgcttgactcgccgcgcgcgacaggtgcttacaaattcgtagttatgccaggacgtgacacggttgtggatgtgcagtcgaaaatctatctgcgcgataaagtcggcaaactgggggttgcaccgttaaccagtatgttcctgtttgggccgaaccaaccgtcgcctgcaaataactatcgtccggagttgcacgactctaacggtctgtctatccatgctggtaatggcgaatggatctggcgtccgttgaataacccgaaacatttagcggtcagcagcttctcgatggaaaacccgcaaggcttcggtctattgcagcgtggtcgtgatttctcccgctttgaagatctcgatgatcgttacgatcttcgtccaagcgcatgggtgactccgaaaggggagtggggcaaaggcagcgttgagctggtggaaattccaaccaacgatgaaaccaacgataacatcgtcgcttactggacgccggatcagctgccggagccgggtaaagagatgaactttaaatacaccatcaccttcagccgtgatgaagacaaactgcatgcgccagataacgcatgggtgcaacaaacgcgtcgttcaacgggggatgtgaagcagtcgaacctgattcgccagcctgacggtactatcgcctttgtggtcgattttaccggcgctgagatgaaaaaactgccagaggataccccggtcacagcgcaaaccagcattggtgataatggtgagatagttgaaagcacggtgcgttataacccggttaccaaaggctggcgtctggtgatgcgtgtgaaagtgaaagatgccaagaaaaccactgaaatgcgtgctgcgctggtgaatgccgatcagacgttgagtgaaacctggagctaccagttacctgccaatgaataa

SEQ ID NO: 2784 - protein, 508 aa, Escherichia coli
MRWLSAAVMLTLYTSSSWAFSIDDVAKQAQSLAGKGYEAPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 2785 - DNA, 2574 bp, Escherichia coli
gtgaaacctggagctaccagttacctgccaatgaataagacaactgagtacattgacgcaatgcccatcgccgcaagcgagaaagcggcattgccgaagactgatatccgcgccgttcatcaggcgctggatgccgaacaccgcacctgggcgcgggaggatgactccccgcaaggctcggtaaaggcgcgtctggaacaagcctggccagattcacttgctgatggacagttaattaaagacgacgaagggcgcgatcagctaaaggcgatgccagaagtaaaacgctcctcgatgtttcccgacccgtggcgtaccaacccggtaggccgtttctgggatcgcctgcgtggacgcgatgtgacgccgcgctatctggctcgtttgaccaaagaagagcaggagagtgagcaaaagtggcgtaccgtcggtaccatccgccgttacattctgttgatcctgacgctcgcgcaaactgttgtcgcgacctggtatatgaagaccattcttccttatcaggggtgggcgctgattaatcctatggatatggttggtcaggatgtgtgggtttcctttatgcagcttctgccttatatgctgcaaaccggtatcctgatcctctttgcggtactgttctgttgggtgtccgccggattctggacggcgttgatgggcttcctgcaactgcttattggtcgcgataaatacagtatatctgcgtcaacagttggcgatgaaccattaaacccggagcatcgcacggcgttgatcatgcctatctgtaacgaagacgtgaaccgtgtttttgctggcttgcgtgcaacgtgggaatcagtaaaagccaccgggaatgccaaacattttgatgtctacattcttagtgacagttataacccggatatctgcgtcgcagagcaaaaagcctggatggagcttatcgctgaagtcggtggcgaaggtcagattttctatcgccgccgccgccgtcgcgtgaagcgtaaaagcggtaatatcgatgacttctgccgtcgctggggcagccagtacagctacatggtggtgctggatgctgactcggtaatgaccggtgattgtttgtgcggcctggtgcgcctgatggaagccaacccgaacgccgggatcattcagtcgtcgccgaaagcgtccggcatggatacgctgtatgcgcgctgtcagcagttcgcgacccgcgtgtatgggccactgtttacagccggtttgcacttctggcaacttggcgagtcgcactactgggggcataacgcgattatccgcgtgaaaccgtttatcgagcactgtgcactggctccgctgccgggcgaaggttcttttgccggttcaatcctgtcacatgacttcgtggaagcggcgttgatgcgccgtgcaggttggggggtctggattgcttacgatctcccgggttcttatgaagaattaccgcctaacttgcttgatgagctaaaacgtgaccgccgctggtgccacggtaacctgatgaacttccgtctgttcctggtgaagggtatgcacccggttcaccgtgcggtgttcctgacgggcgtgatgtcttatctctccgctccgctgtggtttatgttcctcgcgctctctactgcattgcaggtagtacatgcgttgaccgaaccgcaatacttcctgcaaccacggcagttgttcccggtatggccgcagtggcgtcctgagctggcgattgcactttttgcttcgaccatggtgctgttgttcctgccgaagctattgagcattttgcttatctggtgcaaaggaacgaaagaatacggcggcttctggcgcgttacattatcgttgctgctggaagtgctgttttccgtgctgctggctccggttcgcatgttgttccatacggtcttcgtcgtcagcgcgttccttggctgggaagtagtgtggaattcgccgcagcgtgatgatgactccacttcctggggggaagcgttcaaacgccacggctcacagctgctgttagggttagtgtgggctgttgggatggcgtggctggatctgcgttttctgttctggctggcaccgattgtcttctcgttgatcctgtcaccgtttgtttcggttatttccagccgtgccaccgttggtctgcgaaccaaacgctggaaactgttcctgatcccggaagagtattcaccgccgcaggtgctggttgataccgatcggttccttgagatgaatcgtcaatgctcccttgatgatggttttatgcacgcggtgtttaacccgtcatttaacgctctggcaaccgcaatggcgaccgcgcgtcaccgcgccagcaaggtgctggaaatcgcccgtgaccgccacgttgaacaggcgctgaacgagacgccagagaagctgaatcgcgatcgtcgcctggtgctgctaagcgatccggtgacgatggcccgtctgcatttccgcgtctggaattccccggagagatattcttcatgggtgagttattacgaagggataaagctcaatccactggcattgcgtaaaccggatgcggcttcgcaataa

SEQ ID NO: 2786 - protein, 857 aa, Escherichia coli
MKPGATSYLPMNKTTEYIDAMPIAASEKAALPKTDIRAVHQALDAEHRTWAREDDSPQGSVKARLEQAWPDSLADGQLIKDDEGRDQLKAMPEVKRSSMFPDPWRTNPVGRFWDRLRGRDVTPRYLARLTKEEQESEQKWRTVGTIRRYILLILTLAQTVVATWYMKTILPYQGWALINPMDMVGQDVWVSFMQLLPYMLQTGILILFAVLFCWVSAGFWTALMGFLQLLIGRDKYSISASTVGDEPLNPEHRTALIMPICNEDVNRVFAGLRATWESVKATGNAKHFDVYILSDSYNPDICVAEQKAWMELIAEVGGEGQIFYRRRRRRVKRKSGNIDDFCRRWGSQYSYMVVLDADSVMTGDCLCGLVRLMEANPNAGIIQSSPKASGMDTLYARCQQFATRVYGPLFTAGLHFWQLGESHYWGHNAIIRVKPFIEHCALAPLPGEGSFAGSILSHDFVEAALMRRAGWGVWIAYDLPGSYEELPPNLLDELKRDRRWCHGNLMNFRLFLVKGMHPVHRAVFLTGVMSYLSAPLWFMFLALSTALQVVHALTEPQYFLQPRQLFPVWPQWRPELAIALFASTMVLLFLPKLLSILLIWCKGTKEYGGFWRVTLSLLLEVLFSVLLAPVRMLFHTVFVVSAFLGWEVVWNSPQRDDDSTSWGEAFKRHGSQLLLGLVWAVGMAWLDLRFLFWLAPIVFSLILSPFVSVISSRATVGLRTKRWKLFLIPEEYSPPQVLVDTDRFLEMNRQCSLDDGFMHAVFNPSFNALATAMATARHRASKVLEIARDRHVEQALNETPEKLNRDRRLVLLSDPVTMARLHFRVWNSPERYSSWVSYYEGIKLNPLALRKPDAASQ

SEQ ID NO: 2787 - DNA, 225 bp, Escherichia coli
ttgcctgatgcgctacgcttatcaggcctacatcgttcctgcaatttattgattttgcaagattttgtaggtcgggtaaagcgttcacgccgcatccggcaaaaacaacgagccaataaaaataccggcgttatgccggtattttttacggaagaggtatcaaatgcgtttaattgtgatgagcataatggtgaccttgctgagtggctgtggcagcatcattag

SEQ ID NO: 2788 - protein, 74 aa, Escherichia coli
MPDALRLSGLHRSCNLLILQDFVGRVKRSRRIRQKQRANKNTGVMPVFFTEEVSNAFNCDEHNGDLAEWLWQHH

SEQ ID NO: 2789 - DNA, 195 bp, Escherichia coli
ttgctgagtggctgtggcagcatcattagtcgcactataccggggcaggggcatggcaaccaatattatcccggtgtgcaatgggacgtgcgtgactccgcctggcgttacgtcacgatccttgatctgccattctccctggttttcgatactttactgctgccgatcgacgtacatcatggcccgtatgagtga

SEQ ID NO: 2790 - protein, 64 aa, Escherichia coli
MLSGCGSIISRTIPGQGHGNQYYPGVQWDVRDSAWRYVTILDLPFSLVFDTLLLPIDVHHGPYE

SEQ ID NO: 2791 - DNA, 375 bp, Escherichia coli
atgaccatgtacgcaacgcttgaagaagccattgacgctgcacgcgaagaatttcttgcagacaaccccggcatcgatgccgaaaacgcgaatgtgcaacagttcaatgcccaaaaatacgttttgcaggacggcgacatcatgtggcaagttgagttttttgccgacgaaggggaagaaggtgaatgtttacccatgcttagcggtgaagccgcgcaaagtgtctttgacggcgactatgatgagatagagatccgccaggagtggcaagatgagaatacattacatgaatgggacgagggggaatttcagcttgagccaccgctggataccgaggaaggacgcactgcagctgatgagtgggatgaacgttaa

SEQ ID NO: 2792 - protein, 124 aa, Escherichia coli
MTMYATLEEAIDAAREEFLADNPGIDAENANVQQFNAQKYVLQDGDIMWQVEFFADEGEEGECLPMLSGEAAQSVFDGDYDEIEIRQEWQDENTLHEWDEGEFQLEPPLDTEEGRTAADEWDER

SEQ ID NO: 2793 - DNA, 1227 bp, Escherichia coli
atgtcaccctgtgaaaatgacacccctataaactggaaacgaaacctgatcgtcgcctggctaggctgttttcttaccggtgccgccttcagcctggtaatgcccttcttacccctctacgttgagcagcttggcgttaccggccactccgccctgaatatgtggtccggtattgtcttcagcattacatttttattttcggccatcgcctcaccgttttggggtggactcgccgaccgtaaaggccgaaaactcatgctattacgctctgctctcggcatgggcatcgtgatggtgttgatgggactggcacaaaatatctggcagtttttgatcctgcgggcgcttcttggtttacttggcggatttgtccccaacgctaatgctcttatcgccacacaagtaccgcgtaataaaagcggctgggcgctgggtacgctctccacaggcggcgttagcggcgcgttgctcggcccaatggctggcggtttgctcgccgatagctacggcttacgtccggtattctttattaccgccagtgtgctcatactctgctttttcgtcaccctgttttgcatcagagaaaaattccagccggtcagcaaaaaagagatgctgcatatgcgggaagtggtgacatcacttaaaaacccgaaactggtactcagcctgtttgtcaccacgttaatcatccaggtggcgacgggctcaattgcccccattctgacgctgtatgtccgcgaactggcgggtaacgtcagtaacgtcgcttttatcagtggcatgatcgcctcggtgccaggcgtggcggctctgctaagtgcaccacgactcggcaaacttggcgatcgaatcggccccgaaaagatcctgattacggcgctgatcttttctgtactgctgttgatcccaatgtcttacgttcagacgccattacaacttgggattttacgttttttgctcggtgccgccgatggtgcattactccccgccgtacagacactgttggtttacaactcgagcaaccagatcgccgggcgtatcttcagctataaccaatcgtttcgtgatattggcaacgttaccggaccattgatgggagcagcgatttcagcgaactacggtttcagggcggtatttctcgtcaccgctggcgtagtgttattcaacgcagtctattcatggaacagtctacgtcgtcgtcgaatcccccagatatcgaactga

SEQ ID NO: 2794 - protein, 408 aa, Escherichia coli
MSPCENDTPINWKRNLIVAWLGCFLTGAAFSLVMPFLPLYVEQLGVTGHSALNMWSGIVFSITFLFSAIASPFWGGLADRKGRKLMLLRSALGMGIVMVLMGLAQNIWQFLILRALLGLLGGFVPNANALIATQVPRNKSGWALGTLSTGGVSGALLGPMAGGLLADSYGLRPVFFITASVLILCFFVTLFCIREKFQPVSKKEMLHMREVVTSLKNPKLVLSLFVTTLIIQVATGSIAPILTLYVRELAGNVSNVAFISGMIASVPGVAALLSAPRLGKLGDRIGPEKILITALIFSVLLLIPMSYVQTPLQLGILRFLLGAADGALLPAVQTLLVYNSSNQIAGRIFSYNQSFRDIGNVTGPLMGAAISANYGFRAVFLVTAGVVLFNAVYSWNSLRRRRIPQISN

SEQ ID NO: 2795 - DNA, 984 bp, Escherichia coli
ttgcggacgaaaaaatgcgacaatacatacaattgcccgtataggttgaaaaacaggattgatatgacgaatctacccaagttctccaccgcactgcttcatccgcgttattggttaacctggttgggtattggcgtactttggttggtcgtgcaattgccctacccggttatctaccgcctcggttgtggattaggaaaactggcgttacgttttatgaaacgacgcgcaaaaattgtgcatcgcaacctggaactgtgcttcccggaaatgagcgaacaagaacgccgtaaaatggtggtgaagaatttcgaatccgttggcatgggcctgatggaaaccggcatggcgtggttctggccggaccgccgaatcgcccgctggacggaagtgatcggcatggaacacattcgtgacgtgcaggcgcaaaaacgcggcatcctgttagttggcatccattttctgacactggagctgggtgcgcggcagtttggtatgcaggaaccggggattggcgtttaccgcccgaacgataatccactgattgactggctacaaacctggggccgtttgcgctcaaataaatcgatgctcgaccgcaaagatttaaaaggcatgattaaagccctgaaaaaaggcgaagtggtctggtacgcaccggatcatgattacggcccgcgctcaagcgttttcgtcccgttgtttgccgttgagcaggctgcgaccacgaccggaacctggatgctggcacggatgtccggcgcatgtctggtgcccttcgttccacgccgtaagccagatggcaaagggtatcagttgattatactgccgccagagtgttctccgccgctggatgatgccgaaactaccgccgcgtggatgaacaaagtggtcgaaaaatgcatcatgatggcaccagagcagtatatgtggttacaccgtcgctttaaaacacgcccggaaggcgttccttcacgctattaa

SEQ ID NO: 2796 - protein, 327 aa, Escherichia coli
MRTKKCDNTYNCPYRLKNRIDMTNLPKFSTALLHPRYWLTWLGIGVLWLVVQLPYPVIYRLGCGLGKLALRFMKRRAKIVHRNLELCFPEMSEQERRKMVVKNFESVGMGLMETGMAWFWPDRRIARWTEVIGMEHIRDVQAQKRGILLVGIHFLTLELGARQFGMQEPGIGVYRPNDNPLIDWLQTWGRLRSNKSMLDRKDLKGMIKALKKGEVVWYAPDHDYGPRSSVFVPLFAVEQAATTTGTWMLARMSGACLVPFVPRRKPDGKGYQLIILPPECSPPLDDAETTAAWMNKVVEKCIMMAPEQYMWLHRRFKTRPEGVPSRY

SEQ ID NO: 2797 - DNA, 1053 bp, Escherichia coli
atgccagtgttacacaaccgcatttccaacgacgcgttaaaagccaaaatgttggctgagagcgaaccgcgaaccaccatttcgttttataagtatttccacattgccgatcctaaggtgacccgtgacgctttatatcaactgtttaccgcgctgaatgtttttgggcgagtgtatctggcgcatgagggcattaacgcgcaaatcagcgtacctgcgagcaatgttgaaacatttcgcgcgcagctctatgccttcgacccggctttagagggtttacgcctgaatatcgcgttggatgatgacgggaaatccttctgggtactgcgtatgaaggtacgcgatcgcattgttgccgacggtattgacgatcctcactttgatgccagcaatgtgggtgagtatctgcaagcggcggaagtgaacgccatgcttgacgatcccgatgcattgtttatcgacatgcgtaaccactatgagtatgaagtggggcactttgaaaacgcgctggaaataccggcagataccttccgtgagcagctgccaaaagcagttgagatgatgcaggcacataaagataaaaaaatcgttatgtactgcaccggcggcattcgttgtgaaaaggccagtgcctggatgaaacataacggattcaacaaagtctggcatatcgagggtggagttattgaatacgcccgtaaggcgcgcgagcagggcttgccggtgcgttttattggcaaaaattttgtttttgacgagcggatgggcgaacgtatatctgatgagattatcgcgcactgccaccagtgcggtgcgccgtgcgacagccataccaactgtaaaaatgatggctgccatctgttgtttattcagtgtccagtatgtgcggaaaaatacaaaggttgttgtagtgagatttgctgcgaagaaagcgcgttaccgccagatgaacagcgacgccgtcgggcaggacgtgaaaatggcaataagatctttaataagtctcgtggacgtctgaatacaacactgggcattcctgatccaacagaataa

SEQ ID NO: 2798 - protein, 350 aa, Escherichia coli
MPVLHNRISNDALKAKMLAESEPRTTISFYKYFHIADPKVTRDALYQLFTALNVFGRVYLAHEGINAQISVPASNVETFRAQLYAFDPALEGLRLNIALDDDGKSFWVLRMKVRDRIVADGIDDPHFDASNVGEYLQAAEVNAMLDDPDALFIDMRNHYEYEVGHFENALEIPADTFREQLPKAVEMMQAHKDKKIVMYCTGGIRCEKASAWMKHNGFNKVWHIEGGVIEYARKAREQGLPVRFIGKNFVFDERMGERISDEIIAHCHQCGAPCDSHTNCKNDGCHLLFIQCPVCAEKYKGCCSEICCEESALPPDEQRRRRAGRENGNKIFNKSRGRLNTTLGIPDPTE

SEQ ID NO: 2799 - DNA, 576 bp, Escherichia coli
atgaaaaaaagtctgcttggtttaaccttcgcttccttgatgttctctgccggttcagcggttgccgccgattacaaaattgacaaagaaggtcagcacgcctttgttaacttccgaatccagcatcttggctatagctggttatatggcaccttcaaagatttcgacggtacttttacctttgatgaaaaaaatccagctgccgataaagtgaatgtgacaattaacaccaccagcgtcgatactaatcacgccgaacgcgataaacatcttcgcagtgcggatttcctcaataccgcaaaatatccacaggcaacattcacctccaccagcgtgaagaaagacggtgacgaactggatattaccggcgatctgacgctgaatggtgtaaccaagcccgtcacactggaagcgaaattaattggtcagggtgacgacccgtggggcggtaaacgtgcaggctttgaggccgaaggcaaaattaagctcaaagacttcaatatcaagacagatttaggtccagcgtctcaggaagtggatctgattatttcagtggaaggcgtacagcagaagtaa

SEQ ID NO: 2800 - protein, 191 aa, Escherichia coli
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 2801 - DNA, 642 bp, Escherichia coli
ttgttatttttgtgttgcaattcattctccgacacgccattttctttctctcgcaaattcgttttggatgcacttatgtcattcacaaatacccctgaacgctatggtgttatatctgcggccttacattggctaagcgcaattattgtctatggcatgtttgctttaggtctgtggatggtcacgctcagttattacgatggctggtaccaccaggcaccggaactgcataaaagcatcggcattttgttaatgatggggctggttattcgcgttctgtggcgtgtcatatctccaccgccgggtccgctgccgagttattcgcccatgactcgtcttgcagcaaaagctggacatctcgcattgtacctattgctgttcgccatcggcatcagcggctatctgatctcaactgccgatggtaaaccgatcagcgtttttggctggtttgacgtccccgcgaccctctccgacgctggcgcacaggctgactttgccggtgccctgcatttttggctcgcgtggagcgttgtagtactgtccgttatgcacggatttatggccctgaagcatcatttcatcgataaagacgacactctgaagcgcatgctgggaaagtcgtcatctgactatggagtataa

SEQ ID NO: 2802 - protein, 213 aa, Escherichia coli
MLFLCCNSFSDTPFSFSRKFVLDALMSFTNTPERYGVISAALHWLSAIIVYGMFALGLWMVTLSYYDGWYHQAPELHKSIGILLMMGLVIRVLWRVISPPPGPLPSYSPMTRLAAKAGHLALYLLLFAIGISGYLISTADGKPISVFGWFDVPATLSDAGAQADFAGALHFWLAWSVVVLSVMHGFMALKHHFIDKDDTLKRMLGKSSSDYGV

SEQ ID NO: 2803 - DNA, 141 bp, Escherichia coli
atgaggccgtttttacaggagtatttaatgcgtcgactgttgcactatctcatcaataatattcgcgagcatctgatgctttatctttttctctggggattgttggcaattatggatctgatctatgtgttttatttttag

SEQ ID NO: 2804 - protein, 46 aa, Escherichia coli
MRPFLQEYLMRRLLHYLINNIREHLMLYLFLWGLLAIMDLIYVFYF

SEQ ID NO: 2805 - DNA, 1119 bp, Escherichia coli
atgaaatacgatctcatcattattggcagcggttccgtaggcgctgccgccgggtattatgcaacccgcgccggtttaaacgtgctaatgaccgacgcccatatgccaccgcatcaacacggcagccaccacggcgatacgcgattaattcgccatgcttatggtgaaggcgaaaagtatgtcccgctggtcctccgcgcgcaaatgctgtgggatgaactttcccgccacaacgaagatgatcccatttttgtacgctctggtgtcattaacctcggtccggctgactccgcatttctcgccaacgtcgcccacagcgccgaacagtggcaactcaacgttgaaaagctcgacgcgcaagggattatggcccgctggccagaaatacgcgtcccggacaactacatcggtttatttgaaactgattccggttttttgcgcagcgaactggcgattaaaacctggatccaactggcgaaggaagcgggctgtgcgcagctgttcaactgcccggtcaccgcaattcgtcatgacgatgatggcgtaactattgaaacggctgacggtgagtatcaggcgaaaaaagcgattgtctgcgcgggaacatgggtaaaagacctactcccggagctgcctgtccagcccgtacgcaaagtatttgcctggtatcaggccgatggtcgctatagcgtgaagaataaattcccggcgtttaccggtgaactgcccaatggcgatcaatattatggttttccggcagaaaacgacgcgttgaagattggcaaacataacggaggccaggttatccattcagcggatgaacgtgttccgtttgcggaagtggtcagcgatggttcggaagccttcccgttcttgcgcaatgtgttgccgggtatcggttgctgcctgtacggcgctgcctgcacctatgataattcgcctgacgaagattttattatcgataccctacccggccacgataatacactgctcattaccggcctgagtgggcacggttttaaatttgcgtcagttttaggggaaatagctgccgattttgcgcaagacaaaaaaagcgattttgatttgacgccattcaggctttcccgcttccaataa

SEQ ID NO: 2806 - protein, 372 aa, Escherichia coli
MKYDLIIIGSGSVGAAAGYYATRAGLNVLMTDAHMPPHQHGSHHGDTRLIRHAYGEGEKYVPLVLRAQMLWDELSRHNEDDPIFVRSGVINLGPADSAFLANVAHSAEQWQLNVEKLDAQGIMARWPEIRVPDNYIGLFETDSGFLRSELAIKTWIQLAKEAGCAQLFNCPVTAIRHDDDGVTIETADGEYQAKKAIVCAGTWVKDLLPELPVQPVRKVFAWYQADGRYSVKNKFPAFTGELPNGDQYYGFPAENDALKIGKHNGGQVIHSADERVPFAEVVSDGSEAFPFLRNVLPGIGCCLYGAACTYDNSPDEDFIIDTLPGHDNTLLITGLSGHGFKFASVLGEIAADFAQDKKSDFDLTPFRLSRFQ

SEQ ID NO: 2807 - DNA, 255 bp, Escherichia coli
atggaaaaaaataatgaagtcattcagactcatccgctcgtagggtgggacatcagcaccgttgatagctatgatgcgctgatgttgcgtttgcactaccagaccccaaataagtccgagcaggaagggactgaagttggtcagacgctctggttaaccactgatgttgccagacaatttatttcgatattagaagcaggaatcgccaaaattgaatccggtgatttccaggtaaacgagtatcggcgtcattaa

SEQ ID NO: 2808 - protein, 84 aa, Escherichia coli
MEKNNEVIQTHPLVGWDISTVDSYDALMLRLHYQTPNKSEQEGTEVGQTLWLTTDVARQFISILEAGIAKIESGDFQVNEYRRH

SEQ ID NO: 2809 - DNA, 303 bp, Escherichia coli
ttgtcattaggttattttacctgtataaataaccagtatattcaacagggggctattatgcgaattgaagtcaccatagcgaaaacttctccattgccagctggggctattgacgccctggctggcgaactttcccgccgtattcagtatgcgtttcctgataatgaaggccacgtatcggtacgttatgccgcagcaaataatttatcggttattggcgcgacaaaagaagataaacagcgcattagcgaaattctccaggaaacgtgggaaagcgccgatgactggtttgtcagcgaataa

SEQ ID NO: 2810 - protein, 100 aa, Escherichia coli
MSLGYFTCINNQYIQQGAIMRIEVTIAKTSPLPAGAIDALAGELSRRIQYAFPDNEGHVSVRYAAANNLSVIGATKEDKQRISEILQETWESADDWFVSE

SEQ ID NO: 2811 - DNA, 1047 bp, Escherichia coli
atgactgcaccatcccaggtattaaagatccgccgcccagacgactggcaccttcacctccgcgatggcgacatgttaaaaactgtcgtgccgtataccagcgaaatttatggacgggctatcgtaatgcccaatctggctccgcccgtgaccaccgttgaggctgccgtggcgtatcgtcagcgcattcttgacgccgtacctgccgggcacgatttcaccccgctgatgacctgttatttaacagattcgctggatccgaatgagctggagcgcggatttaacgaaggcgtgttcaccgctgcaaaactttatccggcaaacgcaaccactaactccagccacggcgttacgtcagttgacgcaatcatgccggtacttgagcgcatggaaaaaatcggtatgccactactggtgcatggtgaagtaacacatgcagatatcgacatttttgatcgtgaagcgcgctttatagaaagcgtgatggaaccgctgcgccagcgcctgactgcactgaaagtcgtttttgagcacatcaccaccaaagacgctgccgactatgtccgtgacggaaatgaacggctggctgccaccatcactccacagcatctgatgtttaaccgcaaccatatgctggttggtggcgtgcgtccgcacctgtattgtctacccatcctcaaacgcaatatccaccaacaggcattgcgtgaactggtcgccagcggttttaatcgtgtattcctcggaacggattctgcgccacatgcacgtcatcgcaaagagagcagctgcggctgcgcgggctgtttcaacgccccaaccgcgctgggcagttacgctaccgtctttgaagagatgaatgctttgcagtactttgaagcattctgttctgtaaacggcccgcagttctatggcttgccggtcaacgacacattcatcgaactggtacgtgaagagcaacaggttgctgaaagcatcgcactgactgatgacacgctggtgccattcctcgccggagaaacggtacgctggtccgttaaacaataa

SEQ ID NO: 2812 - protein, 348 aa, Escherichia coli
MTAPSQVLKIRRPDDWHLHLRDGDMLKTVVPYTSEIYGRAIVMPNLAPPVTTVEAAVAYRQRILDAVPAGHDFTPLMTCYLTDSLDPNELERGFNEGVFTAAKLYPANATTNSSHGVTSVDAIMPVLERMEKIGMPLLVHGEVTHADIDIFDREARFIESVMEPLRQRLTALKVVFEHITTKDAADYVRDGNERLAATITPQHLMFNRNHMLVGGVRPHLYCLPILKRNIHQQALRELVASGFNRVFLGTDSAPHARHRKESSCGCAGCFNAPTALGSYATVFEEMNALQYFEAFCSVNGPQFYGLPVNDTFIELVREEQQVAESIALTDDTLVPFLAGETVRWSVKQ

SEQ ID NO: 2813 - DNA, 618 bp, Escherichia coli
gtgacacatgctgcgttgtgtcaggatattgacgcagatttcatgtcgaggactaccatgaacaagtttttatttgccgctgcattgatcgtcagtggcctgctcgttggctgtaatcaactcacccaatacaccatcaccgaacaagaaattaaccagtcgcttgcgaaacataataatttctcaaaagatatcggtttacccggcgtggctgacgcccatattgttctgacaaacctgaccagccaaattggtcgcgaagagccgaataaggttaccctaaccggagacgccaatctggacatgaactccctgttcggtagccagaaagcgaccatgaaactgaagctgaaagcgctgcccgtgtttgataaagaaaaaggcgcgatcttcctgaaagagatggaagtggtcgatgcgacggtacaaccggaaaaaatgcaaacggtgatgcaaacgttgcttccctatttaaaccaggcattacgcaattactttaaccagcaacctgcttacgtcctgcgcgaagatggcagccagggcgaagcaatggcgaagaaactggcgaaaggcattgaagtgaagccaggcgaaattgtcattccgtttactgattaa

SEQ ID NO: 2814 - protein, 205 aa, Escherichia coli
MTHAALCQDIDADFMSRTTMNKFLFAAALIVSGLLVGCNQLTQYTITEQEINQSLAKHNNFSKDIGLPGVADAHIVLTNLTSQIGREEPNKVTLTGDANLDMNSLFGSQKATMKLKLKALPVFDKEKGAIFLKEMEVVDATVQPEKMQTVMQTLLPYLNQALRNYFNQQPAYVLREDGSQGEAMAKKLAKGIEVKPGEIVIPFTD

SEQ ID NO: 2815 - DNA, 648 bp, Escherichia coli
gtgaagctatacatttacgatcactgcccttactgcctcaaagcccgcatgattttcggcctgaaaaatatccccgtcgaattacatgttctgctcaacgacgacgcagaaacacccacccggatggtcggtcaaaaacaggttcccattctgcaaaaagatgacagccgctatatgccagaaagcatggacatcgttcactatgtcgataaactcgacggcaaaccgttactgaccggcaaacgttcccctgccattgaagagtggctgcgcaaggtcaatggctacgccaacaaactgctgttgccgcgttttgccaaatcggcatttgatgagttttctactcctgccgcgcgcaaatatttcgtcgacaagaaagaggccagcgcgggtaattttgccgacctgctggcccactctgacggtctgattaagaatatcagcgatgatttacgtgcgctggacaaactgatcgtcaaaccgaacgccgtgaatggcgaactttcggaagatgatattcagctatttccgctcctgcgtaatctgacgctagtagccggaatcaactggccaagccgcgttgctgattaccgcgataatatggcgaaacagacacaaatcaatttgttatcatcaatggcgatttaa

SEQ ID NO: 2816 - protein, 215 aa, Escherichia coli
MKLYIYDHCPYCLKARMIFGLKNIPVELHVLLNDDAETPTRMVGQKQVPILQKDDSRYMPESMDIVHYVDKLDGKPLLTGKRSPAIEEWLRKVNGYANKLLLPRFAKSAFDEFSTPAARKYFVDKKEASAGNFADLLAHSDGLIKNISDDLRALDKLIVKPNAVNGELSEDDIQLFPLLRNLTLVAGINWPSRVADYRDNMAKQTQINLLSSMAI

SEQ ID NO: 2817 - DNA, 1209 bp, Escherichia coli
atgtcccgcgtgtcgcaggcgaggaacctgggtaaatatttcctgctcatcgataatatgctggtcgtgctggggttctttgttgtcttcccgctgatctctatccgcttcgttgatcaaatgggctgggccgccgtcatggtcggtattgccctcggtctacgccagtttattcagcaaggtctgggtattttcggcggcgcaattgccgaccgctttggtgccaaaccgatgattgtcaccggtatgctgatgcgtgccgccggattcgccacaatgggtatcgcccacgaaccgtggctactgtggttttcatgcctgctttcgggactcggcggcacgttgtttgatcctccgcgttcggcgctggtggtgaaattaatccgtccacagcagcgtggtcgttttttctcgctgttgatgatgcaggacagtgccggtgcggtcattggcgcattgttggggagctggctgttgcaatacgactttcgcctggtctgcgccacaggggcagttttgtttgtgctgtgtgcagcgttcaatgcgtggttgttaccggcatggaaactctccaccgtgcgcacgcccgttcgcgaaggcatgacccgcgtgatgcgcgacaagcgttttgtcacctatgtcctgacgctggcgggttactacatgctggctgtacaagtgatgctgatgctgccaattatggtcaacgacgtggctggcgcgccctctgccgttaaatggatgtatgccattgaagcgtgtctgtcgttaacgttgctctaccctatcgcccgctggagtgaaaagcattttcgtctggaacaccggttaatggctgggctgttgataatgtcattaagcatgatgccagtaggcatggtcagcggcctgcaacaacttttcaccctgatttgtctgttttatatcgggtcgatcattgccgagcctgcgcgtgaaaccttaagtgcttcgctggcagacgcaagagctcgcggcagctatatggggtttagccgtctgggtctggcgattggcggcgctattggttatatcggtggcggctggctgtttgacctgggcaaatcggcgcaccagccagagcttccgtggatgatgctgggcattattggcatcttcactttccttgcgctgggttggcagtttagccagaaacgcgccgcgcgtcgtttgcttgaacgcgacgcctga

SEQ ID NO: 2818 - protein, 402 aa, Escherichia coli
MSRVSQARNLGKYFLLIDNMLVVLGFFVVFPLISIRFVDQMGWAAVMVGIALGLRQFIQQGLGIFGGAIADRFGAKPMIVTGMLMRAAGFATMGIAHEPWLLWFSCLLSGLGGTLFDPPRSALVVKLIRPQQRGRFFSLLMMQDSAGAVIGALLGSWLLQYDFRLVCATGAVLFVLCAAFNAWLLPAWKLSTVRTPVREGMTRVMRDKRFVTYVLTLAGYYMLAVQVMLMLPIMVNDVAGAPSAVKWMYAIEACLSLTLLYPIARWSEKHFRLEHRLMAGLLIMSLSMMPVGMVSGLQQLFTLICLFYIGSIIAEPARETLSASLADARARGSYMGFSRLGLAIGGAIGYIGGGWLFDLGKSAHQPELPWMMLGIIGIFTFLALGWQFSQKRAARRLLERDA

SEQ ID NO: 2819 - DNA, 585 bp, Escherichia coli
atgtttggctatcgcagtaacgtgccaaaagtgcgcttaaccacagaccgactggtcgtgcgtctggtgcatgatcgtgatgcctggcgtctggcggattattacgcagagaatcgccatttcctcaagccctgggagccagtgcgcgacgaaagccactgttatccatcaggctggcaggccaggctagggatgattaacgaatttcataaacaaggttcagctttctactttggcttattcgacccggacgaaaaagagattattggcgttgccaatttttccaatgttgttcgcggctcttttcatgcctgctatctcggttattcgattgggcaaaaatggcagggcaaaggactcatgtttgaagctctgagcgcagccattcgttatatgcagcgcacccaacatattcatcgcattatggctaattatatgccgcacaataaacgcagcggtgatttactggcgcgactgggttttgaaaaagaaggctatgcgaaagactatctgttgattgatggacaatggcgcgatcacgtactgacggcattaactaccccagactggacgcccggccgctaa

SEQ ID NO: 2820 - protein, 194 aa, Escherichia coli
MFGYRSNVPKVRLTTDRLVVRLVHDRDAWRLADYYAENRHFLKPWEPVRDESHCYPSGWQARLGMINEFHKQGSAFYFGLFDPDEKEIIGVANFSNVVRGSFHACYLGYSIGQKWQGKGLMFEALSAAIRYMQRTQHIHRIMANYMPHNKRSGDLLARLGFEKEGYAKDYLLIDGQWRDHVLTALTTPDWTPGR

SEQ ID NO: 2821 - DNA, 648 bp, Escherichia coli
atgaaatatcaacttactgccctggaagctcgcgtgattggttgcttgctggaaaaacaggtgaccacgccggagcaatacccgctctcagtcaatggtgtagtcacggcctgtaatcagaaaacgaaccgtgaaccggtcatgaatctgagtgaatccgaggtgcaggagcaactggataatctggtcaaacgccattatctgcgcacggtgagtggctttggtaatcgggtcaccaaatatgaacaacgtttttgtaattcagaatttggcgatctgaaactgagcgccgcagaagtggcgttaatcaccacgttgttattgcgtggtgcccagacgccgggtgaactgcgcagccgcgccgcgcgaatgtatgaattcagcgatatggcggaagtggagtcgacgctggaacaactggcaaatcgcgaagatggtccttttgtggtgcgtctggcccgcgaaccgggtaaacgtgaaagccgctacatgcatcttttcagtggtgaggttgaagatcagccggcggtgatggatatgtcgaacgcggttgacggtgatttacaggcacgcgtcgaagccctggaaatcgaagtggcagaactgaaacagcgtcttgattcgttgctggcccatctgggagattaa

SEQ ID NO: 2822 - protein, 215 aa, Escherichia coli
MKYQLTALEARVIGCLLEKQVTTPEQYPLSVNGVVTACNQKTNREPVMNLSESEVQEQLDNLVKRHYLRTVSGFGNRVTKYEQRFCNSEFGDLKLSAAEVALITTLLLRGAQTPGELRSRAARMYEFSDMAEVESTLEQLANREDGPFVVRLAREPGKRESRYMHLFSGEVEDQPAVMDMSNAVDGDLQARVEALEIEVAELKQRLDSLLAHLGD

SEQ ID NO: 2823 - DNA, 924 bp, Escherichia coli
gtgaaaaaattacgtatcggcgtagtggggttaggcggcatcgcgcaaaaagcgtggttaccggtgctggcggcagcgtctgactggacgttacaaggtgcgtggtcgcctacgcgcgccaaagccttgccaatttgtgacagctggcgcattccttatgctgattcgttatccagccttgccgccagttgcgatgcggtttttgtgcattccagcaccgccagccactttgacgtggtcagtacgttactcaatgcgggggtacatgtctgtgtcgataaaccgctggcagaaaatctgcgcgatgctgaacggctggtggaactggcggcgcggaaaaaactaacgttgatggtcggttttaaccgtcgtttcgcaccactctacggtgagttaaaaacgcaactcgccaccgcagcctcgctaagaatggataaacatcgtagcaatagcgtcgggccacacgatctttatttcacgttgctggatgattatctgcatgtggtggataccgcgctgtggttgtcgggcggcaaagcctctctggatggcggtacgctactgactaacgacgctggcgaaatgctgtttgccgagcaccatttttcggccggtcctttgcagatcaccacctgtatgcatcgccgtgccggaagccagcgtgaaaccgtgcaggccgtgactgacggtgcgctcatcgacattacggatatgcgcgaatggcgtgaggagcgtgggcagggtgtagtgaataaaccgattcctggttggcagagtacgcttgagcaacgtggatttgtcggctgtgcgcggcacttcattgaatgcgtgcaaaatcagacagttccgcaaaccgccggcgaacaggcagtgctggcgcaacgtatcgttgacaagatctggcgcgatgcgatgagtgaataa

SEQ ID NO: 2824 - protein, 307 aa, Escherichia coli
MKKLRIGVVGLGGIAQKAWLPVLAAASDWTLQGAWSPTRAKALPICDSWRIPYADSLSSLAASCDAVFVHSSTASHFDVVSTLLNAGVHVCVDKPLAENLRDAERLVELAARKKLTLMVGFNRRFAPLYGELKTQLATAASLRMDKHRSNSVGPHDLYFTLLDDYLHVVDTALWLSGGKASLDGGTLLTNDAGEMLFAEHHFSAGPLQITTCMHRRAGSQRETVQAVTDGALIDITDMREWREERGQGVVNKPIPGWQSTLEQRGFVGCARHFIECVQNQTVPQTAGEQAVLAQRIVDKIWRDAMSE

SEQ ID NO: 2825 - DNA, 1575 bp, Escherichia coli
ttgcaggcgttttgcccgtgggtctggattagaacaccgatgaatttattaaaatcgctggccgccgtcagctcgatgaccatgttttcgcgtgtgcttggcttcgcacgtgacgcaattgtcgccagaatctttggcgcagggatggcaaccgacgcctttttcgtcgcttttaaacttcctaacttgttacgccgtatctttgccgaaggggcattttcccaggcatttgtaccgattctggcggaatataaaagtaagcagggtgaagacgccacgcgggtctttgtctcttatgtttctggcctgctgacacttgcgctggcggttgtgacggtcgctggcatgctcgccgcaccgtgggtgatcatggtgaccgcgccaggcttcgctgacacagctgacaaatttgccctgaccagccagctactaaagattacctttccctatatcttgctgatctccctggcgtcgctggtgggagcgattctgaatacgtggaaccgcttctcgattccggcgtttgctccaacactgcttaacatcagcatgattggtttcgcgctgtttgccgcaccgtactttaacccaccggtgctggcgctggcgtgggctgttacggtcggcggcgtcctgcagctggtgtatcagctaccgcacctgaagaagatcggcatgctggtcctgccgcgcattaacttccacgatgccggagcaatgcgcgtggtgaaacagatgggaccggcaatccttggcgtctctgtgagtcagatctccttaatcatcaacaccatttttgcctcgtttcttgcttccggttcggtgtcttggatgtattacgccgaccgcttaatggagtttccgtccggtgtactgggcgtggcgcttggcaccattttgctgccgtcgctgtcgaaaagttttgccagtggcaatcatgatgaatacaaccgtttgatggactgggggctgcgtctttgtttcctgttggcgctgccgagtgcggttgcgttgggcattctttcaggtccgttgaccgtttcgctgtttcagtacggtaaatttaccgcctttgatgcgctgatgacccagcgggcgttaattgcctactcggtgggtttgattggcctgattgtagtgaaagtgttggctcctggcttttattcccgccaggacattaaaacgccagtgaaaattgccatcgttacgctgattttaacgcaattgatgaacctggcgtttattggtccgttgaaacatgccgggctgtcactttctattggtctggcggcgtgtctgaatgcttcgctgctttactggcagttgcgtaagcagaaaatctttaccccgcaacctggctggatggcgtttctgttgcgtctggtggtggcggtactggtgatgtctggtgtgcttttaggtatgttacatatcatgccggagtggtcattgggtaccatgccctggcgcttactgcgtttaatggcggtcgtgctggcggggattgctgcgtactttgctgcactggcggtactgggcttcaaagttaaagagtttgcccgccggacggtgtaa

SEQ ID NO: 2826 - protein, 524 aa, Escherichia coli
MQAFCPWVWIRTPMNLLKSLAAVSSMTMFSRVLGFARDAIVARIFGAGMATDAFFVAFKLPNLLRRIFAEGAFSQAFVPILAEYKSKQGEDATRVFVSYVSGLLTLALAVVTVAGMLAAPWVIMVTAPGFADTADKFALTSQLLKITFPYILLISLASLVGAILNTWNRFSIPAFAPTLLNISMIGFALFAAPYFNPPVLALAWAVTVGGVLQLVYQLPHLKKIGMLVLPRINFHDAGAMRVVKQMGPAILGVSVSQISLIINTIFASFLASGSVSWMYYADRLMEFPSGVLGVALGTILLPSLSKSFASGNHDEYNRLMDWGLRLCFLLALPSAVALGILSGPLTVSLFQYGKFTAFDALMTQRALIAYSVGLIGLIVVKVLAPGFYSRQDIKTPVKIAIVTLILTQLMNLAFIGPLKHAGLSLSIGLAACLNASLLYWQLRKQKIFTPQPGWMAFLLRLVVAVLVMSGVLLGMLHIMPEWSLGTMPWRLLRLMAVVLAGIAAYFAALAVLGFKVKEFARRTV

SEQ ID NO: 2827 - DNA, 417 bp, Escherichia coli
atgacgcgtcttgcagagatcctcgaccagatgtccgctgtgcttaacgatctcaaaacggtaatggatcaagagcagcaacatctctctatggggcagatcaacggcagccagttgcaatggattacagaacaaaaaagctcactgctggcgacgctggattacctcgaacagttacgcaggaaagaacccaatacagcaaatagcgttgatattagtcaacgctggcaggaaattactggcaaaactcagcaactacgccaactgaatcaacataacggctggttactggaaggacagattgagcgcaatcaacaggcgctggaaatgttgaaaccgcatcaggaaccgacgctatatggagcgaacggtcagacctcaacaacccatcgcggcagtaaaaagatttcgatctga

SEQ ID NO: 2828 - protein, 138 aa, Escherichia coli
MTRLAEILDQMSAVLNDLKTVMDQEQQHLSMGQINGSQLQWITEQKSSLLATLDYLEQLRRKEPNTANSVDISQRWQEITGKTQQLRQLNQHNGWLLEGQIERNQQALEMLKPHQEPTLYGANGQTSTTHRGSKKISI

SEQ ID NO: 2829 - DNA, 294 bp, Escherichia coli
atgagtattgatcgcacttcgcctctgaagccagtaagcaccgttcaaccgcgcgaaaccactgacgcgccggtaacaaacacccgagcggcaaaaacaacagcctccaccagcaccagtgtgacgttaagcgacgcgcaagcaaaactgatgcaacccggcagcagcgatatcaatcttgaacgtgtcgaagcgttaaaactggcgattcgtaacggtgaactaaaaatggacaccggcaaaattgccgatgcgctgatcaacgaagcgcagcaagacttgcagagtaattga

SEQ ID NO: 2830 - protein, 97 aa, Escherichia coli
MSIDRTSPLKPVSTVQPRETTDAPVTNTRAAKTTASTSTSVTLSDAQAKLMQPGSSDINLERVEALKLAIRNGELKMDTGKIADALINEAQQDLQSN

SEQ ID NO: 2831 - DNA, 660 bp, Escherichia coli
atgctgacaataaaacgtagcgtggcgatcatcgcgatactgttcagtccgttaagtgcggcgagcaatctcacatcgcaattgcacaccttttttagcgcccagctcgcgggggtaagtgatgaggttcgtgtttctattcgtacagcgcccaatctactaccgccgtgcgagcagccattgctttcgatgagcaataattcccgcctgtggggcaatgtgaatgtgttggcacgctgcggtaacgacaaacgatatttacaggttaatgtacaggccacaggaaattatgtggttgccgcgatgcccattgtgcgtggaggaaagctggaagctggcaatgtcaaactgaaacgcggccgactggataccttgccaccgcgtacggtgctggatatcaatcaacttgttgatgccgttagcctgcgcgatctatcacccgatcaacctatccagttaacccactttcgccaggcatggcgggtaaaagcgggacaacgtgtcaacgtgatcgccagcggtgatgggtttagcgccaacgcagaaggtcaggcgctgaacaatgcagccgtcgcacagaatgcgcgggtgcgcatgatatcgggacaagtggtcagcggcgttgttgatgcagatgggaatattcttataaacctgtaa

SEQ ID NO: 2832 - protein, 219 aa, Escherichia coli
MLTIKRSVAIIAILFSPLSAASNLTSQLHTFFSAQLAGVSDEVRVSIRTAPNLLPPCEQPLLSMSNNSRLWGNVNVLARCGNDKRYLQVNVQATGNYVVAAMPIVRGGKLEAGNVKLKRGRLDTLPPRTVLDINQLVDAVSLRDLSPDQPIQLTHFRQAWRVKAGQRVNVIASGDGFSANAEGQALNNAAVAQNARVRMISGQVVSGVVDADGNILINL

SEQ ID NO: 2833 - DNA, 417 bp, Escherichia coli
atgctcgataagctcgacgccgccttacgttttcaacaagaggcgctcaatctgcgcgcccagcgtcaggaagtgctggcagcaaacatcgccaatgccgatacccctggttatcaggctcgcgatatcgattttgccagtgaacttaaaaaagtcatgcaacgtggacgggatgcaaccagtgtggttgctctgacgatgacctcaacgaaacacattccggcgcaggcgctgacgcctccttccgcagaactgcaataccgtattccggaccagccttcgcttgacggtaatactgtcgatatggatcgcgaacgcacccagtttgccgataacagcctgcaataccagatgagccttagcgcgttgagcgggcagatcaaaggcatgatgaacgttttacagagcggaaattaa

SEQ ID NO: 2834 - protein, 138 aa, Escherichia coli
MLDKLDAALRFQQEALNLRAQRQEVLAANIANADTPGYQARDIDFASELKKVMQRGRDATSVVALTMTSTKHIPAQALTPPSAELQYRIPDQPSLDGNTVDMDRERTQFADNSLQYQMSLSALSGQIKGMMNVLQSGN

SEQ ID NO: 2835 - DNA, 405 bp, Escherichia coli
atggcactgctgaatatttttgatatcgccgggtcggcgttaactgcccagtcccagcgcctgaacgtggcggccagtaatctggcgaatgctgatagcgtcaccggtcccgatggacagccatatcgggcaaaacaggtggtattccaggttaacgctgcgccaggtgctgcgacaggcggcgtaaaggttgccgatgttatagaaagtcaggccccggacaaactggtttatgaaccgggtaatccgctggcggatgcaaagggctacgtgaaaatgccaaacgttgatgtcgtcggagagatggttaacaccatgtcggcgtcacgcagttatcaggccaatgttgaagtgctcaacacggtgaaaagtatgatgctgaaaacccttacgctcggtcaataa

SEQ ID NO: 2836 - protein, 134 aa, Escherichia coli
MALLNIFDIAGSALTAQSQRLNVAASNLANADSVTGPDGQPYRAKQVVFQVNAAPGAATGGVKVADVIESQAPDKLVYEPGNPLADAKGYVKMPNVDVVGEMVNTMSASRSYQANVEVLNTVKSMMLKTLTLGQ

SEQ ID NO: 2837 - DNA, 696 bp, Escherichia coli
atgtccattgcggtaaccaccaccgatccgacgaataccggcgtcagtaccaccagcagtagttcgctcacgggcagcaacgccgcagatttacaaagcagttttctgactttgttggtggcgcagctgaaaaaccaggacccgaccaatccaatggaaaacaacgagctgacgtcgcaattggcacaaatcagcacggtcagtgggattgaaaaactcaataccacgcttggatctatttccggacagattgataacagccagtcgttacaggccagtaacctgattggtcacggcgtgatgatccccggtaccactgttcttgcgggaaccggcagtgaagaaggggctgtgaccacgaccacgccgtttggtgttgagttgcaacaggcggcagacaaagtgacggccaccatcaccgataaaaacggcgcggtcgtccgtaccattgatatcggtgaactgactgccggagtccacagtttcacctgggacggtacgttgactgacggcagcactgcgccgaacggttcttacaatgtagcgattagcgccagtaacggtggtacacaactggttgcccagccgctgcagtttgctctggtgcagggtgtgatccgcggcaacaacggtaatacgctggatctcggcacttacggcaccaccaccctcgacgaagtacggcagataatttaa

SEQ ID NO: 2838 - protein, 231 aa, Escherichia coli
MSIAVTTTDPTNTGVSTTSSSSLTGSNAADLQSSFLTLLVAQLKNQDPTNPMENNELTSQLAQISTVSGIEKLNTTLGSISGQIDNSQSLQASNLIGHGVMIPGTTVLAGTGSEEGAVTTTTPFGVELQQAADKVTATITDKNGAVVRTIDIGELTAGVHSFTWDGTLTDGSTAPNGSYNVAISASNGGTQLVAQPLQFALVQGVIRGNNGNTLDLGTYGTTTLDEVRQII

SEQ ID NO: 2839 - DNA, 1206 bp, Escherichia coli
atggccttttctcaagcggttagcggattaaacgctgccgccaccaacctcgatgttattggcaacaatatcgccaactccgccacctacggctttaaatcaggcacggcctcttttgccgatatgtttgccggttcgaaagtgggactgggggtaaaagttgccggtatcacccaggactttaccgatggcacgaccaccaacaccgggcgaggtctggacgttgctatcagccagaacggttttttccgtctggtagacagcaacggttcggtgttctacagccgtaatggacaatttaagctggatgaaaaccgtaacctggtgaatatgcaaggtttacagctgacggggtacccggcaaccggtacgccgccgactattcagcaaggggcgaatccgaccaatatttcgatcccgaataccctgatggcagcgaaaactaccaccacggcgtcaatgcagatcaacctgaattccagtgattcgcttccctctgttaacgcatttgatgccagcaatgcggatagctataacaaaaaaggttcggtgactgttttcgatagtcagggtaatgctcatgatatgagcgtgtactttgtgaagaccggggataataactggcaggtctacacccaggatagtagtgatccaaacagcattgcgaagacagcgacaacactggtgtttaatgccaatggcgttctgacctcaaatccaacagcgaatatttccactggcgcaattaacggcgcagatcccgccacgtttagcctgagcttcctcaactccatgcagcaaaataccggcgctaacaacattgtggcaaccacccagaacggctacaaaccgggcgatctggtgagttatcaaatcaatgatgacggtacggttgtcggcaactattccaacgaacaaacccaactgctggggcagattgtactggcgaactttgccaacaacgaaggtctggcatccgaaggcgacaacgtctggtccgctacgcaatcttctggcgtggcgctgttggggacagccgggacgggcaactttggcacactgaccaacggtgcgctggaagcgtccaacgtcgatctcagtaaagaactggtcaatatgatcgttgcccagcgtaactatcagtctaacgcccagaccatcaaaacccaggaccagatcctcaatacgctggttaacttacgctaa

SEQ ID NO: 2840 - protein, 401 aa, Escherichia coli
MAFSQAVSGLNAAATNLDVIGNNIANSATYGFKSGTASFADMFAGSKVGLGVKVAGITQDFTDGTTTNTGRGLDVAISQNGFFRLVDSNGSVFYSRNGQFKLDENRNLVNMQGLQLTGYPATGTPPTIQQGANPTNISIPNTLMAAKTTTTASMQINLNSSDSLPSVNAFDASNADSYNKKGSVTVFDSQGNAHDMSVYFVKTGDNNWQVYTQDSSDPNSIAKTATTLVFNANGVLTSNPTANISTGAINGADPATFSLSFLNSMQQNTGANNIVATTQNGYKPGDLVSYQINDDGTVVGNYSNEQTQLLGQIVLANFANNEGLASEGDNVWSATQSSGVALLGTAGTGNFGTLTNGALEASNVDLSKELVNMIVAQRNYQSNAQTIKTQDQILNTLVNLR

SEQ ID NO: 2841 - DNA, 756 bp, Escherichia coli
atggatcacgcaatttataccgcgatgggagcagccagccagacgctgaatcaacaggcggtaaccgccagtaatctggccaatgcctctacgcccggttttcgcgcgcagttaaacgccttgcgcgcagtgccggtggaagggctttcactgcccacgcgcacgctggtaacggcgtcaacaccgggtgcagacatgacacccggcaagatggattacacctcgcgcccgctggacgttgcgttgcagcaggatggttggctggccgtgcagaccgctgacggcagtgaagggtatacgcgtaatggcagcattcaggttgatcccaccgggcaactgacaattcagggacatccggtggtaggcgaggcggggccaattgctgtgccggaaggggcggaaatcactattgctgccgatggcacaatctcggcgctgaatccgggcgatccggcaaatacggttgcgccagtggggcgtctgaagctggtgaaagccacgggcagcgaagtccagcgcggtgacgatggcatttttcgtttaagcgcagaaagccaggctacgcgtgggccggtactgcaggcagatccaaccttgcgtgtgatgtcgggggttctggaaggcagtaacgtcaatgccgttgcggcaatgagcgacatgattgccagcgcacggcgttttgaaatgcagatgaaggtgatcagcagcgtcgatgataacgcaggccgtgccaaccaactgctgtcgatgagttaa

SEQ ID NO: 2842 - protein, 251 aa, Escherichia coli
MDHAIYTAMGAASQTLNQQAVTASNLANASTPGFRAQLNALRAVPVEGLSLPTRTLVTASTPGADMTPGKMDYTSRPLDVALQQDGWLAVQTADGSEGYTRNGSIQVDPTGQLTIQGHPVVGEAGPIAVPEGAEITIAADGTISALNPGDPANTVAPVGRLKLVKATGSEVQRGDDGIFRLSAESQATRGPVLQADPTLRVMSGVLEGSNVNAVAAMSDMIASARRFEMQMKVISSVDDNAGRANQLLSMS

SEQ ID NO: 2843 - DNA, 783 bp, Escherichia coli
atgatcagttcattatggatcgccaaaacgggccttgacgcccagcaaaccaatatggacgtcattgccaacaacctggcaaacgttagtaccaacggttttaagcgtcagcgcgcggtgtttgaagatctgctttatcaaaccattcgccagccgggggcacagtcttccgaacaaaccaccttaccatccggattacaaatcggtacgggggtacgcccggtcgccacggaacgtttacacagccagggcaacctgtcgcaaaccaataacagtaaagacgtcgcgattaaagggcagggctttttccaggtgatgttgccagatggctcatcagcctatacccgtgacggctctttccaggtggatcagaacgggcagctggtgacggccggtggttttcaggtgcagccagcgatcaccattccggcgaatgcgttaagtatcaccatcggtcgtgatggcgtggtcagcgtaacccaacaaggccaggcagctccggttcaggttgggcagctcaatctcaccacctttatgaatgacaccggactggagagcattggcgaaaacctctacaccgaaacgcaatcctccggtgcaccgaacgaaagcacgccgggcctgaacggcgcgggactgctgtatcaagggtatgttgaaacgtctaacgtcaacgtggcggaagaactggtcaatatgattcaggtgcaacgcgcttacgaaatcaacagtaaagcggtgtccaccaccgatcagatgctgcaaaaactgacgcaactctaa

SEQ ID NO: 2844 - protein, 260 aa, Escherichia coli
MISSLWIAKTGLDAQQTNMDVIANNLANVSTNGFKRQRAVFEDLLYQTIRQPGAQSSEQTTLPSGLQIGTGVRPVATERLHSQGNLSQTNNSKDVAIKGQGFFQVMLPDGSSAYTRDGSFQVDQNGQLVTAGGFQVQPAITIPANALSITIGRDGVVSVTQQGQAAPVQVGQLNLTTFMNDTGLESIGENLYTETQSSGAPNESTPGLNGAGLLYQGYVETSNVNVAEELVNMIQVQRAYEINSKAVSTTDQMLQKLTQL

SEQ ID NO: 2845 - DNA, 714 bp, Escherichia coli
ttgaagatgatagccatgcaaaaaaacgctgcgcatacttatgccatttccagcttgttggtgctttcactaaccggctgcgcctggataccctccacgccgctggtacaaggggcgaccagtgcacaaccggttcccggtccgacgcccgtcgccaacgggtctattttccagtctgctcagccgattaactatggctatcaaccgctgtttgaagatcgtcgaccacgcaatattggcgatacgctgactatcgtgttgcaggagaacgtcagcgccagcaaaagctcctctgcgaatgccagccgtgacggtaaaactaattttggctttgatactgtgccgcgctatttgcaggggttgtttggtaacgctcgtgccgatgtcgaagcctccggtggtaacacgttcaacggaaaaggcggggccaatgccagcaatacctttagcggtacgttgacggtgacggttgaccaggtactggtcaacggcaacctgcatgtggtgggtgaaaaacagatcgccattaatcagggtaccgaatttattcgcttctctggcgtggttaatccacgcactatcagcggcagcaataccgtaccatctactcaggtggcggatgcgcgcattgaatacgtaggcaatggctacattaacgaagcgcaaaatatgggctggttgcagcgtttcttccttaacctgtcgccaatgtaa

SEQ ID NO: 2846 - protein, 237 aa, Escherichia coli
MKMIAMQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 2847 - DNA, 1098 bp, Escherichia coli
gtgattaaatttctctctgcattaattcttctactggttacgacggcggctcaggctgagcgtattcgcgatctcaccagtgttcagggggtaaggcaaaactcactgattggctatggcctggtggtggggctggatggaaccggtgaccagacaacccagacgccgtttaccacacaaacgcttaataacatgctctcacagctgggaattaccgttccgacgggcaccaatatgcagctaaaaaacgtcgctgcggtaatggtgacggcgtcacttccgccgtttggacgccaggggcaaaccatcgatgtggtggtttcttccatgggtaatgccaaaagcttgcgtggcggtacgttgttgatgacaccgcttaagggcgttgacagtcaggtgtatgcgctggcgcagggcaatattctggttggcggcgcaggagcctctgctggcggtagcagtgttcaggtaaaccaactgaacggtggacggatcaccaatggtgcggttattgaacgtgaattgcccagccagtttggcgtcgggaatacccttaatttgcaacttaacgacgaagatttcagcatggcgcagcaaatcgctgacaccatcaaccgcgtgcgtggatatggcagcgccaccgcgttagatgcgcggactattcaggtgcgcgtaccaagtggcaacagttcccaggtccgtttccttgccgatatccagaatatgcaggttaatgtcaccccgcaggacgctaaagtagtgattaactcgcgcactggctcggtggtgatgaatcgcgaagtgaccctcgacagctgcgcagtagcgcaggggaatctctcggttacggtcaatcgtcaggccaatgtcagccagccagatacaccgtttggtggtggacagactgtggttactccacaaacgcagatcgatttacgccagagcggcggttcgctgcaaagcgtacgttccagcgccagcctcaataacgtggtgcgcgcgctcaatgcgctgggcgctacgccgatggatctgatgtctattttgcaatcaatgcaaagtgcgggatgtctgcgggcaaaactggaaatcatctga

SEQ ID NO: 2848 - protein, 365 aa, Escherichia coli
MIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 2849 - DNA, 972 bp, Escherichia coli
atgtctgcgggcaaaactggaaatcatctgatgatcagcgacagcaaactactggcaagtgcggcctgggatgcgcaatcactcaacgaactaaaggcgaaagcgggcgaagatccagcggcaaatatccgtccggtggcccgccaggtggaagggatgttcgtgcagatgatgttgaaaagcatgcgcgacgctttaccaaaagatggcctgttcagcagcgagcgcactcgcctgtataccagtatgtatgaccagcagattgcccaacagatgacggcgggcaaaggtctggggctggcagagatgatggttaaacagatgacgccagaacaaccattgccagaggagtccacgccagcagcaccgatgaaattcccgctcgaaactgtggtgcgttatcaaaatcaggcgctttctcagctggtgcaaaaggccgtaccacgtaactacgatgattcgttgccgggtaacagtaaagcattcctcgcgcaactctcactgcccgcccaactggcaagccagcaaagcggtgtgccacatcatttgatcctcgctcaggcggcgcttgaatctggctgggggcaacggcaaatccgccgcgaaaacggcgagccgagttacaacctgtttggcgtcaaagcctctggcaactggaaagggccagtcactgaaatcaccacgactgaatatgaaaacggcgaagcgaagaaagtaaaagcgaaatttcgggtctacagctcgtatctggaagcattgtcggattacgttgggctgttaacacgcaatccgcgctacgctgccgtgacgaccgccgtgagtgcggagcagggggcacaggccctacaggacgcgggctatgccaccgatcctcactatgcccgcaaactcaccaacatgattcagcagatgaaatcgataagcgacaaagtgagcaaaacctacagtatgaacattgataatctgttctga

SEQ ID NO: 2850 - protein, 323 aa, Escherichia coli
MSAGKTGNHLMISDSKLLASAAWDAQSLNELKAKAGEDPAANIRPVARQVEGMFVQMMLKSMRDALPKDGLFSSERTRLYTSMYDQQIAQQMTAGKGLGLAEMMVKQMTPEQPLPEESTPAAPMKFPLETVVRYQNQALSQLVQKAVPRNYDDSLPGNSKAFLAQLSLPAQLASQQSGVPHHLILAQAALESGWGQRQIRRENGEPSYNLFGVKASGNWKGPVTEITTTEYENGEAKKVKAKFRVYSSYLEALSDYVGLLTRNPRYAAVTTAVSAEQGAQALQDAGYATDPHYARKLTNMIQQMKSISDKVSKTYSMNIDNLF

SEQ ID NO: 2851 - DNA, 1644 bp, Escherichia coli
atgtccagcttgatcaataacgccatgagcggactgaacgcggcccaggcggcgttaaatacggcaagtaataatatctccagctataacgttgccggatatacccgccaaaccactattatggcgcaggccaatagcacgctgggcgctggcggctgggttggcaatggcgtctacgtttctggtgtgcagcgtgagtatgatgcatttattaccaaccagttacgtgcggcgcagacgcaaagtagcggcctgactgcccgctatgagcagatgtcgaaaatcgacaatatgctctccaccagtacctcttcgctggcaacacagatgcaggatttcttcaccagcctgcaaacgctggtaagtaacgcggaagacccggcagcgcgccaggcgctgattgggaaatcagaagggttggtgaatcagtttaaaaccaccgatcaatatctgcgcgaccaggacaaacaggtcaatatcgcgataggtgccagcgttgatcagatcaacaattacgctaaacaaatcgccagcctgaacgatcaaatctcccgcctgacaggcgtgggggcaggggcgtcacctaacaatctgctggatcaacgcgatcaactggtgagcgaattaaaccagattgttggcgtagaagtcagcgttcaggatggtggcacttataacatcacgatggccaatggctactcactggttcagggaagtacggcgcggcaacttgcggcagttccttccagcgccgacccttctcgtacgactgtcgcttatgttgataggacggcaggcaatattgagatcccggagaaattactgaataccgggtcgctgggcggcattctgacattccgttctcaggatctggaccagacgcgtaatacgcttggacaactggcgctggcatttgccgaggctttcaacacacaacacaaagccggatttgatgccaacggcgatgctggtgaagatttctttgctattggtaagcccgcggttctgcaaaacacgaaaaacaaaggtgacgttgcgatcggtgccacggtaactgatgcctccgcggtactggcgacagattacaaaatctcgttcgataataatcagtggcaggtcacccgccttgccagcaataccacttttacggtgacgccggatgccaacggtaaagtggcatttgatggtctggagttgacgtttacaggaacgcctgccgttaacgacagcttcacgctgaaaccggtaagtgacgccatcgtcaacatggatgtattaatcactgacgaagcgaaaatcgccatggcgagcgaagaagatgcgggtgatagcgacaaccgcaacggtcaggccctgctggatctgcaaagcaacagtaaaacggtgggcggtgcgaaatcctttaacgacgcttatgcctcattagtgagtgatatcgggaataaaaccgcgacgttgaaaaccagtagcgccacgcaaggtaatgtggtgacgcagctttccaatcagcagcagtcgatttccggtgtcaatctcgatgaggagtacggaaatctgcaacgttttcagcagtattacctggcgaatgcgcaggttctgcagacggcaaacgcgatttttgatgcgctgattaacattcgctaa

SEQ ID NO: 2852 - protein, 547 aa, Escherichia coli
MSSLINNAMSGLNAAQAALNTASNNISSYNVAGYTRQTTIMAQANSTLGAGGWVGNGVYVSGVQREYDAFITNQLRAAQTQSSGLTARYEQMSKIDNMLSTSTSSLATQMQDFFTSLQTLVSNAEDPAARQALIGKSEGLVNQFKTTDQYLRDQDKQVNIAIGASVDQINNYAKQIASLNDQISRLTGVGAGASPNNLLDQRDQLVSELNQIVGVEVSVQDGGTYNITMANGYSLVQGSTARQLAAVPSSADPSRTTVAYVDRTAGNIEIPEKLLNTGSLGGILTFRSQDLDQTRNTLGQLALAFAEAFNTQHKAGFDANGDAGEDFFAIGKPAVLQNTKNKGDVAIGATVTDASAVLATDYKISFDNNQWQVTRLASNTTFTVTPDANGKVAFDGLELTFTGTPAVNDSFTLKPVSDAIVNMDVLITDEAKIAMASEEDAGDSDNRNGQALLDLQSNSKTVGGAKSFNDAYASLVSDIGNKTATLKTSSATQGNVVTQLSNQQQSISGVNLDEEYGNLQRFQQYYLANAQVLQTANAIFDALINIR

SEQ ID NO: 2853 - DNA, 954 bp, Escherichia coli
atgcgtttcagtacccagatgatgtaccagcaaaacatgcgtggcatcaccaattctcaggcagaatggatgaagtacggcgaacagatgtcgacgggtaagcgagtcgttaacccttcagatgatcccattgctgcatcacaagctgttgttctctcccaggcacaggcacaaaacagccagtacacgctggcgcgtactttcgccactcaaaaagtgtcactggaagagagtgtgcttagccaggtcaccactgctatccagaatgctcaggaaaaaattgtctacgccagcaatggcaccttgagtgacgatgaccgggcctcactggctacggatattcaggggcttcgtgatcagttactgaatctggcgaacaccactgacggtaacgggcgctacatttttgccggttataaaacagagactgcgccgtttagtgaggctgacggtgattatgtcggcggaacagaaagtattaaacaacaggtcgatgcttcgcgttcgatggtgataggacatacgggcgacaaaattttcgacagtattaccagcaacgcggtagcggaaccagacggtagcgcttctgaaaccaatctttttgccatgctggatagcgccatcgcagccctgaaaacgccggtcgcggatagcgaagcggataaagaaaccgccgctgcggcactggataaaaccaaccgcggactgaaaaactcgctgaacaatgtgctgactgttcgcgcggaattaggcacgcaactgaacgaactggagtcgctggattcattaggtagcgatcgcgctttagggcaaacgcagcagatgagcgatctggttgatgtggactggaatgcaactatttcatcttacatcatgcagcaaacggcattgcaggcatcgtataaagcatttaccgatatgcagggattgtcgctcttccagctcaacaaataa

SEQ ID NO: 2854 - protein, 317 aa, Escherichia coli
MRFSTQMMYQQNMRGITNSQAEWMKYGEQMSTGKRVVNPSDDPIAASQAVVLSQAQAQNSQYTLARTFATQKVSLEESVLSQVTTAIQNAQEKIVYASNGTLSDDDRASLATDIQGLRDQLLNLANTTDGNGRYIFAGYKTETAPFSEADGDYVGGTESIKQQVDASRSMVIGHTGDKIFDSITSNAVAEPDGSASETNLFAMLDSAIAALKTPVADSEADKETAAAALDKTNRGLKNSLNNVLTVRAELGTQLNELESLDSLGSDRALGQTQQMSDLVDVDWNATISSYIMQQTALQASYKAFTDMQGLSLFQLNK

SEQ ID NO: 2855 - DNA, 3186 bp, Escherichia coli
atgaaaagaatgttaatcaacgcaactcagcaggaagagttgcgcgttgcccttgtagatgggcagcgtctgtatgacctggatatcgaaagtccagggcacgagcagaaaaaggcaaacatctacaaaggtaaaatcacccgcattgaaccgagtctggaagctgcttttgttgattacggcgctgaacgtcacggtttcctcccgctaaaagaaattgcccgcgaatatttccctgctaactacagtgctcatggtcgtcccaacattaaagatgtgttgcgtgaaggtcaggaagtcattgttcagatcgataaagaagagcgcggcaacaaaggcgcggcattaaccacctttatcagtctggcgggtagctatctggttctgatgccgaacaacccgcgcgcgggtggtatttctcgtcgtatcgaaggcgacgaccgtaccgaattaaaagaagcactggcaagccttgaactgccggaaggcatggggcttatcgtgcgcaccgctggcgtcggcaaatctgctgaggcgctgcaatgggatttaagcttccgtctgaaacactgggaagccatcaaaaaagccgctgaaagccgcccggctccgttcctgattcatcaggagagcaacgtaatcgttcgcgcattccgcgattacttacgccaggacatcggtgaaatccttatcgataacccgaaagtgctcgaactggcacgtcagcatatcgctgcattaggccgcccggatttcagcagcaaaatcaaactgtacaccggcgagatcccgctgttcagccactaccagatcgagtcgcagatcgagtccgccttccagcgtgaagttcgtctgccatccggtggttcgattgttatcgacagcaccgaagcgttaacggccatcgacatcaactccgcacgcgcgacccgcggcggcgatatcgaagaaaccgcgtttaacactaacctcgaagctgccgatgagattgctcgtcagctgcgcctgcgtgacctcggcggcctgattgttatcgacttcatcgacatgacgcctgtacgccaccagcgtgcggtagaaaaccgtctgcgtgaagcggtgcgtcaggaccgtgcgcgtattcaaatcagccatatttctcgctttggcctgctggaaatgtcccgtcagcgcctgagcccatcactgggtgaatccagccatcacgtctgcccgcgctgctccggtaccggtaccgtgcgtgacaacgaatcgctgtcgctctctattctgcgtctgatcgaagaagaagcgctgaaagagaacacccaggaagttcacgccattgttcctgtgccaatcgcttcttacctgctgaatgaaaaacgttctgcggtaaatgcgattgaaactcgtcaggacggcgtacgctgtgtgattgtgccaaacgatcagatggaaaccccgcactaccatgtgctgcgcgtgcgcaaaggggaagaaacctcaaccttaagctacatgctgccgaagctgcatgaagaagcgatggcgctgccgtctgaagaagagttcgctgaacgtaagcgtccggaacaacctgcgctggcaacctttgccatgccggatgtgccgccagctccaaccccagctgaacctgccgcgcctgttgtagccccagcacctaaagctgcaacggcaacaccagcatctcctgcacaaccagggttgttgagccgcttcttcggcgcactgaaagcgctgttcagcggtggtgaagaaaccaaaccggccgagcaatcagcaccgaaagcagaagcgaaaccggaacgtcaacaggatcgtcgcaagcctcgtcagaacaaccgccgtgaccgtaatgagcgccgcgatacccgtagtgaacgtacagaaggcagcgataatcgcgaagaaaaccgtcgtaatcgtcgccaggcacagcagcagactgccgagacgcgtgagagccgtcagcaggcagaggtaacggaaaaagcgcgtaccacagacgagcagcaagcgccgcgtcgtgaacgtagccgccgccgtaacgatgataaacgtcaggcgcaacaagaagcgaaggcgctgaatgttgaagagcaatctgttcaggaaaccgaacaggaagaacgtgtacgtccggttcagccgcgtcgtaaacagcgtcagctcaatcagaaagtgcgttacgagcaaagcgtagccgaagaagcggtagtcgcaccggtggttgaagaaactgtcgctgccgaaccaattgttcaggaagcgccagctccacgcacagaactggtgaaagtcccgctgccagtcgtagcgcaagctgcaccagaacagcaagaagagaacaatgccgataaccgtgacaacggtggcatgccgcgtcgttctcgccgctcgcctcgtcacctgcgcgtaagtggtcagcgtcgtcgtcgctatcgtgacgagcgttatccaacccagtcgccaatgccgttgaccgtagcgtgcgcgtctccggaactggcctctggcaaagtctggatccgctatccaattgtacgtccgcaagatgtacaggttgaagagcagcacgaacaggaagaagtacaagtgcagccgatggtgactgaggtccctgtcgccgccgctgtcaaacctgttgttagcgcgccagttgttgaagaagtggctgaagtcgtagaagcccccgttcaggttgccgaaccgcaacctgaagtggttgaaacgacgcatcctgaagtgattgctgccgcggtaactgaacagccgcaggtgattaccgagtctgatgttgccgtagcccaggaagttgcagaacacgcagaaccggtggttgaaccgcaggaagagacggcagatattgaagaagttgccgaaactgctgaggttgtggttgctgaacctgaagttgttgctcaacctgccgcgccagtcgtcgctgaagtcgcagcagaagttgaaacggtagctgcggttgaacctgaggtcaccgttgagcataaccacgctaccgcgccgatgacgcgcgctccggcaccggaatatgttccggaagcaccgcgtcacagtgactggcagcgccctactttcgccttcgaaggtaaaggtgccgcaggtggtcatacggcaacgcatcatgcctccgccgctcctgcgcgtccgcaacctgttgagtaa

SEQ ID NO: 2856 - protein, 1061 aa, Escherichia coli
MKRMLINATQQEELRVALVDGQRLYDLDIESPGHEQKKANIYKGKITRIEPSLEAAFVDYGAERHGFLPLKEIAREYFPANYSAHGRPNIKDVLREGQEVIVQIDKEERGNKGAALTTFISLAGSYLVLMPNNPRAGGISRRIEGDDRTELKEALASLELPEGMGLIVRTAGVGKSAEALQWDLSFRLKHWEAIKKAAESRPAPFLIHQESNVIVRAFRDYLRQDIGEILIDNPKVLELARQHIAALGRPDFSSKIKLYTGEIPLFSHYQIESQIESAFQREVRLPSGGSIVIDSTEALTAIDINSARATRGGDIEETAFNTNLEAADEIARQLRLRDLGGLIVIDFIDMTPVRHQRAVENRLREAVRQDRARIQISHISRFGLLEMSRQRLSPSLGESSHHVCPRCSGTGTVRDNESLSLSILRLIEEEALKENTQEVHAIVPVPIASYLLNEKRSAVNAIETRQDGVRCVIVPNDQMETPHYHVLRVRKGEETSTLSYMLPKLHEEAMALPSEEEFAERKRPEQPALATFAMPDVPPAPTPAEPAAPVVAPAPKAATATPASPAQPGLLSRFFGALKALFSGGEETKPAEQSAPKAEAKPERQQDRRKPRQNNRRDRNERRDTRSERTEGSDNREENRRNRRQAQQQTAETRESRQQAEVTEKARTTDEQQAPRRERSRRRNDDKRQAQQEAKALNVEEQSVQETEQEERVRPVQPRRKQRQLNQKVRYEQSVAEEAVVAPVVEETVAAEPIVQEAPAPRTELVKVPLPVVAQAAPEQQEENNADNRDNGGMPRRSRRSPRHLRVSGQRRRRYRDERYPTQSPMPLTVACASPELASGKVWIRYPIVRPQDVQVEEQHEQEEVQVQPMVTEVPVAAAVKPVVSAPVVEEVAEVVEAPVQVAEPQPEVVETTHPEVIAAAVTEQPQVITESDVAVAQEVAEHAEPVVEPQEETADIEEVAETAEVVVAEPEVVAQPAAPVVAEVAAEVETVAAVEPEVTVEHNHATAPMTRAPAPEYVPEAPRHSDWQRPTFAFEGKGAAGGHTATHHASAAPARPQPVE

SEQ ID NO: 2857 - DNA, 105 bp, Escherichia coli
atggaaatatttctggagagtaatacccagtctgtttctctgataattgcgctgtttttccgcatgaaaaacgggcaaccgacactctgcgcctctttgagctga

SEQ ID NO: 2858 - protein, 34 aa, Escherichia coli
MEIFLESNTQSVSLIIALFFRMKNGQPTLCASLS

SEQ ID NO: 2859 - DNA, 261 bp, Escherichia coli
  n 234, 235, 236, 237, 238: n is any nucleotide
atgaaaacagagactccatccgtaaaaattgttgctatcaccgctgacgaagcggggcaacgtatcgacaactttttgcgtacccaattgaaaggcgtaccaaaaagtatgatttaccgtattttgcgtaaaggcgaagtgcgggtgaacaaaaaacgtattaagcctgaatataaactcgaagcgggtgatgaggtgcgtatcccaccggttcgcgttgctgagcgggaagannnnncattccattcattaattaattaa

SEQ ID NO: 2860 - protein, 86 aa, Escherichia coli
  Xaa 78, 79, 80: Xaa is any amino acid
MKTETPSVKIVAITADEAGQRIDNFLRTQLKGVPKSMIYRILRKGEVRVNKKRIKPEYKLEAGDEVRIPPVRVAEREXXXFHSLIN

SEQ ID NO: 2861 - DNA, 522 bp, Escherichia coli
  n 4, 5, 6, 7, 8: n is any nucleotide
atgnnnnntgtgttgctggtagcgaaaaaacgctcggcgttgcgttctctgcatgagcaattacgtgaaaaagggatgcaaaaagattacctggcgctggtgcgcggtcagtggcagtcgcatgtgaagagcgttcaagcgccgttactgaaaaatattctgcaaagcggcgaacgtatcgtgcgtgtgagtcaggaaggcaaaccgtcggaaacacgctttaaagtggaagagcgctatgcatttgccaccctggtgcgttgtagcccggtaacagggcgtactcatcagatccgtgtgcatacacaatatgcgggtcatccgattgcctttgacgatcgctacggtgaccgtgaatttgacagacagctcactgaagcaggcacgggattaaatcgcctgttcctgcacgccgcagcgttgaagtttactcatccggggaccggtgaggtgatgcgtattgaagcgccgatggatgaaggtttgaagcgttgtttgcaaaagctgcgtaacgcgcgctaa

SEQ ID NO: 2862 - protein, 173 aa, Escherichia coli
  Xaa 2, 3: Xaa is any amino acid
MXXVLLVAKKRSALRSLHEQLREKGMQKDYLALVRGQWQSHVKSVQAPLLKNILQSGERIVRVSQEGKPSETRFKVEERYAFATLVRCSPVTGRTHQIRVHTQYAGHPIAFDDRYGDREFDRQLTEAGTGLNRLFLHAAALKFTHPGTGEVMRIEAPMDEGLKRCLQKLRNAR

SEQ ID NO: 2863 - DNA, 624 bp, Escherichia coli
atggctatcatcaatacgctatatctgatggaaaaaaatatgcctaaacttattttagcctccacctcgccctggcgtcgcgctcttctggaaaaactgcaaatctcttttgaatgtgcagcacccgaggtcgacgaaactccacgcagcgacgaatcaccgcgacagttggtgcttcgactggcacaagaaaaagcgcaatctctggcgtcacgttatccggatcatttaattattggttcagaccaggtatgtgttcttgatggcgaaatcaccggtaaaccgttaacggaagaaaatgcccgtctgcaattacgcaaagccagcggcaatatcgtcaccttctatactggactggcgttgtttaattcggcgaatgggcatctacaaacagaagtggagccttttgacgtccatttccgtcacctgagcgaggcggagattgataattacgtgcgtaaagagcatcccctgcactgcgcgggtagctttaagagtgaaggatttggcattacgctgtttgagcgtttagaggggcgtgatcctaacacgctggttggtttaccgctaatcgcgctgtgtcagatgttacgtcgggaagggaaaaacccgctgatgggatag

SEQ ID NO: 2864 - protein, 207 aa, Escherichia coli
MAIINTLYLMEKNMPKLILASTSPWRRALLEKLQISFECAAPEVDETPRSDESPRQLVLRLAQEKAQSLASRYPDHLIIGSDQVCVLDGEITGKPLTEENARLQLRKASGNIVTFYTGLALFNSANGHLQTEVEPFDVHFRHLSEAEIDNYVRKEHPLHCAGSFKSEGFGITLFERLEGRDPNTLVGLPLIALCQMLRREGKNPLMG

SEQ ID NO: 2865 - DNA, 522 bp, Escherichia coli
atgcaaaaggtaaaattacccctgactctcgatccggttcgtacggctcaaaaacgccttgattaccagggtatctatactcctgatcaggttgagcgcgtcgccgaatccgtagtcagtgtggacagtgatgtggaatgctccatgtcgttcgctatcgataaccaacgtctcgcagtgttaaacggcgatgcgaaggtgacggtaacgctcgagtgtcagcgttgcgggaagccgtttactcatcaggtctacacaacgtattgttttagtcctgtgcgttcagacgaacaggctgaagcactgccggaagcgtatgaaccgattgaggttaacgaattcggtgaaatcgatctgcttgcaatggttgaagatgaaatcatcctcgccttgccggtagttccggtgcatgattctgaacactgtgaagtgtccgaagcggacatggtctttggtgaactgcctgaagaagcgcaaaagccaaacccatttgccgtattagccagcttaaagcgtaagtaa

SEQ ID NO: 2866 - protein, 173 aa, Escherichia coli
MQKVKLPLTLDPVRTAQKRLDYQGIYTPDQVERVAESVVSVDSDVECSMSFAIDNQRLAVLNGDAKVTVTLECQRCGKPFTHQVYTTYCFSPVRSDEQAEALPEAYEPIEVNEFGEIDLLAMVEDEIILALPVVPVHDSEHCEVSEADMVFGELPEEAQKPNPFAVLASLKRK

SEQ ID NO: 2867 - DNA, 174 bp, Escherichia coli
atggccgtacaacagaataaaccaacccgttccaaacgtggcatgcgtcgttcccatgacgcgctgaccgcagtcaccagcctgtctgtagacaaaacttctggtgaaaaacacctgcgtcaccacatcactgccgacggttactaccgcggccgcaaggtcatcgctaagtaa

SEQ ID NO: 2868 - protein, 57 aa, Escherichia coli [sequence omitted]

SEQ ID NO: 2869 - DNA, 1242 bp, Escherichia coli
gtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccaagcatctctatcgcgaccgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgcgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaa

SEQ ID NO: 2870 - protein, 413 aa, Escherichia coli
MSKRRVVVTGLGMLSPVGNTVESTWKALLAGQSGISLIDHFDTSAYATKFAGLVKDFNCEDIISRKEQRKMDAFIQYGIVAGVQAMQDSGLEITEENATRIGAAIGSGIGGLGLIEENHTSLMNGGPRKISPFFVPSTIVNMVAGHLTIMYGLRGPSISIATACTSGVHNIGHAARIIAYGDADVMVAGGAEKASTPLGVGGFGAARALSTRNDNPQAASRPWDKERDGFVLGDGAGMLVLEEYEHAKKRGAKIYAELVGFGMSSDAYHMTSPPENGAGAALAMANALRDAGIEASQIGYVNAHGTSTPAGDKAEAQAVKTIFGEAASRVLVSSTKSMTGHLLGAAGAVESIYSILALRDQAVPPTINLDNPDEGCDLDFVPHEARQVSGMEYTLCNSFGFGGTNGSLIFKKI

SEQ ID NO: 2871 - DNA, 810 bp, Escherichia coli
atgttcttaattaacggtcataagcaggaatcgctggcagtaagcgatcgggcaacgcagtttggtgatggttgttttaccaccgccagagttatcgacggtaaagtcagtttgttatcggcgcatatccagcgactacaggatgcttgtcagcggttgatgatttcctgtgacttctggcctcagcttgaacaagagatgaaaacgctggcagcagaacagcaaaatggtgtactgaaagtcgtgatcagtcgcggtagtggcgggcgagggtacagcacattgaacagtggaccggcaacgcggattctctccgttacggcttatcctgcacattacgaccgtttgcgtaacgaagggatgacgttggcgctaagcccggtgcggctggggcgcaatcctcatcttgcaggtattaaacatcttaatcggcttgagcaagtattgatccgctctcatcttgagcagacaaacgctgatgaggcgctggtccttgacagcgaagggtgggttacggaatgctgtgcggctaatttgttctggcggaagggcaacgtagtttatacgccgcgactggatcaggcaggtgttaacggcattatgcgacaattctgtatccgtttgctggcacaatcctcttatcagcttgtcgaagtgcaagcctctctggaagaggcgttgcaggcagatgagatggttatttgtaatgcgttaatgccagtgatgcccgtacgtgcctgtggcgatgtctccttttcgtcagcaacgttatatgaatatttagccccactttgtgagcgcccgaattag

SEQ ID NO: 2872 - protein, 269 aa, Escherichia coli
MFLINGHKQESLAVSDRATQFGDGCFTTARVIDGKVSLLSAHIQRLQDACQRLMISCDFWPQLEQEMKTLAAEQQNGVLKVVISRGSGGRGYSTLNSGPATRILSVTAYPAHYDRLRNEGMTLALSPVRLGRNPHLAGIKHLNRLEQVLIRSHLEQTNADEALVLDSEGWVTECCAANLFWRKGNVVYTPRLDQAGVNGIMRQFCIRLLAQSSYQLVEVQASLEEALQADEMVICNALMPVMPVRACGDVSFSSATLYEYLAPLCERPN

SEQ ID NO: 2873 - DNA, 1023 bp, Escherichia coli
atgaaaaaagtgttattgataatcttgttattgctggtggtactgggtatcgccgctggtgtgggcgtctggaaggttcgccatcttgccgacagcaaattgcttatcaaagaagagacgatatttacccttaagccagggaccggacgtctggcgctaggtgaacagctttatgccgataagatcatcaatcgcccacgggtttttcaatggttgctgcgtatcgaaccggatctttctcactttaaagccgggacttaccgctttacaccgcagatgaccgtgcgcgagatgctgaaattgttggaaagcggtaaagaagcacagttcccgctgcgactggtagaagggatgcgtctgagcgactacctcaagcaattgcgtgaggctccgtatatcaagcacacgctgagcgacgataagtacgccaccgtagcgcaggcacttgaactggaaaacccggagtggattgaaggttggttctggccagacacctggatgtataccgccaataccaccgatgtcgcgttactcaagcgagcgcacaagaaaatggtgaaagcggtcgatagcgcctgggaagggcgtgcggacggtctgccttataaagataaaaaccagttggtgacgatggcatcaattatcgaaaaagaaaccgccgttgccagtgaacgcgatcaggttgcctcagtatttatcaaccgtttacgcattggtatgcgcctgcagaccgacccgaccgtgatttacgggatgggagagcgttataatggcaaactttctcgtgcagacctggaaacgccgacagcgtataacacctataccattaccggtctgccgccaggtgcgatagcgacgccgggggcggattcgctgaaggctgctgcgcatccggcaaaaacgccgtatctctattttgtggccgatggtaaaggtggtcacacgtttaataccaatcttgccagtcataacaagtctgtgcaggattatctgaaagtgcttaaggaaaaaaatgcgcagtaa

SEQ ID NO: 2874 - protein, 340 aa, Escherichia coli
MKKVLLIILLLLVVLGIAAGVGVWKVRHLADSKLLIKEETIFTLKPGTGRLALGEQLYADKIINRPRVFQWLLRIEPDLSHFKAGTYRFTPQMTVREMLKLLESGKEAQFPLRLVEGMRLSDYLKQLREAPYIKHTLSDDKYATVAQALELENPEWIEGWFWPDTWMYTANTTDVALLKRAHKKMVKAVDSAWEGRADGLPYKDKNQLVTMASIIEKETAVASERDQVASVFINRLRIGMRLQTDPTVIYGMGERYNGKLSRADLETPTAYNTYTITGLPPGAIATPGADSLKAAAHPAKTPYLYFVADGKGGHTFNTNLASHNKSVQDYLKVLKEKNAQ

SEQ ID NO: 2875 - DNA, 642 bp, Escherichia coli
atgcgcagtaagtatatcgtcattgaggggctggaaggcgcaggcaaaactaccgcgcgtaacgtggtggttgagacgcttgagcaactgggtatccgcgacatggttttcactcgggaacctggcggtacgcaacttgccgaaaagttaagaagccttgtgctggatatcaaatcggtaggcgatgaagtcattaccgataaagccgaagttctgatgttttatgccgcgcgcgttcaactggtagaaacggtcatcaaacctgcgctggctaacggcacctgggtgattggcgatcgccacgatctctccactcaagcctatcagggtggaggacgaggtattgaccaacatatgctggcaacactgcgtgatgctgttctcggggggtttcgccccgacttaacgctctatctcgatgttaccccggaggttggcttaaaacgcgcgcgtgcgcgcggcgagctggatcgtattgagcaagaatctttcgatttctttaatcgcacccgcgcccgctatctggaactggcagcacaagataaaagcattcataccattgatgccacccagccgctggaggccgtgatggatgcaatccgcaccaccgtgaccaactgggtgaaggagttggacgcatga

SEQ ID NO: 2876 - protein, 213 aa, Escherichia coli
MRSKYIVIEGLEGAGKTTARNVVVETLEQLGIRDMVFTREPGGTQLAEKLRSLVLDIKSVGDEVITDKAEVLMFYAARVQLVETVIKPALANGTWVIGDRHDLSTQAYQGGGRGIDQHMLATLRDAVLGGFRPDLTLYLDVTPEVGLKRARARGELDRIEQESFDFFNRTRARYLELAAQDKSIHTIDATQPLEAVMDAIRTTVTNWVKELDA

SEQ ID NO: 2877 - DNA, 1005 bp, Escherichia coli
atgagatggtatccatggttacgacctgatttcgaaaaactggtagccagctatcaggccggaagaggtcaccatgcgctactcattcaggcgttaccgggcatgggcgatgatgctttaatctacgccctgagccgttatttactctgccaacaaccgcagggccacaaaagttgcggtcactgtcgtggatgtcagttgatgcaggctggcacacatcccgattactacaccctgactcccgaaaaagggaaaaatgcgctgggcattgatgcggtacgtgaggtcaccgaaaagctgaatgagcacgcacgcttaggtggtgcgaaagttgtctgggtaaccgatgctgccttactaaccgacgccgcggctaacgcattgctgaaaacgcttgaagagccaccagcagagacgtggtttttccttgctacccgcgagccagaacgtttactggcaacattacgtagtcgttgtcggttacattaccttgcgccgccgccggaacagtacgccgtgacctggctttcacgcgaagtgacaatgtcacaggctgcactacttgccgcattgcgcttaagcgccggttcgcctggggcggcactggcgttgtttcagggagataactggcaggctcgtgaaacattgtgtcaggcgctggcatatagcgtgcaatcgggcgactggtattcgctgctagcggcccttaatcatgaacaagctccggcacgtttacactggctggcaacgttgctgatggatgcgctaaaacgccatcatggcgctgcgcaggtgaccaatgttgatgtgccgggcctggtcgtcgaactggcaaaccatctttctccctcgcgcctgcaggctatactgggggatgtttgccacattcgtgaacagttaatgtctgtcacaggcatcaaccgcgagcttctcatcaccgatcttttactgcgtattgagcattacctgcaaccgggcgttgtgctaccggttcctcatctttaa

SEQ ID NO: 2878 - protein, 334 aa, Escherichia coli
MRWYPWLRPDFEKLVASYQAGRGHHALLIQALPGMGDDALIYALSRYLLCQQPQGHKSCGHCRGCQLMQAGTHPDYYTLTPEKGKNALGIDAVREVTEKLNEHARLGGAKVVWVTDAALLTDAAANALLKTLEEPPAETWFFLATREPERLLATLRSRCRLHYLAPPPEQYAVTWLSREVTMSQAALLAALRLSAGSPGAALALFQGDNWQARETLCQALAYSVQSGDWYSLLAALNHEQAPARLHWLATLLMDALKRHHGAAQVTNVDVPGLVVELANHLSPSRLQAILGDVCHIREQLMSVTGINRELLITDLLLRIEHYLQPGVVLPVPHL

SEQ ID NO: 2879 - DNA, 798 bp, Escherichia coli
atgtttttagtcgactcacactgccatctcgatggtctggattatgaatctttgcataaggacgtggatgacgttctggcgaaagccgccgcacgcgatgtgaaattttgtctggcagtcgccacaacattaccgggttatttacacatgcgggatctggtaggcgaacgcgacaacgtcgtattttcttgtggcgtgcatccactcaaccagaatgatccctacgatgtagaagatttacgtcgtctggcggcagaagagggcgttgtagcgctgggtgaaaccgggctggattattattacacgccggaaactaaagtacgtcagcaagagtccttcatccatcatatccagattggtcgtgaactgaacaagccggttatcgtccacacccgtgacgcccgcgccgatacgctggcaattctgcgcgaagaaaaagtgacggattgcggtggcgtactacactgttttacagaggacagagaaacggcgggcaaattactggatctcggattttacatctccttttccggcattgtgaccttccgtaatgcggagcaactgcgcgatgctgcgcgttatgtccccctggatcggttactggtggaaactgactcaccttaccttgcgccagtaccgcatcgaggaaaagagaatcaacctgcgatggttcgtgacgttgcagaatacatggctgtgttgaaaggtgttgccgttgaagaactggcgcaggtaaccaccgataacttcgcccgtctgtttcacatcgacgcttcccgccttcaatccatccgttga

SEQ ID NO: 2880 - protein, 265 aa, Escherichia coli
MFLVDSHCHLDGLDYESLHKDVDDVLAKAAARDVKFCLAVATTLPGYLHMRDLVGERDNVVFSCGVHPLNQNDPYDVEDLRRLAAEEGVVALGETGLDYYYTPETKVRQQESFIHHIQIGRELNKPVIVHTRDARADTLAILREEKVTDCGGVLHCFTEDRETAGKLLDLGFYISFSGIVTFRNAEQLRDAARYVPLDRLLVETDSPYLAPVPHRGKENQPAMVRDVAEYMAVLKGVAVEELAQVTTDNFARLFHIDASRLQSIR

SEQ ID NO: 2881 - DNA, 1434 bp, Escherichia coli
atgtttaagaatgcatttgctaacctgcaaaaggtcggtaaatcgctgatgctgccggtatccgtactgcctatcgcaggtattctgctgggcgtcggttccgcgaatttcagctggctgcccgccgttgtatcgcatgttatggcagaagcaggcggttccgtctttgcaaacatgccactgatttttgcgatcggtgtcgccctcggctttaccaataacgatggcgtatccgcgctggccgcagttgttgcctatggcatcatggttaaaaccatggccgtggttgcgccactggtactgcatttacctgctgaagaaatcgcctctaaacacctggcggatactggcgtactcggggggattatctccggtgcgatcgcagcgtacatgtttaaccgtttctaccgtattaagctgcctgagtatcttggcttctttgccggtaaacgctttgtgccgatcatttcaggcctggctgccatctttactggcgttgtgctgtccttcatttggccgccgattggttctgcaatccagaccttctctcagtgggctgcttaccagaacccggtagttgcgtttggcatttacggtttcatcgaacgttgcctggtaccgtttggtctgcaccacatctggaacgtacctttccagatgcagattggtgaatacaccaacgcagcaggtcaggttttccacggcgacattccgcgttatatggcgggtgacccgactgcgggtaaactgtctggtggcttcctgttcaaaatgtacggtctgccagctgccgcaattgctatctggcactctgctaaaccagaaaaccgcgcgaaagtgggcggtattatgatctccgcggcgctgacctcgttcctgaccggtatcaccgagccgatcgagttctccttcatgttcgttgcgccgatcctgtacatcatccacgcgattctggcaggcctggcattcccaatctgtattcttctggggatgcgtgacggtacgtcgttctcgcacggtctgatcgacttcatcgttctgtctggtaacagcagcaaactgtggctgttcccgatcgtcggtatcggttatgccattgtttactacaccatcttccgcgtgctgattaaagcactggatctgaaaacgccgggtcgtgaagatgcgactgaagatgcaaaagcgacaggtaccagcgaaatggcaccggctctggttgctgcatttggtggtaaagaaaacattactaacctcgacgcatgtattacccgtctgcgcgtcagcgttgctgatgtgtctaaagtggatcaggctggcctgaagaaactgggcgcagcgggcgtagtggttgctggttctggtgttcaggcgattttcggtactaaatccgataacctgaaaaccgagatggatgagtacatccgtaaccactaa

SEQ ID NO: 2882 - protein, 477 aa, Escherichia coli
MFKNAFANLQKVGKSLMLPVSVLPIAGILLGVGSANFSWLPAVVSHVMAEAGGSVFANMPLIFAIGVALGFTNNDGVSALAAVVAYGIMVKTMAVVAPLVLHLPAEEIASKHLADTGVLGGIISGAIAAYMFNRFYRIKLPEYLGFFAGKRFVPIISGLAAIFTGVVLSFIWPPIGSAIQTFSQWAAYQNPVVAFGIYGFIERCLVPFGLHHIWNVPFQMQIGEYTNAAGQVFHGDIPRYMAGDPTAGKLSGGFLFKMYGLPAAAIAIWHSAKPENRAKVGGIMISAALTSFLTGITEPIEFSFMFVAPILYIIHAILAGLAFPICILLGMRDGTSFSHGLIDFIVLSGNSSKLWLFPIVGIGYAIVYYTIFRVLIKALDLKTPGREDATEDAKATGTSEMAPALVAAFGGKENITNLDACITRLRVSVADVSKVDQAGLKKLGAAGVVVAGSGVQAIFGTKSDNLKTEMDEYIRNH

SEQ ID NO: 2883 - DNA, 2190 bp, Escherichia coli
atgctttcgacacaatttaacagggataatcaacatcaagctatcatcaaaccgtcactccttgccggttgcatagcactggcactattaccttccgccgcttttgctgcaccagtcactgaagaaacggtgattgttgagggttcagccacagccccagatgatggcgaaaatgattacaacgtaacgtctacctctgcgggtacaaaaatgcagatgactcaacgtgatattcctcagtcggtcactattgttagccagcagcggatggaagatcagcagttacaaacgctgggcgaagtgatggaaaacacgctggggatcagcaaaagtcaggcggattccgatcgtgctctttattattcccgcggattccagatcgataactatatggttgatggtatccccacctattttgaatcgcgctggaatctgggcgacgcactttctgatatggcactgtttgaacgcgtagaagtagtgcgtggcgcgacaggcctcatgaccgggacgggtaatccatctgcggcaattaatatggttcgaaaacacgcgaccagtcgtgaatttaaaggcgatgtctcggcggaatacggtagctggaacaaagaacggtatgtggcggatttacaaagcccactcaccgaagatggtaaaatccgcgcacgaattgtcggcggctaccagaataacgactcatggctggaccgctacaacagtgaaaagaccttcttctccggcattgtcgatgctgatttaggcgatcttacgatgctttcagccggttacgaatatcagcgtattgatgttaatagcccaacctggggtggtttaccgcgctggaatactgatggcagcagcaacagttacgatcgcgcacgcagtaccgcacctgactgggcgtacaacgataaagagatcaacaaggtctttatgaccctgaagcagcggtttgctgatacctggcaagcgacgctgaatgccacccactctgaagtcgaatttgacagcaaaatgatgtatgtcgatgcctatgtaaacaaagcggatggtatgctggttgggccatacagtaattatggacctggttttgattatgtcggcggcaccggttggaacagcggcaaacgtaaagttgatgcgctggatttgttcgctgacggtagttatgaattgtttggtcgtcagcacaatctaatgtttggtggcagttacagcaaacaaaacaatcgttacttcagttcatgggccaacatcttcccggatgaaattggcagtttctacaactttaatggcaatttcccacaaaccgactggtcaccacagagcctggcgcaggacgataccacacatatgaaatcgttatatgctgccactcgtgtcacccttgccgatccgctgcatctgatcctcggcgcacgttataccaactggcgggttgatacgctgacttacagcatggagaaaaaccacaccacgccttacgctggtctggtgtttgacatcaatgacaactggtcgacctacgccagctatacctctattttccagccgcaaaatgatcgtgacagttcaggcaaatatctgactccaatcaccggtaacaactacgagctgggtctgaaatcggactggatgaatagccgtctgaccaccacgttagccatcttccgtattgagcaggataatgtcgctcagtccaccggtacacctatccccggcagcaacggcgaaaccgcctataaagcggtggatgggacagtcagtaaaggtgtggaatttgaactcaacggcgcaattaccgacaactggcagctgacgtttggcgcaacgcgctatattgcagaagataacgaaggaaacgccgttaatcctaatctgccacgcaccacggttaaaatgttcaccagctaccggttgcctgtcatgccagagttgacggtcggcggtggtgttaactggcaaaatcgcgtgtataccgacaccgtgacaccgtatggcaccttccgcgccgagcaaggtagctacgcgctggtggatctcttcacccgctaccaggtgacgaaaaacttctcgttacaggggaacgtcaataacctgttcgacaaaacctacgataccaacgtggaaggttctatcgtctacggcgcaccgcgtaatttcagcattaccggcacgtatcaattctga

SEQ ID NO: 2884 - protein, 729 aa, Escherichia coli
MLSTQFNRDNQHQAIIKPSLLAGCIALALLPSAAFAAPVTEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 2885 - DNA, 360 bp, Escherichia coli
gtggcagaagaaactatattcagcaaaattattcgtcgtgagatcccctccgatatcgtctaccaggatgatctggtaacggcgtttcgcgatatttcgccgcaagcgccaacgcatattctgatcattccgaatatcctcattccgactgtgaacgacgtgtcagctgagcatgagcaggcgctgggacgcatgatcaccgtagcggcaaaaattgctgagcaagaaggtattgccgaagatggctatcgtctgatcatgaacaccaaccgccatggcggacaagaggtttaccacatccatatgcatttgttgggtggctgtccgctgggaccaatgctggcgcataaaggtctgtaa

SEQ ID NO: 2886 - protein, 119 aa, Escherichia coli
MAEETIFSKIIRREIPSDIVYQDDLVTAFRDISPQAPTHILIIPNILIPTVNDVSAEHEQALGRMITVAAKIAEQEGIAEDGYRLIMNTNRHGGQEVYHIHMHLLGGCPLGPMLAHKGL

SEQ ID NO: 2887 - DNA, 378 bp, Escherichia coli
atgagaaaaggatgctttgggctgatgtctctggcgttgttagtgctggtgggctgtcgttcacatccggaaattccggtgaatgatgagcaatcgctggtgatggagtcatctttattagctgcgggcatcagtgcagaaaagcccgtcctttcgacatctgatattcaaccttcagcatcctcaacgctttataacgaaaggcaagaacccgttaccgttcattatcgtttttactggtatgacgccagagggctggagatgcatcctctggaaaggccacgcagcgttaccattcccgcacattcggcggtcacgctgtacggcagcgccaattttctgggggcgcacaaagtcagactttatctatatttgtaa

SEQ ID NO: 2888 - protein, 125 aa, Escherichia coli
MRKGCFGLMSLALLVLVGCRSHPEIPVNDEQSLVMESSLLAAGISAEKPVLSTSDIQPSASSTLYNERQEPVTVHYRFYWYDARGLEMHPLERPRSVTIPAHSAVTLYGSANFLGAHKVRLYLYL

SEQ ID NO: 2889 - DNA, 642 bp, Escherichia coli
atgacaaaaatgagtcgctacgccttgattaccgcgctggcgatgtttcttgccgggtgtgtggggcaacgtgaacctgcaccggtagaagaagtgaaaccagcgccggaacaacctgctgagccacaacagcctgtccccacagtgccatcggtgccgacgataccgcagcagccaggcccaattgagcacgaagatcaaactgcaccgcctgcgccgcatattcgccattatgactggaatggcgcaatgcagccgatggtcagtaagatgcttggggctgacggcgtgactgcgggtagcgtcctgctggttgatagcgttaacaaccgtactaatggttcgttgaatgccgcagaagcgaccgaaacgctgcgaaatgcgctggctaataacggtaaatttaccctggtttccgcccagcagctgtcgatggctaagcaacaattaggtttgtcgccgcaggacagtttaggcacccgtagtaaagccataggcattgcccgcaatgttggcgctcattacgtgctgtactccagcgcctctggcaacgttaacgctccgaccctacaaatgcagctgatgctggtgcagacgggcgaaattatctggtcaggtaaaggtgccgtttcgcagcaataa

SEQ ID NO: 2890 - protein, 213 aa, Escherichia coli
MTKMSRYALITALAMFLAGCVGQREPAPVEEVKPAPEQPAEPQQPVPTVPSVPTIPQQPGPIEHEDQTAPPAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 2891 - DNA, 825 bp, Escherichia coli
gtgccgtttcgcagcaataatcccctcacgcgcgacgaattgctgtcgcgctttttcccgcagtttcatcccgtcacgacgtttaatagtgggcttagtggcgggagttttctcattgaacatcagggccagcgttttgttgtgcgtcagccgcacgatcctgatgcgccgcagtccgcgttcttgcgccagtatcgggctttatcacaactacccgcatgcattgcaccgaagccgcatttatatctccgtgactggatggtggtcgactatctgcccggcgaggtaaaaacgtatttgccggataccaacgaactggcaggcttgctgtattatctacatcaacaaccgcgttttggctggcgaataacgctgttgccgttactggaactgtactggcagcaaagcgatccggcgcggcggacagtgggttggctgcgaatgttaaaacgtctgcgcaaagcgcgggaaccacggcttttacgcttaagtccattgcatatggatgtccacgccggaaatttagtgcatagcgcgtcagggttaaaactcatcgactgggagtatgccggagatggtgatatcgcgctggaactggcggcggtgtgggtggaaaatattgaccagcatcggcaattggtcaatgactatgccactcgcgcgaagatttatccggcgcaattatggcgtcaggtcaggcgatggtttccctggctgctgatgctcaaagcagggtggtttgagtaccgctggcgacaaaccggcgatcaacaatttatcaggctggccgatgacacgtggcggcagctattaataaaacaataa

SEQ ID NO: 2892 - protein, 274 aa, Escherichia coli
MPFRSNNPLTRDELLSRFFPQFHPVTTFNSGLSGGSFLIEHQGQRFVVRQPHDPDAPQSAFLRQYRALSQLPACIAPKPHLYLRDWMVVDYLPGEVKTYLPDTNELAGLLYYLHQQPRFGWRITLLPLLELYWQQSDPARRTVGWLRMLKRLRKAREPRLLRLSPLHMDVHAGNLVHSASGLKLIDWEYAGDGDIALELAAVWVENIDQHRQLVNDYATRAKIYPAQLWRQVRRWFPWLLMLKAGWFEYRWRQTGDQQFIRLADDTWRQLLIKQ

SEQ ID NO: 2893 - DNA, 1014 bp, Escherichia coli
atgttggatgtcgaaggttacgaactggacgcggaagagcgtgaaatactggcgcatccgctggtgggagggctgattctctttacgcgaaactatcatgatcctgcccagttacgtgaactggtgcgccagatccgcgcagcatcgcgcaatcatctggtggtggcggtagatcaggaaggtggacgcgtgcagcgttttcgtgaaggttttacccgcttgccagcggcacaatcattcgctgcgctgttgggaatggaagaaggcggaaaactggcgcaagaggcaggttggttgatggccagtgaaatgattgctatggatattgatatcagctttgcgccagtgctggacgtcgggcatatcagcgcggcgattggcgagcgttcttatcatgccgatccacaaaaagccctggcaattgccagccgttttattgatggtatgcatgaagcgggaatgaaaactaccgggaaacacttcccaggtcacggtgcagtaacggcagactcacacaaagaaacaccgtgcgacccacgtccgcaagcggagattcgcgctaaagatatgtcggtcttcagttccttaatccgcgaaaataaactcgacgccattatgcctgcgcatgtgatctacagtgatgttgatccgcgtccggcgagcggttctccctactggctgaaaaccgttttgcgtcaggaattgggttttgacggcgtgattttctctgacgatttatcgatggaaggcgcagcgattatgggcagttatgccgagcgtggacaggcatcactggatgcaggttgcgatatgatcctggtctgcaataatcgtaaaggggccgtcagcgtgttagataatctgtcaccgatcaaggcagaacgtgttacacgtttgtatcataaaggttcattttcgcgacaggaactgatggactcggctcgctggaaagcgatcagcacccgtctgaatcagttacatgaacgctggcaggaagagaaggcaggtcattaa

SEQ ID NO: 2894 - protein, 337 aa, Escherichia coli
MLDVEGYELDAEEREILAHPLVGGLILFTRNYHDPAQLRELVRQIRAASRNHLVVAVDQEGGRVQRFREGFTRLPAAQSFAALLGMEEGGKLAQEAGWLMASEMIAMDIDISFAPVLDVGHISAAIGERSYHADPQKALAIASRFIDGMHEAGMKTTGKHFPGHGAVTADSHKETPCDPRPQAEIRAKDMSVFSSLIRENKLDAIMPAHVIYSDVDPRPASGSPYWLKTVLRQELGFDGVIFSDDLSMEGAAIMGSYAERGQASLDAGCDMILVCNNRKGAVSVLDNLSPIKAERVTRLYHKGSFSRQELMDSARWKAISTRLNQLHERWQEEKAGH

SEQ ID NO: 2895 - DNA, 600 bp, Escherichia coli
atgaacgctggcaggaagagaaggcaggtcattaaccctggcttatgtgaggaagcgatgattatctatttgcacggttttgactctaacagtccgggtaaccacgagaaagtcttacaattgcagtttattgacccggatgtacggctaataagctacagtacgcggcatccgaaacatgatatgcagcatttgctcaaagaagtggacaaaatgttgcaactgaacgtcgacgagcgcccgctcatttgtggtgttggtctgggcggttattgggctgagcggattggttttctctgtgatatccgccaggtgatcttcaaccccaatttgttcccttatgagaacatggaagggaagattgatcgcccggaagagtatgccgatattgccactaagtgtgtgaccaacttccgtgagaagaatcgcgatcgttgcctggtgattttgtcgcgtaatgatgaagcgcttaacagccagcggacatctgaagagttgcatcattattacgagattgtctgggacgaagagcagacgcacaaattcaagaatatctccccgcatttacagcgcattaaagcgttcaaaaccctcgggtaa

SEQ ID NO: 2896 - protein, 199 aa, Escherichia coli
MNAGRKRRQVINPGLCEEAMIIYLHGFDSNSPGNHEKVLQLQFIDPDVRLISYSTRHPKHDMQHLLKEVDKMLQLNVDERPLICGVGLGGYWAERIGFLCDIRQVIFNPNLFPYENMEGKIDRPEEYADIATKCVTNFREKNRDRCLVILSRNDEALNSQRTSEELHHYYEIVWDEEQTHKFKNISPHLQRIKAFKTLG

SEQ ID NO: 2897 - DNA, 1281 bp, Escherichia coli
gtgattgtcggcggcggtgctggtgggctggaaatggcaacacagctggggcataagctgggacgcaagaaaaaagccaaaattacgctggtcgatcgtaaccacagccacctgtggaaaccgctgctgcacgaagtggcgactggctcgcttgatgaaggcgtcgatgcgttgagctatctggcccatgcgcgcaatcatggtttccagttccagctgggttccgtaattgatattgatcgtgaagcgaaaacaatcactattgcagaactgcgcgacgagaaaggtgaactgctggttccggaacgtaaaatcgcctatgacaccctggtaatggcgctgggtagcacctctaacgatttcaatacaccaggtgtcaaagagaactgcattttcctcgataacccgcaccaggcgcgtcgcttccaccaggagatgctgaatctgttcctgaaatactccgccaacctgggcgcgaatggcaaagtaaacattgcgattgtcggcggcggcgcgacgggtgtagaactctccgctgaattgcacaacgcggtcaagcaactgcacagttacggttataaaggtctgaccaacgaagccctgaacgtaacgctggtagaagcgggcgaacgtattttgcctgcattgccgccacgtatctctgctgcggcccatagtgagttaacgaaactaggcgttcgcgtgctgacgcaaaccatggtcaccagtgctgatgaaggcggcctgcacactaaagatggcgaatatattgaggctgatctgatggtgtgggcagccgggatcaaagcgccagacttcctgaaagatatcggtggtcttgaaaccaaccgtatcaaccagctggtggtggaaccgacgctgcaaaccactcgcgatccagacatatacgctattggcgactgcgcgtcatgcccgcgtccggaagggggctttgttccgccgcgcgctcaggccgcacatcagatggcaacctgcgcaatgaacaacattctggcgcagatgaacggtaagccgctgaaaaattatcagtataaagatcacggttcgctggtatcgctgtcgaacttttccaccgtcggtagcctgatgggtaacctgacacgcggctcaatgatgattgaaggacgaattgcgcgctttgtatacatctcgctgtaccgaatgcaccagattgcgctgcatggttactttaaaaccggattaatgatgctggtggggagtattaaccgcgttatccgtccacgtttgaagttgcattaa

SEQ ID NO: 2898 - protein, 426 aa, Escherichia coli
MIVGGGAGGLEMATQLGHKLGRKKKAKITLVDRNHSHLWKPLLHEVATGSLDEGVDALSYLAHARNHGFQFQLGSVIDIDREAKTITIAELRDEKGELLVPERKIAYDTLVMALGSTSNDFNTPGVKENCIFLDNPHQARRFHQEMLNLFLKYSANLGANGKVNIAIVGGGATGVELSAELHNAVKQLHSYGYKGLTNEALNVTLVEAGERILPALPPRISAAAHSELTKLGVRVLTQTMVTSADEGGLHTKDGEYIEADLMVWAAGIKAPDFLKDIGGLETNRINQLVVEPTLQTTRDPDIYAIGDCASCPRPEGGFVPPRAQAAHQMATCAMNNILAQMNGKPLKNYQYKDHGSLVSLSNFSTVGSLMGNLTRGSMMIEGRIARFVYISLYRMHQIALHGYFKTGLMMLVGSINRVIRPRLKLH

SEQ ID NO: 2899 - DNA, 528 bp, Escherichia coli
atgttggcgggtatcgggattggtgtcgcagctgcgctgggcgtagcggcagtggccagtctgaacgtgtttgaacgtggcccgcaatacgctcaggttgtttctgcaaccccaatcaaggaaacggttaaaacaccgcgtcaggagtgtcgcaacgttacagtgacccatcgtcgaccggtgcaggatgaaaatcgcattaccgggtcggtgctcggcgctgttgctggcggcgtgattgggcatcagtttggtggtggtcgcggtaaagatgtcgccactgttgtgggggcgctggggggtggatatgcaggtaaccagatccagggctctctccaggaaagcgatacttacacgactacgcaacagcgttgtaaaacggtgtatgacaagtcagaaaaaatgctcggttatgatgtgacctataagattggcgatcagcagggcaaaatccgaatggaccgcgatccgggtacgcagatcccgctagatagcaacgggcagctgattttgaataacaaagcataa

SEQ ID NO: 2900 - protein, 175 aa, Escherichia coli
MLAGIGIGVAAALGVAAVASLNVFERGPQYAQVVSATPIKETVKTPRQECRNVTVTHRRPVQDENRITGSVLGAVAGGVIGHQFGGGRGKDVATVVGALGGGYAGNQIQGSLQESDTYTTTQQRCKTVYDKSEKMLGYDVTYKIGDQQGKIRMDRDPGTQIPLDSNGQLILNNKA

SEQ ID NO: 2901 - DNA, 711 bp, Escherichia coli
atggtttctggactggtgaacggaggtgattatttttataataacctttcattcacagtcaccaggtacaacggcatcatggcaactgactcaacacaatgtgtaaaaaaaagccgtggccgcccaaaagtgttcgacagggatgccgcgcttgataaggccatgaaattgttctggcagcacggttatgaagcgacttctcttgcggacctcgttgaagcgaccggagctaaagcgcccacgctatacgcggaatttaccaacaaagaggggttattccgcgccgtactcgaccgctatatcgatcgttttgccgccaagcatgaagcacagctgttttgtgaagagaaaagcgtggagtctgcgctggctgactattttgctgccatcgccaactgctttaccagcaaagacactccggctggctgcttcatgatcaacaactgcaccaccctctccccggattcaggagatatcgccaatacgctgaaatcacgccatgcgatgcaagagcgcactttgcagcagtttttatgtcaacgacaagcgcgcggggaaatcccgacccactgtgacgtgacgcatctggcagaattccttaattgtattattcaggggatgtcgatcagcgcacgcgaaggtgcatcgctggaaaaactgatgcagattgcccgaacgactttgcgtttatggccggaactgctgaaatag

SEQ ID NO: 2902 - protein, 236 aa, Escherichia coli
MVSGLVNGGDYFYNNLSFTVTRYNGIMATDSTQCVKKSRGRPKVFDRDAALDKAMKLFWQHGYEATSLADLVEATGAKAPTLYAEFTNKEGLFRAVLDRYIDRFAAKHEAQLFCEEKSVESALADYFAAIANCFTSKDTPAGCFMINNCTTLSPDSGDIANTLKSRHAMQERTLQQFLCQRQARGEIPTHCDVTHLAEFLNCIIQGMSISAREGASLEKLMQIARTTLRLWPELLK

SEQ ID NO: 2903 - DNA, 258 bp, Escherichia coli
atgaaaaacgtaaaaaacctcatcgctgcggcgattttaagctccatgtcatttgccagctttgcggctgtcgaagttcagtccacgccagaaggccaacaaaaagtcggtactatcagtgctaacgcggggacaaatctgggatcgctggaagagcagttggcgcaaaaagcggatgagatgggcgcaaaatctttccgtattacttctgtaaccggtccgaataccctccatggaacagcagtaatttataaataa

SEQ ID NO: 2904 - protein, 85 aa, Escherichia coli
MKNVKNLIAAAILSSMSFASFAAVEVQSTPEGQQKVGTISANAGTNLGSLEEQLAQKADEMGAKSFRITSVTGPNTLHGTAVIYK

SEQ ID NO: 2905 - DNA, 966 bp, Escherichia coli
ttggtgatgatcaaaacgcatttttctcgctggctaacgttttttacgttcgccgctgccgtggcgctggcgctaccggcaaaagccaacacctggccgctgccgcaagcgggcagtcgtctggttggtgaaaacaaatttcatgtggtggaaaatgacggtggctctctggaagcgatcgccaaaaaatataacgtcggctttctcgctctgttacaggctaaccccggcgttgatccttacgtaccgcgcgcgggtagcgtgttaacgatcccgttgcaaaccctacttccagacgcgccgcgcgaaggcattgtgatcaacattgcggagctgcgtctctattactacccgccgggtaaaaattcggtaaccgtgtatcccatcggcattggtcagttaggtggtgacacgctgacgccaacgatggtgactaccgtttcagacaaacgtgcaaacccaacctggacgccaacggcaaacatccgcgcgcggtataaggcacagggaattgagttgcctgcggtagtgccggcaggaccggataacccaatgggccatcatgcgattcgtctggcggcctatggcggcgtttatttgcttcatggtacgaacgccgatttcggcattggcatgcgggtaagttctggctgtattcgtctgcgggatgacgatatcaaaacactctttagccaggtcaccccaggcaccaaagtgaatatcatcaacactccgataaaagtctctgccgaaccaaacggtgcgcgtctggttgaagtacatcagccgctgtctgagaagattgatgacgatccgcagctgctgccaattacgctgaatagcgcaatgcaatcatttaaagatgcagcacaaactgacgctgaagtgatgcaacatgtgatggatgtccgttccgggatgccggtggatgtccgccgtcatcaagtgagcccacaaactctgtaa

SEQ ID NO: 2906 - protein, 321 aa, Escherichia coli
MVMIKTHFSRWLTFFTFAAAVALALPAKANTWPLPQAGSRLVGENKFHVVENDGGSLEAIAKKYNVGFLALLQANPGVDPYVPRAGSVLTIPLQTLLPDAPREGIVINIAELRLYYYPPGKNSVTVYPIGIGQLGGDTLTPTMVTTVSDKRANPTWTPTANIRARYKAQGIELPAVVPAGPDNPMGHHAIRLAAYGGVYLLHGTNADFGIGMRVSSGCIRLRDDDIKTLFSQVTPGTKVNIINTPIKVSAEPNGARLVEVHQPLSEKIDDDPQLLPITLNSAMQSFKDAAQTDAEVMQHVMDVRSGMPVDVRRHQVSPQTL

SEQ ID NO: 2907 - DNA, 3510 bp, Escherichia coli
ttgcttatcagagatatgcccccatatgttgaggcatatcctaacgagaatctgacaaccgttatgcctgaacaatatcgttatacgctgcccgtcaaagcgggtgagcagcgtctgctgggcgagttaactggcgctgcctgcgcaacgctggtagcggaaattgccgaacgtcacgccggaccagtggtgcttattgcgccagatatgcaaaatgctctgcgtttgcatgatgaaatcagccagttcaccgatcagatggtgatgaacctggcggactgggaaaccctcccttacgacagtttttcgcctcatcaggacattatctcctcgcgcctttccaccctttaccagctaccgacgatgcagcgtggcgtactgattgttccggtgaatacgcttatgcagcgcgtttgcccgcacagttttctccacggtcatgcgctggtgatgaaaaaaggtcagcgcctgtcacgagatgcattacgaacccaactggacagcgccggttatcgccatgttgaccaggtgatggagcacggcgaatacgccacgcgcggcgcgttgctggatctcttcccgatggggagtgagctgccttatcgtcttgatttctttgatgatgaaatcgacagcctgcgggtgtttgacgtcgatagccagcgcacgctggaggaagtagaagcgatcaatctgcttcccgcgcacgaatttccgaccgataaagcggcaattgaactgttccgcagccagtggcgtgataccttcgaagtgaagcgcgacccggaacatatttatcagcaagtgagtaaaggcacattacctgccgggatcgagtactggcagccgctattcttcagcgaaccgctgccgccactgttcagttatttccctgccaatacgctgttggtgaatactggcgatctggaaaacagtgccgaacgtttccaggctgacacgctggcgcgttttgagaatcgcggcgtcgacccaatgcgcccactgttgccaccacaatcgctctggctgcgggtggatgagctcttttcagagctgaaaaactggccgcgtgtgcagctaaaaactgaacatttaccgacaaaagcagcgaatgccaatttaggtttccagaaactgccagacctggccattcaggcacaacaaaaagcgccgctggatgcgctgcgtaagttcctcgagactttcgacggtccggtggtgttctcggtagaaagtgaaggtcgccgtgaagcgctgggtgaactgctcgcgcgaattaaaattgctccgcaacgcattatgcgtcttgatgaagccagcgaccgtgggcgttatctgatgattggcgctgccgaacatggttttgtcgatacgatgcgtaacctggcgctgatttgcgaaagcgatctgctcggtgaacgcgttgcccgtcgtcgtcaggattctcgccgcgccatcaaccccgatacactgatccgtaaccttgcggagctgcatattggtcagccggtggtccatctggagcacggcgtcggtcgttatgccggaatgaccacgctcgaagctggaggcattactggcgagtatttgatgctcacctatgccaacgacgccaaactgtatgttccggtgtcgtcactgcatctgattagccgttacgcgggtggcgcagaagaaaacgcaccactgcataaacttggtggcgatgcctggtcacgcgcacggcagaaagcggcggaaaaagtgcgtgatgtggcggcggaattgctggatatctacgcgcaacgcgccgccaaagagggcttcgcgtttaaacacgatcgtgagcagtatcagttattctgcgacagcttcccgtttgaaaccacgccggatcaggctcaagccattaatgcggtgcttagcgacatgtgtcagccgctggcaatggatcgtctggtgtgcggcgatgttggctttggtaaaacagaagtggcgatgcgcgccgctttcctggcggtagataaccacaaacaggtggcggtgctggtgcctaccacccttctcgcgcagcagcattacgacaacttccgcgaccgtttcgccaactggccggtacgtatcgaaatgatctcccgtttccgcagcgccaaagagcagacgcaaatccttgcggaagtggcggaagggaaaatcgatattctgatcggtacgcacaaactgctgcaaagtgacgtcaagtttaaagatttaggcctgctgattgtcgatgaagaacaccgcttcggggtgcgtcataaagagcgcattaaagcgatgcgcgcgaacgtggatattctgacgcttaccgcaacgccgatcccacgtacgctgaatatggcaatgagcggaatgcgcgatctgtcgattatcgccacgccgcccgcccgtcgtctggcagttaaaacctttgtccgtgagtatgacagtctggtggtccgggaggcgatcctgcgtgaaattttgcgcggaggacaggtttattatctctacaatgatgtggaaaacatccagaaagccgccgaacggctggcagaactggtacctgaagcgcggattgccatcggtcacgggcaaatgcgtgagcgcgaactggaacgggtgatgaatgatttccatcatcaacgtttcaacgtgctggtttgtaccaccattatcgaaaccgggatcgacattcctaccgccaacaccattatcattgaacgcgcggatcacttcggtctggcacagttgcaccagttgcgcggtcgcgtcgggcgttctcaccaccaggcatatgcatggctactgacgccgcatccaaaagcgatgactaccgatgcgcaaaaacgtcttgaagcgattgcctcgctggaagatctcggtgcaggttttgcgctggcaacgcacgatctggagatccgcggcgcaggtgaactgcttggcgaagaacaaagcggctcaatggaaaccatcggtttctcgctgtatatggagttgctggaaaacgccgtcgatgcgctgaaagccggacgcgagccgtcgctggaagatctcaccagccagcaaacagaagtcgacctgcggatgccgtcgctattgccagatgatttcatccctgacgtgaacacgcgtctgtcgttctacaaacgtattgccagcgccaaaacggaaaacgaactggaagagatcaaagtcgagcttatcgatcgcttcggcctgctaccggatccggcgcgtaccctgctggatattgcccgtctgcgccagcaagcgcagaaactggggatcaggaagctggaaggtaatgagaaaggcggcgtgatcgaatttgccgagaagaatcacgttaatccggcctggttgattggtttgctgcaaaaacagccgcagcattaccgccttgatggtccgacgcgcctgaagtttattcaggatttgagtgagcggaaaacgcgtatcgaatgggtacgccagtttatgcgtgaactggaagagaacgcgatcgcttga

SEQ ID NO: 2908 - protein, 1169 aa, Escherichia coli
MLIRDMPPYVEAYPNENLTTVMPEQYRYTLPVKAGEQRLLGELTGAACATLVAEIAERHAGPVVLIAPDMQNALRLHDEISQFTDQMVMNLADWETLPYDSFSPHQDIISSRLSTLYQLPTMQRGVLIVPVNTLMQRVCPHSFLHGHALVMKKGQRLSRDALRTQLDSAGYRHVDQVMEHGEYATRGALLDLFPMGSELPYRLDFFDDEIDSLRVFDVDSQRTLEEVEAINLLPAHEFPTDKAAIELFRSQWRDTFEVKRDPEHIYQQVSKGTLPAGIEYWQPLFFSEPLPPLFSYFPANTLLVNTGDLENSAERFQADTLARFENRGVDPMRPLLPPQSLWLRVDELFSELKNWPRVQLKTEHLPTKAANANLGFQKLPDLAIQAQQKAPLDALRKFLETFDGPVVFSVESEGRREALGELLARIKIAPQRIMRLDEASDRGRYLMIGAAEHGFVDTMRNLALICESDLLGERVARRRQDSRRAINPDTLIRNLAELHIGQPVVHLEHGVGRYAGMTTLEAGGITGEYLMLTYANDAKLYVPVSSLHLISRYAGGAEENAPLHKLGGDAWSRARQKAAEKVRDVAAELLDIYAQRAAKEGFAFKHDREQYQLFCDSFPFETTPDQAQAINAVLSDMCQPLAMDRLVCGDVGFGKTEVAMRAAFLAVDNHKQVAVLVPTTLLAQQHYDNFRDRFANWPVRIEMISRFRSAKEQTQILAEVAEGKIDILIGTHKLLQSDVKFKDLGLLIVDEEHRFGVRHKERIKAMRANVDILTLTATPIPRTLNMAMSGMRDLSIIATPPARRLAVKTFVREYDSLVVREAILREILRGGQVYYLYNDVENIQKAAERLAELVPEARIAIGHGQMRERELERVMNDFHHQRFNVLVCTTIIETGIDIPTANTIIIERADHFGLAQLHQLRGRVGRSHHQAYAWLLTPHPKAMTTDAQKRLEAIASLEDLGAGFALATHDLEIRGAGELLGEEQSGSMETIGFSLYMELLENAVDALKAGREPSLEDLTSQQTEVDLRMPSLLPDDFIPDVNTRLSFYKRIASAKTENELEEIKVELIDRFGLLPDPARTLLDIARLRQQAQKLGIRKLEGNEKGGVIEFAEKNHVNPAWLIGLLQKQPQHYRLDGPTRLKFIQDLSERKTRIEWVRQFMRELEENAIA

SEQ ID NO: 2909 - DNA, 1074 bp, Escherichia coli
atgaaacaaaaagagctatggattaaccagatcaaagggttatgtatttgtctggtggtgatttatcactcggtcattaccttttatccgcatctgaccactttccagcatccgttatcagaagtcctgagcaaatgctggatctatttcaatctttaccttgcaccctttcgtatgccggtttttttctttatctctggctatttgattcgccgctatatcgacagcgtaccgtggggaaattgtctcgataaacgcatctggaacatcttctgggtgctggcgctttggggcgtggtgcagtggctggcgctaagtgcactaaatcagtggctggcacctgagcgcaatttaagcaatgcctccaatgccgcttatgccgattccaccggtgagttcctgcacgggatgatcaccgccagcaccagcttgtggtatctgtatgcgttaattgtctatttcgtgatatgtaaaatttttaaccgcctggccctgccgttatttgttctgtttatactgatgagtgtggctgttaatttcgtacccacaccgtggtggggaatgaacagtgtgagccgcaatttgccttattacagccttggcgcatggtttggcgcaacattaatgacctgtgttaaagcggtaccgttgcgccgccatctgctgatggcttctttgctggccgttctggcggtcggtgcctggttgtttaatatctcgctgctgttgtcgctggtatcgattgtggtgatcatgaagctgttttatcagtacgaacaacgtttcggtatgcgctccaccagcctgctgaatgtgattggttccaacaccattgctatctacaccacccatcgcattctggttgaaatattcagcttaactctgcttgcgcaaatgaacgcagcacgctggtcgccgcaagtcgaactgacactcctgctggtttacccctttgttagtttgttcatctgtactgttgcgggcttgctggtaagaaaactttcacagcgcgcattcagcgatctgttgttctccccgccttctctgcccgcggccgtcagttactcccgctaa

SEQ ID NO: 2910 - protein, 357 aa, Escherichia coli
MKQKELWINQIKGLCICLVVIYHSVITFYPHLTTFQHPLSEVLSKCWIYFNLYLAPFRMPVFFFISGYLIRRYIDSVPWGNCLDKRIWNIFWVLALWGVVQWLALSALNQWLAPERNLSNASNAAYADSTGEFLHGMITASTSLWYLYALIVYFVICKIFNRLALPLFVLFILMSVAVNFVPTPWWGMNSVSRNLPYYSLGAWFGATLMTCVKAVPLRRHLLMASLLAVLAVGAWLFNISLLLSLVSIVVIMKLFYQYEQRFGMRSTSLLNVIGSNTIAIYTTHRILVEIFSLTLLAQMNAARWSPQVELTLLLVYPFVSLFICTVAGLLVRKLSQRAFSDLLFSPPSLPAAVSYSR

SEQ ID NO: 2911 - DNA, 96 bp, Escherichia coli
ttgtgggctgagctttatctgaaaaataaccaaatacagacagatacgcattacaccacgcgactcgccccgcaggatcaaccgcatgttaaataa

SEQ ID NO: 2912 - protein, 31 aa, Escherichia coli
MWAELYLKNNQIQTDTHYTTRLAPQDQPHVK

SEQ ID NO: 2913 - DNA, 1311 bp, Escherichia coli
ttgccggtgcttttcagattagccctgacgatcacttacagttcagacgtttacccatcccgctttcgcttatatactcgtgtctttgctaacagcaaccagacggatttcatgtaccaacctgtcgctctatttattggcctgcgttacatgcgtgggcgtgcagcggatcgcttcggtcgtttcgtctcctggctttctaccatcggcattaccctcggggtgatggcgctggtcacagtattgtcagtgatgaacggctttgagcgcgagctgcaaaacaacatccttggcctgatgccacaggcaattctctcttctgagcatggctctcttaacccgcagcaactcccggaaacggcagtcaaactggacggcgttaatcgcgtcgcacctattactaccggtgatgtggtactgcaaagcgcgcgcagcgtggcggtcggggtgatgctgggtatcgacccggcgcaaaaagatccactaacgccgtatctggtcaatgtgaaacaaactgacctcgagccggggaaatataatgtcatcctcggtgaacagcttgcctcacagttgggcgtcaatcgcggtgatcaaatccgcgtgatggtgccatctgccagccagttcacgccgatggggcgtattccaagtcagcgcctgttcaatgtgattggcactttcgccgccaacagtgaagtcgatggctatgaaatgctggtgaatattgaggatgcctcgcgtctgatgcgttatccggcaggcaatattaccggctggcgtttgtggctggatgagccgctgaaagtcgactcattaagtcagcaaaaactgcctgaaggcagcaaatggcaggactggcgtgaccgtaaaggcgagctgttccaggccgtacgcatggaaaaaaatatgatgggcttgctgctgagcctgattgtcgccgttgcggcgtttaacattattacctcgctgggactgatggtgatggagaagcagggcgaagtggccattcttcagactcaggggctgactccgcgtcaaatcatgatggtctttatggtgcaaggggccagcgctgggattatcggtgcgatcctcggagcggcgcttggcgcactgcttgccagccagttgaataatctgatgccgataatcggcgtcctgcttgatggcgcggcgctgccggtcgctatcgagcctttacaggtcattgttattgcgctggtggcgatggctatcgcgctgctgtctacgctttacccttcctggcgcgctgccgccactcaacccgctgaggctttacgttatgaataa

SEQ ID NO: 2914 - protein, 436 aa, Escherichia coli
MPVLFRLALTITYSSDVYPSRFRLYTRVFANSNQTDFMYQPVALFIGLRYMRGRAADRFGRFVSWLSTIGITLGVMALVTVLSVMNGFERELQNNILGLMPQAILSSEHGSLNPQQLPETAVKLDGVNRVAPITTGDVVLQSARSVAVGVMLGIDPAQKDPLTPYLVNVKQTDLEPGKYNVILGEQLASQLGVNRGDQIRVMVPSASQFTPMGRIPSQRLFNVIGTFAANSEVDGYEMLVNIEDASRLMRYPAGNITGWRLWLDEPLKVDSLSQQKLPEGSKWQDWRDRKGELFQAVRMEKNMMGLLLSLIVAVAAFNIITSLGLMVMEKQGEVAILQTQGLTPRQIMMVFMVQGASAGIIGAILGAALGALLASQLNNLMPIIGVLLDGAALPVAIEPLQVIVIALVAMAIALLSTLYPSWRAAATQPAEALRYE

SEQ ID NO: 2915 - DNA, 645 bp, Escherichia coli
gtgcaaaccgatgtactgcacaatgtcagtttcagcgtgggcgaaggtgaaatgatggcgatcgtcggcagctctggttccggtaaaagcaccttgctgcacctgttaggcgggctggatacgccaacctccggcgatgtgatctttaacggtcaaccgatgagcaaactgtcgtcggcggccaaagcggaactgcgtaaccagaagctgggatttatttatcagtttcaccacctgttgccggattttaccgccctggaaaacgtggctatgccgctgttgattggcaagaaaaagcccgctgaaatcaacagccgtgcgctggagatgttaaaagcggtggggctggagcatcgtgcgaatcaccgcccatctgaactttctggcggcgaacgccagcgtgtggcgattgcccgtgcgctggtcaataacccgcggctggtactggcggatgaacctactggtaacctcgatgcacgtaacgccgacagcatcttccagttgcttggggaattgaatcgcttgcagggcaccgccttcctggtggttactcacgacctgcaactggcgaaacgtatgagccgccaactggaaatgcgtgatggacgtttgacggcggaactgagcctgatgggggcggagtaa

SEQ ID NO: 2916 - protein, 214 aa, Escherichia coli
MQTDVLHNVSFSVGEGEMMAIVGSSGSGKSTLLHLLGGLDTPTSGDVIFNGQPMSKLSSAAKAELRNQKLGFIYQFHHLLPDFTALENVAMPLLIGKKKPAEINSRALEMLKAVGLEHRANHRPSELSGGERQRVAIARALVNNPRLVLADEPTGNLDARNADSIFQLLGELNRLQGTAFLVVTHDLQLAKRMSRQLEMRDGRLTAELSLMGAE

SEQ ID NO: 2917 - DNA, 1245 bp, Escherichia coli
atggcgatgcctttatcgttattgattggcctgcgttttagccgcggacggcgacgcggcggcatggtgtcgttgatctccgtcatttctaccattggcattgccctgggcgtggcggtattgatcgtcggcttaagcgcgatgaacggctttgaacgcgaactgaataaccgcattctggcggtagtaccgcacggtgaaattgaggcggtagatcagccgtggaccaactggcaggaagcactggataacgtgcagaaagtgccgggcattgccgccgctgcgccgtatatcaatttcaccgggctggtggagagcggcgcgaatctgcgcgcaatccaggtgaagggcgttaacccgcaacaggaacagcgtctgagcgcattaccctcgtttgttcagggggatgcctggcgcaattttaaagcgggcgaacagcaaattatcatcggcaaaggcgtggcggatgcgctgaaagtgaagcagggcgattgggtgtcgattatgatcccaaattcgaatcccgagcataaactgatgcagccaaaacgtgtgcgtttgcacattgccggtattttgcagttgagtggccaactcgatcacagttttgccatgatcccgctggccgatgctcagcaatatcttgatatgggttccagcgtgtcaggtattgcccttaaaatgacggatgttttcaacgccaataagctggtacgcgatgcgggggaagtgaccaacagctatgtttatattaaaagctggattggtacttacggctatatgtatcgcgatatccagatgatccgcgccattatgtatctggcgatggtactggtgattggtgtggcctgtttcaacatcgtctccaccttagtgatggcggtgaaagacaagagtggcgatatcgcagtattaagaacgctgggggcgaaagatggtttaattcgcgccatctttgtctggtatggattgctggcagggctgttcggcagcctgtgtggtgtgattatcggcgtagttgtttcactgcaacttaccccgattattgagtggattgaaaagctgatcggtcatcagttcctctccagcgatatctattttattgacttcttgccatcggaattgcactggctggacgtcttctacgtactggtcacagcattgttgctgagtcttttggcaagctggtatccggcgcggcgcgccagtaatattgaccctgcgcgagtccttagcggccagtaa

SEQ ID NO: 2918 - protein, 414 aa, Escherichia coli
MAMPLSLLIGLRFSRGRRRGGMVSLISVISTIGIALGVAVLIVGLSAMNGFERELNNRILAVVPHGEIEAVDQPWTNWQEALDNVQKVPGIAAAAPYINFTGLVESGANLRAIQVKGVNPQQEQRLSALPSFVQGDAWRNFKAGEQQIIIGKGVADALKVKQGDWVSIMIPNSNPEHKLMQPKRVRLHIAGILQLSGQLDHSFAMIPLADAQQYLDMGSSVSGIALKMTDVFNANKLVRDAGEVTNSYVYIKSWIGTYGYMYRDIQMIRAIMYLAMVLVIGVACFNIVSTLVMAVKDKSGDIAVLRTLGAKDGLIRAIFVWYGLLAGLFGSLCGVIIGVVVSLQLTPIIEWIEKLIGHQFLSSDIYFIDFLPSELHWLDVFYVLVTALLLSLLASWYPARRASNIDPARVLSGQ

SEQ ID NO: 2919 - DNA, 912 bp, Escherichia coli
atgtattacgggtttgatattggtggaacaaaaattgcgctaggcgtgtttgatagcggtcggcagttgcagtgggaaaagcgggtgccgacaccgcgtgacagctatgacgcatttttagatgcagtgtgcgagctggtagccgaagctgaccggcgttttggctgtaaaggttctgtcggcatcggtattccgggaatgccggaaacagaagatggtacgctgtatgccgccaatgtccctgctgccagcggtaaaccgctgcgtgccgacctgagcgcacgtcttgatcgcgatgtacgccttgataacgatgccaactgctttgccctttctgaagcatgggatgatgaatttactcaatatccactggtgatggggttgattctcggcaccggcgttggcggcgggctgattttcaacggtaaacccattaccggtaaaagctatattaccggcgagtttggccatatgcgtctgccggttgatgcgttaaccatgatggggctggatttcccgttacgccgctgcggctgtggtcagcatggctgcattgaaaattatctgtctggtcgcggttttgcgtggctgtatcaacactattatcatcaaccgttgcaggctcctgagatcattgcgctttatgatcaaggcgatgagcaggcaagggcgcacgttgagcgttatctggatttattagcggtttgtctgggaaatatcctgaccattgttgaccctgacctggtcgtcattggtggtggcttatcgaatttcccggcaatcacaacgcaactggcggaaaggttgcctcgtcatctcttacctgtagctcgtgttccgcgcattgaacgcgcgcggcacggtgatgcggggggaatgcgtggtgcggccttcctacatctaaccgattaa

SEQ ID NO: 2920 - protein, 303 aa, Escherichia coli
MYYGFDIGGTKIALGVFDSGRQLQWEKRVPTPRDSYDAFLDAVCELVAEADRRFGCKGSVGIGIPGMPETEDGTLYAANVPAASGKPLRADLSARLDRDVRLDNDANCFALSEAWDDEFTQYPLVMGLILGTGVGGGLIFNGKPITGKSYITGEFGHMRLPVDALTMMGLDFPLRRCGCGQHGCIENYLSGRGFAWLYQHYYHQPLQAPEIIALYDQGDEQARAHVERYLDLLAVCLGNILTIVDPDLVVIGGGLSNFPAITTQLAERLPRHLLPVARVPRIERARHGDAGGMRGAAFLHLTD

SEQ ID NO: 2921 - DNA, 822 bp, Escherichia coli
atgctgtcgcgtcggggtcatcggttaagtcgttttcgtaaaaataaacgtcgcctgcgcgagcgtttgcgtcagcgtatttttttcagagataaagtggtgccggaagcaatggaaaaaccaagagtactcgtactgacaggggcagggatttctgcggaatcaggtattcgtacctttcgcgccgcagatggcctgtgggaagaacatcgggttgaagatgtggcaacgccggaaggttttgatcgcgatcctgaactggtgcaaacgttttataacgcccgtcgtcgacagctgcagcagccagaaattcagcctaacgctgcacatcttgcgctggctaaactgcaagatgctctcggcgatcgctttttgctggtgacgcagaatatcgacaatctgcatgaacgcgcaggtaataccaatgtcattcatatgcatggggaactgctgaaagtacgttgttcgcaaagtggccaggtcctcgactggaccggagacgttacgccagaagataaatgccattgttgccagttcccggcacccttgcgcccgcacgtagtgtggtttggcgaaatgccactcggtatggatgaaatttatatggcgttgtcgatggccgatattttcattgccattggtacttcggggcatgtttatccggcggctgggtttgttcacgaagcgaaactgcatggcgcgcacaccgtggaactgaatcttgaaccgagtcaggttggtaatgaatttgccgagaaatattacggtccggcaagccaggtggtgccagagtttgttgaaaagttgctgaagggattataa

SEQ ID NO: 2922 - protein, 273 aa, Escherichia coli
MLSRRGHRLSRFRKNKRRLRERLRQRIFFRDKVVPEAMEKPRVLVLTGAGISAESGIRTFRAADGLWEEHRVEDVATPEGFDRDPELVQTFYNARRRQLQQPEIQPNAAHLALAKLQDALGDRFLLVTQNIDNLHERAGNTNVIHMHGELLKVRCSQSGQVLDWTGDVTPEDKCHCCQFPAPLRPHVVWFGEMPLGMDEIYMALSMADIFIAIGTSGHVYPAAGFVHEAKLHGAHTVELNLEPSQVGNEFAEKYYGPASQVVPEFVEKLLKGL

SEQ ID NO: 2923 - DNA, 789 bp, Escherichia coli
atgaaaaaaatcataatattgctcagtttactgatactcctgcctctaacggcgaccagtaatccattgattccaataatgaagactctttttacagatgttaccggtactgtaccagatgctgaagagatcgcgcataaagccgagctttttcgccaacaaaccggagttgcaccgtttattgtggttttacccgacattaataatgaagccagtctcaggcaaaatggcaaagcgatgctggcgcatgcggcatcttcaatgagtaatgtaaaaggcagcgtcctgttactctttactacccgcgagccacggttaattatgataaccaacggccaggtcgaaagcagtatggacgataaacatctcggccttctggtagaaaatcacacgctggcttatttacatgcggatctctggtatcagggtatcaataatgcattggctgttttacaagcacaaatattaaaacaaccgacgccaccactgacatattatccgcatcccggacaacagcatgaaaatgatccacccggcagtaccacgacattaggcctttttgcctgggcagttgcattcatcgtctttgctgcattttttaactacacaacgcgcctttattatgcgttaaaatttgcagtggcgatggctgttgccaatatgggttatcaggctttatgtttgtatatcgataacagctttgcgattaccagaatatcgccactctgggcagggctgattggtgtctgtacgtttattgccgcgttactatggacgagtaaacggtaa

SEQ ID NO: 2924 - protein, 262 aa, Escherichia coli
MKKIIILLSLLILLPLTATSNPLIPIMKTLFTDVTGTVPDAEEIAHKAELFRQQTGVAPFIVVLPDINNEASLRQNGKAMLAHAASSMSNVKGSVLLLFTTREPRLIMITNGQVESSMDDKHLGLLVENHTLAYLHADLWYQGINNALAVLQAQILKQPTPPLTYYPHPGQQHENDPPGSTTTLGLFAWAVAFIVFAAFFNYTTRLYYALKFAVAMAVANMGYQALCLYIDNSFAITRISPLWAGLIGVCTFIAALLWTSKR

SEQ ID NO: 2925 - DNA, 504 bp, Escherichia coli
gtggtattaccgcccgttttttatttagcaaggatgtggctaatgagccaggacagtagagttttctttcgtatattcttcggtatcggtctggtactgatcctcatttctgttgttatcttttataaccagttcacctatagcaaagacgcgattcatactgaaggcgtcattgttgataccgtctggcactccagtcattctcatcgcacgggtaaaaatggttcgtggtatcccgtcgttgtctttcgtccgacgccagattacacgctaattttcaattcgagtattggcagcgatttttatgaagacagcgaaggcgataaagttaatgtttattattctccaggacatcctgaaaaggctgagataaataacccgtgggttaatttttttaaatgggggtttatcggcattatgggcgttatttttatcgccgtcggtttattaatcagtatgccctcctcaaaaaagacacgcaggaaacggaagtcccgcccatga

SEQ ID NO: 2926 - protein, 167 aa, Escherichia coli
MVLPPVFYLARMWLMSQDSRVFFRIFFGIGLVLILISVVIFYNQFTYSKDAIHTEGVIVDTVWHSSHSHRTGKNGSWYPVVVFRPTPDYTLIFNSSIGSDFYEDSEGDKVNVYYSPGHPEKAEINNPWVNFFKWGFIGIMGVIFIAVGLLISMPSSKKTRRKRKSRP

SEQ ID NO: 2927 - DNA, 1047 bp, Escherichia coli
atgaaaaaatggtcacgccacctgctcgcggcgggtgctctggcactgggcatgagcgccgctcacgccgatgacaacaacacgctgtatttctacaactggaccgagtacgtgccgccaggactgcttgaacagttcaccaaagaaaccggtattaaggttatctattcgacttacgagtcgaacgaaaccatgtacgcgaagctgaaaacgtacaaagacggtgcctatgacctggtggttccttcaacctattacgtcgataaaatgcgtaaagaagggatgatccagaagatcgacaagtcgaagttaagcaatttcagcaacctcgatccagacatgctcaacaagccgtttgacccgaataacgactattccattccgtatatctggggtgcaacggcgattggcgttaacggtgatgcggtggatccgaaatctgtcaccagctgggccgatctgtggaaacctgagtacaagggcagcctgctgctgaccgacgatgcccgtgaagtgttccagatggcgctgcgtaagctgggctactccggtaacaccaccgatccgaaagagattgaagctgcatacaacgagctgaaaaaactgatgccaaacgtcgcggcgtttaactccgataaccccgctaacccgtatatggaaggcgaagttaacctcggcatgatctggaacggttctgctttcgttgcacgccaggcgggtacgccaattgatgtggtatggccgaaagaaggcggcattttctggatggacagcctggcgatcccggcaaatgccaaaaacaaagaaggcgcgctgaaattgatcaacttcctgctgcgcccggatgtggcaaaacaggttgctgaaactatcggttatccaacgccaaaccttgcggcgcgtaagctgttaagtccggaagtggcgaacgataaaacgctctacccggatgctgaaaccattaaaaatggtgaatggcaaaatgacgtaggctccgccagcagcatttatgaagagtattatcagaagctgaaagcaggacgttaa

SEQ ID NO: 2928 - protein, 348 aa, Escherichia coli
MKKWSRHLLAAGALALGMSAAHADDNNTLYFYNWTEYVPPGLLEQFTKETGIKVIYSTYESNETMYAKLKTYKDGAYDLVVPSTYYVDKMRKEGMIQKIDKSKLSNFSNLDPDMLNKPFDPNNDYSIPYIWGATAIGVNGDAVDPKSVTSWADLWKPEYKGSLLLTDDAREVFQMALRKLGYSGNTTDPKEIEAAYNELKKLMPNVAAFNSDNPANPYMEGEVNLGMIWNGSAFVARQAGTPIDVVWPKEGGIFWMDSLAIPANAKNKEGALKLINFLLRPDVAKQVAETIGYPTPNLAARKLLSPEVANDKTLYPDAETIKNGEWQNDVGSASSIYEEYYQKLKAGR

SEQ ID NO: 2929 - DNA, 795 bp, Escherichia coli
atgatcggtcgactgcttcgcggcggttttatgaccgctatctacgcgtacctgtatatcccaatcattattttgattgtgaactcctttaacagctcgcgctttggcatcaactggcagggttttaccaccaaatggtatagcctgctgatgaacaacgacagcctgttacaggcagcgcagcattcactaacaatggcggtgttttcggcgacgtttgctacgcttatcggttcactgacggcagttgcgctgtaccgttatcgctttcgtggtaaaccgttcgttagcggaatgctgtttgtggtgatgatgtcaccagatatcgtgatggcgatttcgctgctggtgctgtttatgctgctgggtattcagcttggcttctggtcgctgctgttctcgcatatcaccttctgcctgccatttgtggtggtgacagtgtattcgcgcctgaaaggttttgacgtgcgaatgctggaagcggcgaaagatctcggtgccagcgaatttaccattctgcgaaaaatcattctgcctctggcaatgccagcggtagcggcgggctgggtgttaagctttaccctgtcgatggacgacgtggtggtttcttcgtttgtcaccgggccgagttatgaaattctgccgttaaaaatttattcgatggtcaaagtcggcgtatcgccggaagttaacgcgctggcaaccatattactggtgctgtcgctggtgatggtaattgccagccagcttattgctcgtgataaaacgaaaggtaacacaggggacgttaaatga

SEQ ID NO: 2930 - protein, 264 aa, Escherichia coli
MIGRLLRGGFMTAIYAYLYIPIIILIVNSFNSSRFGINWQGFTTKWYSLLMNNDSLLQAAQHSLTMAVFSATFATLIGSLTAVALYRYRFRGKPFVSGMLFVVMMSPDIVMAISLLVLFMLLGIQLGFWSLLFSHITFCLPFVVVTVYSRLKGFDVRMLEAAKDLGASEFTILRKIILPLAMPAVAAGWVLSFTLSMDDVVVSSFVTGPSYEILPLKIYSMVKVGVSPEVNALATILLVLSLVMVIASQLIARDKTKGNTGDVK

SEQ ID NO: 2931 - DNA, 858 bp, Escherichia coli
atgaagaacacaagtaagttccagaatgtagtgattgtcactattgtcggttggcttgtgttgtttgtctttctgcccaacctgatgatcattggcaccagctttttgacccgcgacgacgccagtttcgtcaaaatggtctttacgctggataactacacgcgtctgctcgatccgctctattttgaagtgctattgcactcgctgaatatggcgctgatcgccaccctcgcctgcctggtgctgggctatccttttgcctggtttctggcgaagctgccacacaaggtgcgtccgctgctgctgtttctgctgattgttccgttctggaccaactcattgattcgtatttacgggctgaaaattttcctcagcaccaaaggctatctcaacgagtttttgctctggctgggcgttatcgatacaccaattcgcatcatgttcacgcctagtgcggtgattatcggtctggtttacattctgctgccgtttatggtgatgccgctgtactccagtatcgaaaaactggataagccgttgcttgaggcggcgcgcgatctcggtgccagcaagttgcagacctttatccgcatcattatcccactaacgatgccgggaattattgccggatgtctgctggtgatgctgccagcgatgggcctgttctatgtgtccgacctgatgggcggtgcgaaaaacctgctgatcggtaacgtcatcaaggtacagttcctcaatattcgtgactggccgtttggtgcagccaccagcattacgctgactatcgtaatgggcctgatgttgctggtttactggcgcgcttctcgtctgctgaataagaaggtggaactcgaatga

SEQ ID NO: 2932 - protein, 285 aa, Escherichia coli
MKNTSKFQNVVIVTIVGWLVLFVFLPNLMIIGTSFLTRDDASFVKMVFTLDNYTRLLDPLYFEVLLHSLNMALIATLACLVLGYPFAWFLAKLPHKVRPLLLFLLIVPFWTNSLIRIYGLKIFLSTKGYLNEFLLWLGVIDTPIRIMFTPSAVIIGLVYILLPFMVMPLYSSIEKLDKPLLEAARDLGASKLQTFIRIIIPLTMPGIIAGCLLVMLPAMGLFYVSDLMGGAKNLLIGNVIKVQFLNIRDWPFGAATSITLTIVMGLMLLVYWRASRLLNKKVELE

SEQ ID NO: 2933 - DNA, 1137 bp, Escherichia coli
atgggacagagtaaaaaattgaataaacaaccgaattcgctttcaccgctggtgcaattggcgggaattcgcaaatgctttgatggtaaagaggtcattccccagctggatctgactatcaacaatggcgagttcctcacgctgcttggcccttctggctgcggtaaaacaaccgttcttcgcctgattgcaggtctggaaactgttgattccggacgcatcatgctggataacgaggacatcacccacgttccggcggaaaaccgctatgtgaacactgttttccaaagctacgcacttttcccccacatgaccgtgttcgaaaatgtggcctttgggttgcgcatgcaaaaaacccccgctgctgaaattacgccccgcgtgatggaagccctgcggatggtgcagctggaaaccttcgctcaacgcaaaccgcatcagctctctggtggtcaacagcaacgcgtcgccattgctcgcgcggtggttaacaagcctcgtctgttgttgctggatgagtcgctctcagcgctggattacaaactgcgcaagcaaatgcagaacgagctgaaagcgttacagcgtaagcttggcattacattcgtgttcgtaactcacgaccaggaagaagcacttaccatgtcggacaggatcgtggtgatgcgcgatggtcgcattgagcaagacggcacgccgcgtgaaatctacgaagagccgaaaaacctgtttgttgccgggtttattggcgaaatcaatatgtttaacgccactgtcatcgaacgtctcgacgagcagcgcgtacgcgccaacgttgaaggccgcgaatgtaatatctacgttaacttcgccgttgaaccggggcaaaaactgcatgttctgctgcgcccggaagacttacgtgttgaagagattaacgacgacaaccacgccgaagggctgattggttacgttcgcgagcgtaactacaaaggcatgacgctggagtcggttgttgagctggaaaatggcaagatggtgatggtcagcgaattcttcaatgaagacgatcctgactttgaccactctctcgaccaaaaaatggccattaattgggtagaaagctgggaggtcgtactggctgatgaagaacacaagtaa

SEQ ID NO: 2934 - protein, 378 aa, Escherichia coli
MGQSKKLNKQPNSLSPLVQLAGIRKCFDGKEVIPQLDLTINNGEFLTLLGPSGCGKTTVLRLIAGLETVDSGRIMLDNEDITHVPAENRYVNTVFQSYALFPHMTVFENVAFGLRMQKTPAAEITPRVMEALRMVQLETFAQRKPHQLSGGQQQRVAIARAVVNKPRLLLLDESLSALDYKLRKQMQNELKALQRKLGITFVFVTHDQEEALTMSDRIVVMRDGRIEQDGTPREIYEEPKNLFVAGFIGEINMFNATVIERLDEQRVRANVEGRECNIYVNFAVEPGQKLHVLLRPEDLRVEEINDDNHAEGLIGYVRERNYKGMTLESVVELENGKMVMVSEFFNEDDPDFDHSLDQKMAINWVESWEVVLADEEHK

SEQ ID NO: 2935 - DNA, 1227 bp, Escherichia coli
atggataaactacttgagcgatttttgaactacgtgtctctggatacccaatcaaaggcaggggtgagacaggttcccagcacggaaggccaatggaagttattgcatctgctgaaagagcagctcgaagagatggggcttatcaatgtgaccttaagtgagaagggcactttgatggcgacgttaccggctaacgtccctggcgatatcccggcgattggctttatttctcatgtggatacctcaccggattgcagcggcaaaaatgtgaatccgcaaattgttgaaaactatcgcggtggcgatattgcgctgggtatcggcgatgaagttttatcaccggttatgttcccggtgctgcatcagctactgggtcagacgctgattaccaccgatggtaaaaccttgttaggtgccgatgacaaagcaggtattgcagaaatcatgaccgcgctggcggtattgcaacaaaaaaacattccgcatggtgatattcgcgtcgcctttaccccggatgaagaagtgggcaaaggggcgaagcattttgatgttgacgccttcgatgcccgctgggcatacaccgttgatggtggtggcgtcggcgaactggagtttgaaaacttcaacgccgcgtcggtcaatatcaaaattgtcggtaacaatgttcacccgggcacggcgaaaggagtgatggtaaatgcgctgtcgctggcggcacgtattcatgcggaagttccggcggatgaaagcccggaaatgacagaaggctatgaaggtttctatcacctggcgagcatgaaaggcaccgttgaacgggccgatatgcactacatcatccgtgatttcgaccgtaaacagtttgaagcgcgtaaacgtaaaatgatggagatcgccaaaaaagtgggcaaagggttacatcctgattgctacattgaactggtgattgaagacagttactacaatatgcgcgagaaagtggttgagcatccgcatattctcgatatcgcccagcaggcgatgcgtgactgcgatattgaaccggaactgaaaccgatccgcggcggtaccgacggcgcgcagttgtcgtttatgggattaccgtgcccgaacctgttcactggcggttacaactatcatggtaagcatgagtttgtgactctggaaggtatggaaaaagcggtgcaggtgatcgtccgtattgccgagttgacggcgcaacggaagtaa

SEQ ID NO: 2936 - protein, 408 aa, Escherichia coli
MDKLLERFLNYVSLDTQSKAGVRQVPSTEGQWKLLHLLKEQLEEMGLINVTLSEKGTLMATLPANVPGDIPAIGFISHVDTSPDCSGKNVNPQIVENYRGGDIALGIGDEVLSPVMFPVLHQLLGQTLITTDGKTLLGADDKAGIAEIMTALAVLQQKNIPHGDIRVAFTPDEEVGKGAKHFDVDAFDARWAYTVDGGGVGELEFENFNAASVNIKIVGNNVHPGTAKGVMVNALSLAARIHAEVPADESPEMTEGYEGFYHLASMKGTVERADMHYIIRDFDRKQFEARKRKMMEIAKKVGKGLHPDCYIELVIEDSYYNMREKVVEHPHILDIAQQAMRDCDIEPELKPIRGGTDGAQLSFMGLPCPNLFTGGYNYHGKHEFVTLEGMEKAVQVIVRIAELTAQRK

SEQ ID NO: 2937 - DNA, 1131 bp, Escherichia coli
atgcttaacatggaataccaactcactcttaactggcccgattttcttgaacgtcactggcagaaacgcccggtggtgttaaaacgcggctttaataattttattgacccgatctctccagacgagttggcgggtctggcgatggaaagcgaagtcgacagtcgactggtcagtcatcaggatggcaaatggcaggtcagccacggtccattcgaaagctacgatcatctcggtgaaactaactggtcattgttagtgcaagcagtgaaccactggcatgagccgaccgctgcgctaatgcgaccgttccgtgaactaccggactggcgtattgatgatctgatgatctctttttctgtaccgggcggcggcgtcggcccgcatctcgatcagtacgacgtgtttatcattcagggtaccggtcgtcgtcgctggcgagtgggcgaaaagctgcaaatgaaacagcactgcccgcacccggacctgttacaggtcgatccgttcgaagccatcatcgatgaagagctggagcctggcgatattctttatattccgccaggattcccgcatgaaggctacgcgctggaaaatgcgatgaactattccgtgggttttcgcgcgccaaatacgcgggaactgattagcggatttgccgattatgtgctgcaacgtgaactgggcggcaactactacagcgatcctgatgttccacctcgcgctcatcctgcggacgttctgccgcaagagatggataaactgcgtgagatgatgctcgaattgatcaaccagccggaacactttaaacaatggtttggcgagtttatatcccagtcacgtcatgaactggacatcgcgccgccagagccgccttatcagccggatgaaatctacgatgcgctgaaacaaggtgatgtgctggtgcgcctggggggtctgcgcgtattgcgcattggcgacgacgtgtatgccaatggtgagaagatcgattccccgcaccgtccggcactggatgcgctcgccagcaacattgcgctgaccgcggagaattttggcgatgcgctggaagatccgtcattcctcgcgatgctcgcggcgctggtcaatagcggatactggttcttcgaagggtaa

SEQ ID NO: 2938 - protein, 376 aa, Escherichia coli
MLNMEYQLTLNWPDFLERHWQKRPVVLKRGFNNFIDPISPDELAGLAMESEVDSRLVSHQDGKWQVSHGPFESYDHLGETNWSLLVQAVNHWHEPTAALMRPFRELPDWRIDDLMISFSVPGGGVGPHLDQYDVFIIQGTGRRRWRVGEKLQMKQHCPHPDLLQVDPFEAIIDEELEPGDILYIPPGFPHEGYALENAMNYSVGFRAPNTRELISGFADYVLQRELGGNYYSDPDVPPRAHPADVLPQEMDKLREMMLELINQPEHFKQWFGEFISQSRHELDIAPPEPPYQPDEIYDALKQGDVLVRLGGLRVLRIGDDVYANGEKIDSPHRPALDALASNIALTAENFGDALEDPSFLAMLAALVNSGYWFFEG

SEQ ID NO: 2939 - DNA, 1383 bp, Escherichia coli
gtgctttcgcttgcctacggaatggttgcgctgatcggttatagcgtcagtttcgataaaaccacgtttcggctgttacgtggcgagagcaatctgttctatacccttgcgaagtgggaaaacaataagttgcatgtcgagttacccgaaaatatcgacaagcaaagccccacgatgacactaatttatgatgagaacgggcagcttttatgggcgcaacgtgacgtgccctggctgatgaagatgatccagcctgactggctgaaatcgaatggttttcatgaaattgaagcggatgttaacgataccagcctcttgctgagtggagatcattcgatacagcaacagttgcaggaagtgcgggaagatgatgacgacgcggagatgacccactcggtggcggtaaacgtctacccggcaacatcgcggatgccaaagttaaccattgtggtggtggataccattccggtggagctaaaaagttcctatatggtctggagctggtttatctatgtgctctcagccaatctgctgttagtgatcccgctgctgtgggtcgccgcctggtggagtttacgccccatcgaagccctggcaaaagaagtccgcgaactggaagaacataaccgtgaattgctcaatccagccacaacgcgagaactgaccagtctggtacgaaacctgaaccgactgttaaaaagtgaacgcgaacgttacgacaaatatcgtacaacgctcaccgacctgacccatagtctgaaaacgccactggcggtgctgcaaagtacgctgcgttctctgcgtagtgagaagatgagcgtcagtgatgctgagccggtaatgctggagcaaatcagccgcatttcacagcaaattggctactacctgcatcgtgccagtatgcgcggcgggacattgcttagccgcgagctgcatccggtcgcgccactgttggacaatctcacctcggcgctgaacaaagtgtatcaacgcaaaggtgtcaatatctctctcgatatctcgccagaaatcagctttgttggtgagcagaatgattttgtcgaagtgatgggcaacgtgctggataacgcctgtaaatattgcctcgagtttgtcgaaatttctgcaaggcaaaccgacgagcatctctatattgtggtcgaggatgatggccccggtattccattaagcaagcgagaggtcattttcgaccgtggtcaacgggttgatactttacgccctgggcaaggtgtggggctggcggtagcccgcgaaatcaccgagcaatatgagggtaaaatcgtcgccggagagagcatgctgggcggtgcgcggatggaggtgatttttggtcgccagcattctgcgccgaaagatgaataa

SEQ ID NO: 2940 - protein, 460 aa, Escherichia coli
MLSLAYGMVALIGYSVSFDKTTFRLLRGESNLFYTLAKWENNKLHVELPENIDKQSPTMTLIYDENGQLLWAQRDVPWLMKMIQPDWLKSNGFHEIEADVNDTSLLLSGDHSIQQQLQEVREDDDDAEMTHSVAVNVYPATSRMPKLTIVVVDTIPVELKSSYMVWSWFIYVLSANLLLVIPLLWVAAWWSLRPIEALAKEVRELEEHNRELLNPATTRELTSLVRNLNRLLKSERERYDKYRTTLTDLTHSLKTPLAVLQSTLRSLRSEKMSVSDAEPVMLEQISRISQQIGYYLHRASMRGGTLLSRELHPVAPLLDNLTSALNKVYQRKGVNISLDISPEISFVGEQNDFVEVMGNVLDNACKYCLEFVEISARQTDEHLYIVVEDDGPGIPLSKREVIFDRGQRVDTLRPGQGVGLAVAREITEQYEGKIVAGESMLGGARMEVIFGRQHSAPKDE

SEQ ID NO: 2941 - DNA, 672 bp, Escherichia coli
atgcgcgtactggttgttgaagacaatgcgttgttacgtcaccatcttaaagttcagatacaggatgctggtcatcaggtcgatgacgcagaagatgccaaagaagccgattattatctcaatgaacatttacctgatattgcgattgtcgatctcggattgcctgacgaggatggtctgtcactgattcgccgctggcgtagcaatgatgtttcactgccgattctggtattaaccgcccgtgagagctggcaggacaaagtcgaagtattaagtgccggtgctgatgattacgtgactaaaccgtttcatattgaagaggtgatggcgcgaatgcaggcattaatgcggcgtaatagcggtctggcttcacaggtcatttcgctaccaccgtttcaggttgatctctcccgccgtgaattatctattaatgacgaagtgatcaaactgaccgcgttcgaatacaccattatggaaacgttgatacgcaataatggcaaagtggtgagcaaagattcgttaatgctccaactctatccggatgcggagctgcgggaaagtcataccatagatgtactgatgggacgtctgcgcaaaaaaatacaggcacaatatccgcaagaagtgattaccaccgttcgcggccagggctatctgttcgaattgcgctga

SEQ ID NO: 2942 - protein, 223 aa, Escherichia coli
MRVLVVEDNALLRHHLKVQIQDAGHQVDDAEDAKEADYYLNEHLPDIAIVDLGLPDEDGLSLIRRWRSNDVSLPILVLTARESWQDKVEVLSAGADDYVTKPFHIEEVMARMQALMRRNSGLASQVISLPPFQVDLSRRELSINDEVIKLTAFEYTIMETLIRNNGKVVSKDSLMLQLYPDAELRESHTIDVLMGRLRKKIQAQYPQEVITTVRGQGYLFELR

SEQ ID NO: 2943 - DNA, 1371 bp, Escherichia coli
atggaattatcctcactgaccgccgtttcccctgtcgatggacgctacggcgataaagtcagcgcgctgcgcgggattttcagcgaatacggtttgctgaaattccgtgtacaagttgaagtacgttggctgcaaaaactggccgcgcacgcagcgatcaaggaagttcctgcttttgctgccgacgcaatcggttaccttgatgcaattgtcgccagtttcagcgaagaagatgcagcacgcatcaaaaccatcgagcgtaccactaaccacgacgttaaagcggttgagtatttcctgaaagaaaaagtggcggatatcccggaactgcacgcggtttctgaattcatccactttgcctgtacttcggaagatatcaataacctctcccacgcattaatgctgaaaaccgcgcgtgatgaagtgatcctgccgtactggcgtcaactgattgatggcattaaagatctcgccgttcagtatcgcgatatcccgctgctgtctcgtacccacggtcagccagccacgccgtcaaccatcggtaaagagatggctaatgtcgcctaccgtatggagcgccagtaccgccagcttaatcaggtggagatcctcggcaaaatcaacggcgctgtcggtaactacaacgcccacatcgccgcttacccggaagttgactggcatcagttcagcgaagagttcgtcacctcgctgggtattcagtggaacccgtacaccacccagatcgaaccgcacgactacattgccgaactgtttgattgcgttgcgcgcttcaacaccattctgatcgactttgaccgtgacgtctggggttatatcgcccttaaccacttcaaacagaaaaccattgctggtgagattggttcttccaccatgccgcataaagttaacccgatcgacttcgaaaactccgaagggaacctgggcctttccaacgcggtattgcagcacctggcaagcaaactgccagtttcccgctggcagcgtgacctgaccgactccaccgtgctgcgtaacctcggcgtgggtatcggttatgcgctgattgcgtatcaatccaccctgaaaggcgtgagcaaactggaagtgaaccgtgaccatctactggatgaactggatcacaactgggaagtgctggctgaaccaatccagacagttatgcgtcgctatggcatcgaaaaaccgtacgagaagctgaaagagctgactcgcggtaagcgcgttgacgccgaaggcatgaagcagtttatcgatggtctggcgttgccagaagaagagaaagcccgcctgaaagcgatgacgccggctaactacattggtcgcgccatcaccatggttgatgagctgaaataa

SEQ ID NO: 2944 - protein, 456 aa, Escherichia coli
MELSSLTAVSPVDGRYGDKVSALRGIFSEYGLLKFRVQVEVRWLQKLAAHAAIKEVPAFAADAIGYLDAIVASFSEEDAARIKTIERTTNHDVKAVEYFLKEKVADIPELHAVSEFIHFACTSEDINNLSHALMLKTARDEVILPYWRQLIDGIKDLAVQYRDIPLLSRTHGQPATPSTIGKEMANVAYRMERQYRQLNQVEILGKINGAVGNYNAHIAAYPEVDWHQFSEEFVTSLGIQWNPYTTQIEPHDYIAELFDCVARFNTILIDFDRDVWGYIALNHFKQKTIAGEIGSSTMPHKVNPIDFENSEGNLGLSNAVLQHLASKLPVSRWQRDLTDSTVLRNLGVGIGYALIAYQSTLKGVSKLEVNRDHLLDELDHNWEVLAEPIQTVMRRYGIEKPYEKLKELTRGKRVDAEGMKQFIDGLALPEEEKARLKAMTPANYIGRAITMVDELK

SEQ ID NO: 2945 - DNA, 642 bp, Escherichia coli
gtggcaaagaattactatgacatcaccctcgcccttgccggtatttgtcagtcggcacgcctggtgcaacaactcgctcaccaggggcattgtgatggcgatgcgctacacgtctcactcaacagtattatcgatatgaaccccagctcaacgctggcggtttttggcggtagcgaagccaacctgcgcgtcgggctggaaaccttgctcggcgtactcaatgccagcagtcgccagggcttaaacgccgaattaacccgctacacactcagtctgatggtgcttgagcgcaaactctcctcagcgaaaggtgcgctcgacactctgggcaaccggatcaacggcctgcaacgccagctcgaacacttcgatttacagtccgaaacgctgatgagcgcgatggctgccatctatgttgatgttatcagcccgcttggcccgcgcattcaggtcactggttcccctgctgtactgcaaagcccacaggtgcaggcgaaagttcgcgcaaccctgctggcaggcattcgcgccgccgtgctctggcaccaggtcggcggcggtcgtctgcaactgatgttttctcgtaatcgcctgaccactcaggcaaaacaaattcttgctcatttaaccccggagttgtga

SEQ ID NO: 2946 - protein, 213 aa, Escherichia coli
MAKNYYDITLALAGICQSARLVQQLAHQGHCDGDALHVSLNSIIDMNPSSTLAVFGGSEANLRVGLETLLGVLNASSRQGLNAELTRYTLSLMVLERKLSSAKGALDTLGNRINGLQRQLEHFDLQSETLMSAMAAIYVDVISPLGPRIQVTGSPAVLQSPQVQAKVRATLLAGIRAAVLWHQVGGGRLQLMFSRNRLTTQAKQILAHLTPEL

SEQ ID NO: 2947 - DNA, 1152 bp, Escherichia coli
gtgatagaatacgccgccttgaagttcaatgtcgtgagtgatccaatgtctgaaaccgcaaaaaaagtaatcgtcggcatgtccggcggtgtcgattcctccgtttctgcctggctgttgcaacaacagggatatcaggtcgaaggcctgtttatgaagaactgggaagaagacgacggtgaggaatattgcacagcggcagcggatctggctgatgcccaggctgtctgcgacaagctcggcattgaactgcacaccgttaactttgctgccgagtactgggacaacgtcttcgaactgttccttgccgaatataaagccggtcgcacgccaaatccggatattctgtgcaacaaagagatcaaatttaaagctttcctcgaatttgccgccgaagatttaggtgccgattatatcgctaccggtcattacgtacgtcgggcagatgtcgatggcaagagccgcctgctgcgtggcctggacagcaataaagaccagagctacttcctttatacgctcagccatgagcaaattgcgcaaagcctgttcccggtcggcgaactggaaaaaccgcaggtgcgtaagattgctgaagatctcggtctggtcaccgcgaagaaaaaagactctaccggtatctgctttatcggcgagcgtaaattccgcgagttcctgggccgttatctcccggcgcaaccgggcaaaatcattaccgtcgatggcgatgaaattggtgagcaccaggggctgatgtatcacaccctcggtcagcgtaaaggtctgggtatcggtggcaccaaagacggcaccgaagaaccgtggtatgtggtcgataaagacgtcgaaaacaacattctgattgttgcgcaaggccatgaacacccgcgtctgatgtctgtcggtctgattgcccagcagctgcactgggtcgatcgcgagccgttcaccggtactatgcgttgcacagtaaaaacccgctatcgccagaccgacatcccgtgcaccgtcaaggcgctggacgctgatcgcattgaagtgattttcgatgagccggttgccgccgtgacgccgggccagtctgccgttttctataacggtgaagtgtgcctcggtggcggtattattgagcagcgtctgccgctgccggtctga

SEQ ID NO: 2948 - protein, 383 aa, Escherichia coli
MIEYAALKFNVVSDPMSETAKKVIVGMSGGVDSSVSAWLLQQQGYQVEGLFMKNWEEDDGEEYCTAAADLADAQAVCDKLGIELHTVNFAAEYWDNVFELFLAEYKAGRTPNPDILCNKEIKFKAFLEFAAEDLGADYIATGHYVRRADVDGKSRLLRGLDSNKDQSYFLYTLSHEQIAQSLFPVGELEKPQVRKIAEDLGLVTAKKKDSTGICFIGERKFREFLGRYLPAQPGKIITVDGDEIGEHQGLMYHTLGQRKGLGIGGTKDGTEEPWYVVDKDVENNILIVAQGHEHPRLMSVGLIAQQLHWVDREPFTGTMRCTVKTRYRQTDIPCTVKALDADRIEVIFDEPVAAVTPGQSAVFYNGEVCLGGGIIEQRLPLPV

SEQ ID NO: 2949 - DNA, 462 bp, Escherichia coli
atgtttaaaccgcacgttaccgttgcctgcgtggtgcacgcagaaggcaaatttttagtcgttgaagagacgattaatggtaaagcgttatggaaccaacctgccgggcacctggaagccgatgaaaccttagtggaagccgccgcccgtgagctgtgggaagaaaccggcattagcgcgcagccgcaacactttattcgtatgcatcagtggattgcgccggataaaacgccgtttttgcgtttcctctttgccattgagcttgagcaaatatgcccgacgcagcctcatgacagcgatatcgactgctgccgttgggtcagcgccgaagaaattttacaggcgtcaaatcttcgttcgccgctggtggcggaaagtattcgttgttatcaaagcgggcaacgctatccgctggagatgattggcgattttaactggccttttacaaagggtgtcatctaa

SEQ ID NO: 2950 - protein, 153 aa, Escherichia coli
MFKPHVTVACVVHAEGKFLVVEETINGKALWNQPAGHLEADETLVEAAARELWEETGISAQPQHFIRMHQWIAPDKTPFLRFLFAIELEQICPTQPHDSDIDCCRWVSAEEILQASNLRSPLVAESIRCYQSGQRYPLEMIGDFNWPFTKGVI

SEQ ID NO: 2951 - DNA, 654 bp, Escherichia coli
atgcggcaattcataatctctgaaaataccatgcaaaaaacttcttttagaaatcaccaggttaagcgattcagctcgcaacgttctaccaggcgtaaacctgaaaaccagcccacgcgtgtgatcctgttcaataaaccctacgatgttcttccgcagttcaccgatgaagccggacgcaaaacattaaaagaattcatcccggttcagggggtgtatgcggcaggtcgtctcgaccgcgacagcgaagggttactggtgctgaccaataacggcgcgttgcaggcgcgtttaacccagccgggtaaacgcaccggaaaaatctattatgtgcaggtggaaggtattcccacacaagacgcacttgaagccttgcgcaatggcgtaaccttaaatgatggccctaccctgcccgcaggcgcggagctggttgaagaacccgcgtggttatggccgcggaatccaccaattcgtgagcgcaaaagtattcccaccagctggctgaagatcaccttatatgagggacgtaatcgccaggtgcgccgcatgaccgcccatgttggtttccccacgctgcgactgattcgctatgcgatgggggattactctttggataatcttgccaatggcgaatggcgagacgcgacagattaa

SEQ ID NO: 2952 - protein, 217 aa, Escherichia coli
MRQFIISENTMQKTSFRNHQVKRFSSQRSTRRKPENQPTRVILFNKPYDVLPQFTDEAGRKTLKEFIPVQGVYAAGRLDRDSEGLLVLTNNGALQARLTQPGKRTGKIYYVQVEGIPTQDALEALRNGVTLNDGPTLPAGAELVEEPAWLWPRNPPIRERKSIPTSWLKITLYEGRNRQVRRMTAHVGFPTLRLIRYAMGDYSLDNLANGEWRDATD

SEQ ID NO: 2953 - DNA, 1182 bp, Escherichia coli
atggcgcagcatcatctcagcggagagaataatagagcctgggtttactttgtcctgtccggcatatttcggcgcagtaccgtgggtggcttcaaacagggcgcattcgtcaccgatgtttgcgccaggggcgataccgataccaccaacctgcgctgccagggcgtcagaaatgtagtcaccgttcaggttcatacaggcgataacatcatattcagccggacgcagcaggatctgttgcaggaatgcatcagcaatcacgtctttaatgacgatctctttgccggtattcgggtttttaactttcagccacgggccgccgtcgatcagttcaccgccaaattcttcacgcgccagttggtagccccagtctttaaacgcgccttcggtgaacttcatgatgttgcctttgtgcaccagggtcacagagtcacgatcgttagcaattgcgtattcgatcgctgcacgaaccagacgtttggtgccttcttccgaacacggcttaataccgataccgcaatgttccgggaagcgaattttcttcacgcccatctcttcacgcaggaatttaatcactttctcagcgtcggcagagtctgctttccattcgatacccgcataaatgtcttccgagttttcacggaagataaccatatcggtcagttcagggtgtttaaccgggcttggagtgccctgatagtaacgtaccggacgcaggcagatgtagagatccagttcctggcgcagggcaacgttcagagagcgaataccgccaccaaccggagtggtcagcgggcctttaatggcaacgcgatattcacgaatcagatcaagggtttcagcaggcaaccagacgtcctgaccataaacctgtgtggatttttcaccggtgtaaatttccatccaggagattttacgctcgcctttataggctttctcaactgcagcgtcgaccactttcagcatggctggggttacatctacaccgattccatcaccttcaatgtaagggataatcggattttcaggaacgttgagtttgccgttttgcagggtgatcttcttgccttgtgccggaacaactactttactttccattcacctctccttcgagcgctactggtttgctcgtctaccaccacgttgcatatgcgtttgcgtcctgcgatacggatgctttag

SEQ ID NO: 2954 - protein, 393 aa, Escherichia coli
MAQHHLSGENNRAWVYFVLSGIFRRSTVGGFKQGAFVTDVCARGDTDTTNLRCQGVRNVVTVQVHTGDNIIFSRTQQDLLQECISNHVFNDDLFAGIRVFNFQPRAAVDQFTAKFFTRQLVAPVFKRAFGELHDVAFVHQGHRVTIVSNCVFDRCTNQTFGAFFRTRLNTDTAMFREANFLHAHLFTQEFNHFLSVGRVCFPFDTRINVFRVFTEDNHIGQFRVFNRAWSALIVTYRTQADVEIQFLAQGNVQRANTATNRSGQRAFNGNAIFTNQIKGFSRQPDVLTINLCGFFTGVNFHPGDFTLAFIGFLNCSVDHFQHGWGYIYTDSITFNVRDNRIFRNVEFAVLQGDLLALCRNNYFTFHSPLLRALLVCSSTTTLHMRLRPAIRML

SEQ ID NO: 2955 - DNA, 1251 bp, Escherichia coli
atggaaagtaaagtagttgttccggcacaaggcaagaagatcaccctgcaaaacggcaaactcaacgttcctgaaaatccgattatcccttacattgaaggtgatggaatcggtgtagatgtaaccccagccatgctgaaagtggtcgacgctgcagttgagaaagcctataaaggcgagcgtaaaatctcctggatggaaatttacaccggtgaaaaatccacacaggtttatggtcaggacgtctggttgcctgctgaaacccttgatctgattcgtgaatatcgcgttgccattaaaggcccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgctgagaaagtgattaaattcctgcgtgaagagatgggcgtgaagaaaattcgcttcccggaacattgcggtatcggtattaagccgtgttcggaagaaggcaccaaacgtctggttcgtgcagcgatcgaatacgcaattgctaacgatcgtgactctgtgaccctggtgcacaaaggcaacatcatgaagttcaccgaaggcgcgtttaaagactggggctaccaactggcgcgtgaagaatttggcggtgaactgatcgacggcggcccgtggctgaaagttaaaaacccgaataccggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggtggtatcggtatcgcccctggcgcaaacatcggtgacgaatgcgccctgtttgaagccacccacggtactgcgccgaaatatgccggacaggacaaagtaaacccaggctctattattctctccgctgagatgatgctgcgccatatgggttggactgaagcggctgacctgattgttaaaggtatggaaggcgcaatcaatgccaagaccgtaacctatgacttcgaacgtctgatggaaggcgctaaactgctgaaatgttcagagtttggtgacgcgatcatcaagaatatgtaa

SEQ ID NO: 2956 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGDAIIKNM

SEQ ID NO: 2957 - DNA, 1143 bp, Escherichia coli
atggctgctagaccccgatctcacaaaatctctatacccaatttatattgcaaattagataagcgaaccggaaaggtatattggcaatacaaacatccactatccggtcgttttcatagcttaggaactgatgagaatgaagcaaaacaagttgctactgaagcaaataccattattgctgaacaacgtaccagacaaatattaagcgtcaatgagcgtctggaaagaatgaaaggcaggcgctcagacattacggtgacagaatggcttgataaatatatttctatccaagaggacaggctgcaacataatgaactaagacccaactcctatcggcaaaaaggcaaacccattcgtcttttccgtgagcattgtggaatgcaacacctcaaggatattaccgcacttgatattgccgaaataattgatgctgtaaaggctgaaggtcataacaggatggcgcaagtcgtgagaatggtgttgatcgacgtcttcaaagaagcacaacacgcaggacatgttccgccaggatttaacccagcgcaggcaacaaaacaaccgcgaaatcgagtaaaccgccaaagattgtcactgcccgaatggcaggcaatatttgacagcgtaagcagacggcagccctatttaaaatgcggcatgctacttgctcttgttactggacaacgtttaggcgatatctgcaatttgaaattctctgatatatgggacgacatgttgcacattactcaggaaaaaaccggttcaaaacttgctattccgcttaacctgaaatgcgatgctctgaatattacccttcgtgaagttatatctcagtgcagggatgctgttgttagtaaatatctggtccattaccgtcacactacctctcaagcaaacagaggagaccaggtttctgcgaatactctgacaacggcttttaaaaaggcccgggaaaaatgtggcataaaatgggagcaaggaactgcgcccacatttcatgagcagcgatctctgtcagaacggttatatcgggaacagggtctggatacgcaaaagttgttaggccataaatccagaaaaatgaccgaccgatacaatgatgatcgtggtaaagactggattatcgtagatatcaaaacagcatag

SEQ ID NO: 2958 - protein, 380 aa, Escherichia coli
MAARPRSHKISIPNLYCKLDKRTGKVYWQYKHPLSGRFHSLGTDENEAKQVATEANTIIAEQRTRQILSVNERLERMKGRRSDITVTEWLDKYISIQEDRLQHNELRPNSYRQKGKPIRLFREHCGMQHLKDITALDIAEIIDAVKAEGHNRMAQVVRMVLIDVFKEAQHAGHVPPGFNPAQATKQPRNRVNRQRLSLPEWQAIFDSVSRRQPYLKCGMLLALVTGQRLGDICNLKFSDIWDDMLHITQEKTGSKLAIPLNLKCDALNITLREVISQCRDAVVSKYLVHYRHTTSQANRGDQVSANTLTTAFKKAREKCGIKWEQGTAPTFHEQRSLSERLYREQGLDTQKLLGHKSRKMTDRYNDDRGKDWIIVDIKTA

SEQ ID NO: 2959 - DNA, 327 bp, Escherichia coli
atggctaacctgcaacttgctgttaaaagtgaatacttcgatgccatgattcgcggagagaaaacggaagagtatcgcttgtgtaatgactactggaataagcgaattatgttccgggaatatgaccgcctgattatcacaaagggatatccgaagcgcgacgattccagtcgcagaattgatgttccgtatgacggatatgaagtgaagacaatcacacatccgcactttggcgataaaccggtaaaggtgttcgctataaaggtgaatatcagcactgaatatcaatccgcacaacacaaggtcaagaatgttcagagtgattga

SEQ ID NO: 2960 - protein, 108 aa, Escherichia coli
MANLQLAVKSEYFDAMIRGEKTEEYRLCNDYWNKRIMFREYDRLIITKGYPKRDDSSRRIDVPYDGYEVKTITHPHFGDKPVKVFAIKVNISTEYQSAQHKVKNVQSD

SEQ ID NO: 2961 - DNA, 183 bp, Escherichia coli
atgacccatcctcacgataatatccgggtaggcgcgatcactttcgtctactccgttacaaagcgaggctgggtatttcacggtctttctgttatccgaaatccgctgaaagcccagcggctggctgaggagataaataataaacggggggcggtatgcacaaagcatctcctgttgagttaa

SEQ ID NO: 2962 - protein, 60 aa, Escherichia coli
MTHPHDNIRVGAITFVYSVTKRGWVFHGLSVIRNPLKAQRLAEEINNKRGAVCTKHLLLS

SEQ ID NO: 2963 - DNA, 681 bp, Escherichia coli
atgacaccggacattatcctgcagcgtaccgggatcgacgtgagagctgtcgaacagggggatgatgcatggcacaaattacggctcggcgtcatcaccgcttcagaagttcacaacgtgatagcaaagccccgctcaggaaagaagtggcctgacatgaaaatgtcctacttccacaccctgctggctgaggtttgcaccggtgtggctccggaagttaatgctaaggcgctggcgtggggaaaacagtacgagaacgacgccagaaccctgtttgaattcacttccggcgtgaatgttactgaatccccgatcatctatcgcgacgaaagtatgcgcaccgcctgctctcccgatggtttatgcagtgacggcaatggccttgagctgaaatgcccgtttacctcccgggatttcatgaagttccggctcggtggtttcgaggccataaagtcggcttacatggcccaggtgcagtacagcatgtgggtgacacgaaaagatgcctggtactttgccaactatgacccacgaatgaagcgtgaaggcctgcattatgtcgtggttgagcgggatgaaaagtacatggcgagttttgacgagatggtgccggagttcatcgaaaaaatggacgaagcactggctgaaattggttttgtatttggagagcaatggcgatga

SEQ ID NO: 2964 - protein, 226 aa, Escherichia coli
MTPDIILQRTGIDVRAVEQGDDAWHKLRLGVITASEVHNVIAKPRSGKKWPDMKMSYFHTLLAEVCTGVAPEVNAKALAWGKQYENDARTLFEFTSGVNVTESPIIYRDESMRTACSPDGLCSDGNGLELKCPFTSRDFMKFRLGGFEAIKSAYMAQVQYSMWVTRKDAWYFANYDPRMKREGLHYVVVERDEKYMASFDEMVPEFIEKMDEALAEIGFVFGEQWR

SEQ ID NO: 2965 - DNA, 786 bp, Escherichia coli
atgagtacagcactcgcaacgctggcagggaagctggctgaacgtgtcggcatggattctgtcgacccacaggaactgatcaccactcttcgccagacggcatttaaaggtgatgccagcgatgcgcagttcatcgcattgttgatcgtcgccaaccagtacggccttaatccgtggacgaaagaaatttacgccttccctgataagcagaacggcattgttccggtggtgggcgttgatggctggtcccgcatcatcaatgaaaaccagcagtttgatggtatggactttgagcaggacaatgaatcatgtacatgccggatttaccgcaaagaccgcaatcatccgatctgcgttaccgagtggatggatgaatgccgccgcgaaccattcaaaacccgcgaaggcagagaaatcacggggccgtggcagtcgcatcccaaacggatgttacggcataaagccatgattcagtgtgcccgtctggccttcggatttgctggtatctatgacaaggatgaagccgagcgcattgtcgaaaataccgcatacactgcagaacgtcagccggaacgcgacatcactccggttaacgatgaaaccatgcaggagattaacactctgctgattgccctggacaaaacatgggatgacgacttattgccgctctgttcccagatatttcgccgcgacattcgcgcatcgtcagaactgacacaggccgaagcagtgaaagctcttggattcctgaaacagaaagccactgagcagaaggtggcagcatga

SEQ ID NO: 2966 - protein, 261 aa, Escherichia coli
MSTALATLAGKLAERVGMDSVDPQELITTLRQTAFKGDASDAQFIALLIVANQYGLNPWTKEIYAFPDKQNGIVPVVGVDGWSRIINENQQFDGMDFEQDNESCTCRIYRKDRNHPICVTEWMDECRREPFKTREGREITGPWQSHPKRMLRHKAMIQCARLAFGFAGIYDKDEAERIVENTAYTAERQPERDITPVNDETMQEINTLLIALDKTWDDDLLPLCSQIFRRDIRASSELTQAEAVKALGFLKQKATEQKVAA

SEQ ID NO: 2967 - DNA, 297 bp, Escherichia coli
atgaacgcttattacattcaggatcgtcttgaggctcagagctgggcgcgtcactaccagcagatcgcccgtgaagagaaagaggcagaactggcagacgacatggaaaaaggcctgccccagcacctgtttgaatcgctatgcatcgatcatttacaacgccacggggccagcaaaaaagccattacccgtgcgtttgatgacgatgttgagtttcaggagcgcatggcagaacacatccggtacatagttgaaaccattgctcaccatcaggctgatattgattcagaggtataa

SEQ ID NO: 2968 - protein, 98 aa, Escherichia coli
MNAYYIQDRLEAQSWARHYQQIAREEKEAELADDMEKGLPQHLFESLCIDHLQRHGASKKAITRAFDDDVEFQERMAEHIRYIVETIAHHQADIDSEV

SEQ ID NO: 2969 - DNA, 270 bp, Escherichia coli
atgccattgcagggtggcctgttgctggctgcccttccgaatctttacttgaacgaatcacccgtaaattacgtgacggatggaaacgccttatcgacatacttaatcagccaggagtcccaaaaaatggatcaaacaattatggctatccagactaaattcactatcgccacttttattggcgatgaaaagatgtttcgtgaggccgtcgacgcttataaaaaatggatattaatactgaaactgagatcaagcaaaagcattcactaa

SEQ ID NO: 2970 - protein, 89 aa, Escherichia coli
MPLQGGLLLAALPNLYLNESPVNYVTDGNALSTYLISQESQKMDQTIMAIQTKFTIATFIGDEKMFREAVDAYKKWILILKLRSSKSIH

SEQ ID NO: 2971 - DNA, 165 bp, Escherichia coli
atgcaatatgccattgcagggtggcctgttgctggctgcccttccgaatctttacttgaacgaatcacccgtaaattacgtgacggatggaaacgccttatcgacatacttaatcagccaggagtcccaaaaaatggatcaaacaattatggctatccagactaa

SEQ ID NO: 2972 - protein, 54 aa, Escherichia coli
MQYAIAGWPVAGCPSESLLERITRKLRDGWKRLIDILNQPGVPKNGSNNYGYPD

SEQ ID NO: 2973 - DNA, 369 bp, Escherichia coli
atgtcaaacatcaaaaaatacatcattgattacgactggaaagcatcaatagaaattgaaattgaccatgacgtaatgacagaggaaaaacttcaccagattaataatttctggtcagactctgaataccgactcaataaacacggctctgtattaaatgctgtattaatcatgctggcgcaacatgctctgcttatagcaatttcaagcgacttaaatgcatatggtgttgtgtgtgagttcgactggaatgatggaaatggtcaggaaggatggcctccaatggatggtagtgaaggaataagaattaccgatatcgatacatcaggaatatttgattcagatgatatgactatcaaggccgcctga

SEQ ID NO: 2974 - protein, 122 aa, Escherichia coli
MSNIKKYIIDYDWKASIEIEIDHDVMTEEKLHQINNFWSDSEYRLNKHGSVLNAVLIMLAQHALLIAISSDLNAYGVVCEFDWNDGNGQEGWPPMDGSEGIRITDIDTSGIFDSDDMTIKAA

SEQ ID NO: 2975 - DNA, 114 bp, Escherichia coli
ttgatttccggtagcctgccgcgtaaagagctacgttcggaagacaagttgaaccttcatattttctggtcaacgttgtcagagttatcacttctgctctcattgctggtttga

SEQ ID NO: 2976 - protein, 37 aa, Escherichia coli
MISGSLPRKELRSEDKLNLHIFWSTLSELSLLLSLLV

SEQ ID NO: 2977 - DNA, 618 bp, Escherichia coli
  n 4, 5, 6, 7, 8: n is any nucleotide
atgnnnnnggtttgccttattcctggcaaagttggtgttcaggatcctcagtttgcgattgaaggcctgctcaattacgcgatggcactggataacccgacattgaacaaattgagtgaagaaacccggttacagatcatcccttaccttgtgaattttgcctttgctgattattccaggtctgcggcaagtaaggctcgctgtgagcattgtactggtactggatttcataatgtattgcgcgaagtggtgaaacattccagaagcggggaatccgttatcaaagaagagtgggtgaaggaactgtgtcagcattgtcatggcaagggagaagtcagcacggcgtgcagagggtgtaagggtaaaggtattgtcctggatgaaaaaagaacccggcttcatggcacgcctgtttataagacttgtgggcgttgcaatggaaaccggtttagccgtttaccgactacactggcacgacgtcatgtccagaagctggttccagacctgactgattatcagtggtacaaaggatatgcagacgtaattgataaactagtaacaaagtgctggcaggaagaagcatatgctgaaacacaattgagaaaggtgacgagataa

SEQ ID NO: 2978 - protein, 205 aa, Escherichia coli
  Xaa 2, 3: Xaa is any amino acid
MXXVCLIPGKVGVQDPQFAIEGLLNYAMALDNPTLNKLSEETRLQIIPYLVNFAFADYSRSAASKARCEHCTGTGFHNVLREVVKHSRSGESVIKEEWVKELCQHCHGKGEVSTACRGCKGKGIVLDEKRTRLHGTPVYKTCGRCNGNRFSRLPTTLARRHVQKLVPDLTDYQWYKGYADVIDKLVTKCWQEEAYAETQLRKVTR

SEQ ID NO: 2979 - DNA, 477 bp, Escherichia coli
atgcaaaatcttaatcctcagcgtaaagctttcctcgatatggtggcctggtcagaaggaacggataatgggctacaaccgacacgtaatcatggttatgacgtcattgtgggcggagaaatattcactgattactccgatcaccctcgcagacttgtcacgctaaacccaaaactcaaatcaacggctgccgggcgctaccagcttctttcccgctggtgggatgcataccgtaaacagcttggactgaaagacttctctccaaaaagccaggatgctgttgcactgcagcagattaaagagcgtggtgctttaccgatgattgatcgcggtgatattcgtcaggctatcgaccgttgcagcaatatctgggcttcactgccgggagctggttatggtcagtttgagcataaggctgacagcctgattgcaaaattcaaagaagccggcggaacggtcaaagagattcaggtatga

SEQ ID NO: 2980 - protein, 158 aa, Escherichia coli
MQNLNPQRKAFLDMVAWSEGTDNGLQPTRNHGYDVIVGGEIFTDYSDHPRRLVTLNPKLKSTAAGRYQLLSRWWDAYRKQLGLKDFSPKSQDAVALQQIKERGALPMIDRGDIRQAIDRCSNIWASLPGAGYGQFEHKADSLIAKFKEAGGTVKEIQV

SEQ ID NO: 2981 - DNA, 438 bp, Escherichia coli
atgagcagagtaacggtgattatatccgctctggttatctgcatcatcgtctgcttgtcatgggctgttgataattaccgtgatgacgccatcgtctacaaagtacagcgcgataaagccacatccatcatcgctgatatgcagaagcgtcaacgtaatgtagctgaactcgatgccagatatacaaaggagcttgctgatgctaatgcgactatcgaaagtcttcgtgctgatgtttctgctgggcataagcgcctgcaagtcgccgccacctgtacaaagtcaacgaccggagccagcggcatgggcgatggagaaagccctagacttacagcagatgctgaactccattattaccgtctccgaagtggaatcgacaagataacctcacaggtcaattacttgcaggagtatatcaggacgcaatgtcccaactaa

SEQ ID NO: 2982 - protein, 145 aa, Escherichia coli
MSRVTVIISALVICIIVCLSWAVDNYRDDAIVYKVQRDKATSIIADMQKRQRNVAELDARYTKELADANATIESLRADVSAGHKRLQVAATCTKSTTGASGMGDGESPRLTADAELHYYRLRSGIDKITSQVNYLQEYIRTQCPN

SEQ ID NO: 2983 - DNA, 252 bp, Escherichia coli
atgatgaacttggcaaaggatatgattatgcgtattaaacctcaagattttaagtttgatgtgttgactgttgctggttacgctaaccctaaagctaaaacacatttcgcaccttctgcttctggatttaattttaaatgggagtgggaagggaaaatttatgagcttcatatcgagcaagaaaaattacagtaccctgattttattcttgaacgactttttgatgccgcaattgagatggctaaaaaatga

SEQ ID NO: 2984 - protein, 83 aa, Escherichia coli
MMNLAKDMIMRIKPQDFKFDVLTVAGYANPKAKTHFAPSASGFNFKWEWEGKIYELHIEQEKLQYPDFILERLFDAAIEMAKK

SEQ ID NO: 2985 - DNA, 351 bp, Escherichia coli
atgcccccacgaaccccaaaagcctgccgcgttcgcggctgccgccaaaccaccactgatccgtcaggctattgtgaaagccacaaaagcgaaggctggaaacaatacaagccaggacaatcccgtcaccagcgcggctacggttcgaagtgggatgttatccgcgcgcgcgtgctgaagcgtgacaaaggcctgtgtcagttgtgcctgcatgtcggtgtggtgcgtgaggcgaaaaccgttgaccacatcatccctaaagcgcatggcggcactgatgcagactgcaatctgcagagcctgtgctggccgtgtcataaggcgaagacggcccgtgaacgactgaagtga

SEQ ID NO: 2986 - protein, 116 aa, Escherichia coli
MPPRTPKACRVRGCRQTTTDPSGYCESHKSEGWKQYKPGQSRHQRGYGSKWDVIRARVLKRDKGLCQLCLHVGVVREAKTVDHIIPKAHGGTDADCNLQSLCWPCHKAKTARERLK

SEQ ID NO: 2987 - DNA, 495 bp, Escherichia coli
atggctggaacggcggggcgttccgggcgtcgccccaagccaacggcgcgcaaggcgctggccggaaaccccggcaagcgagccctgaacaaagatgaacctgtttttacgcccatcaaaggtgttgagccaccggagtggttcgctgaagaagatctccctctcgccacgatcatgtggcaactgacaaccaaagaactctgcggtcagggcctgctgtgcgtgactgacctcgcggtgcttgagcggtggtgcgtggcctatgagttctggcgacgtgctgtgaaaaatattgccatacagggcaataccatcaccggcgcaatgggcggcagggtcaaaaatccggagctgacagccaaaaaagaacaggagtccgagatgagcagcacgggggcaatgctcggactcgaccccagcagccgtcagcgtctgattggcctggcggggcagaagaaagccactaacccgtttctgaaaatcatcgaatcatga

SEQ ID NO: 2988 - protein, 164 aa, Escherichia coli
MAGTAGRSGRRPKPTARKALAGNPGKRALNKDEPVFTPIKGVEPPEWFAEEDLPLATIMWQLTTKELCGQGLLCVTDLAVLERWCVAYEFWRRAVKNIAIQGNTITGAMGGRVKNPELTAKKEQESEMSSTGAMLGLDPSSRQRLIGLAGQKKATNPFLKIIES

SEQ ID NO: 2989 - DNA, 1734 bp, Escherichia coli
atgagccggaaatcttaccccaacgtaaatgctgccaatcagtatgcccgggatgtcgtgcgcggaaagattgtggcctgccagtttgtgattcaggcctgccagcgccatcttgatgacctgatggcggaaaaaagtaagtcgtttcgttaccgcttcgacaaggacctggctgaacgggccgccaaatttattcagctgttgccgcacaccaagggtgagtgggcatttaagaggatgcccatcacgctggagccgtggcagctctttgtgatctgctgcgcgtttggctgggtcaataaaggctcccggctgcgccgcttccgggaggtgtataccgaaatcccccgtaagaacggcaaatcggcaatctctgccggtgttgccctgtattgttttgcctgtgataacgagtttggcgcggaagtgtattccggtgccacgacagagaaacaggcgtgggaagtctttcgcccggctcgactgatgtgtaaacgcacacccatgctgacggaagcgttcgggattgaggttaacgcctcaaacatgaaccgtccggaggatggcgcgcggtttgaaccgctgatcggtaaccccggtgatggttcatcaccccactgtgcggtggtggatgaatatcacgagcacgccaccgatgcgctttacaccacgatgcttaccgggatgggggcgcgacgtcagccactgatgtgggctatcaccaccgccgggtacaacattgaggggccgtgctacgacaagcggcgggaagtcatcgagatgctcaatggctcggtgcctaacgatgaactgttcgggatcatctataccgttgatgaaggtgacgactggaccgacccgcaggtgctggaaaaagccaatccaaatattggcgtgtcggtttatcgcgaatttttgttaagtcagcagcagcgtgcgaaaaataacgcccgtctggcaaacgtctttaaaacaaaacacctcaatatctgggtgtcggcgcgttcggcgtatttcaacctggtgagctggcagagctgcgaggataaatcactgacccttgagcagttcgaggggcagccgtgcattctggcctttgacctggcgcgtaagctggatatgaacagcatggcgcgactttatacccgcgagattgacggtaaaacgcattactacagtgtggccccgcgtttctgggtaccgtatgacacggtgtacagcgtcgagaaaaatgaagatcgacggacagccgaacgctttcagaaatgggtggaaatgggcgttctgaccgttaccgatggtgcggaggtggattatcgctacatcctcgaggaggccaaagcggcgaacaaaatcagcccggtcagtgagtcacccatcgaccccttcggggcgaccgggttgtcacatgaccttgctgatgaagacctgaaccccatcactatcattcagaactacaccaacatgtccgacccgatgaaagagctggaagcggcaattgaatcggggcgctttcatcatgatggcaatcccatcatgacctggtgtatcggcaacgtggtcggcaaaaccattccgggtaacgatgatgtggtgaaacccgtcaaagagcaggcggaaaacaaaatcgatggtgcagttgcgctgattatggcggttggcagagccatgttgtacgagaaagaagacacgctgtctgaccacattgagtcctacgggatccgctcgctttaa

SEQ ID NO: 2990 - protein, 577 aa, Escherichia coli
MSRKSYPNVNAANQYARDVVRGKIVACQFVIQACQRHLDDLMAEKSKSFRYRFDKDLAERAAKFIQLLPHTKGEWAFKRMPITLEPWQLFVICCAFGWVNKGSRLRRFREVYTEIPRKNGKSAISAGVALYCFACDNEFGAEVYSGATTEKQAWEVFRPARLMCKRTPMLTEAFGIEVNASNMNRPEDGARFEPLIGNPGDGSSPHCAVVDEYHEHATDALYTTMLTGMGARRQPLMWAITTAGYNIEGPCYDKRREVIEMLNGSVPNDELFGIIYTVDEGDDWTDPQVLEKANPNIGVSVYREFLLSQQQRAKNNARLANVFKTKHLNIWVSARSAYFNLVSWQSCEDKSLTLEQFEGQPCILAFDLARKLDMNSMARLYTREIDGKTHYYSVAPRFWVPYDTVYSVEKNEDRRTAERFQKWVEMGVLTVTDGAEVDYRYILEEAKAANKISPVSESPIDPFGATGLSHDLADEDLNPITIIQNYTNMSDPMKELEAAIESGRFHHDGNPIMTWCIGNVVGKTIPGNDDVVKPVKEQAENKIDGAVALIMAVGRAMLYEKEDTLSDHIESYGIRSL

SEQ ID NO: 2991 - DNA, 183 bp, Escherichia coli
atgatcatgctgattctcgcgcctctggtgggcgtgctgggtgcgcttttgctggcatatggtgcctggctgatttatcccccggcgggttttgttgttgccggggcgctgtgcctgttctggtcgtggctggtggcgcgatatctcgatcgtacacagctgtctgtcggcggaggtaaatag

SEQ ID NO: 2992 - protein, 60 aa, Escherichia coli
MIMLILAPLVGVLGALLLAYGAWLIYPPAGFVVAGALCLFWSWLVARYLDRTQLSVGGGK

SEQ ID NO: 2993 - DNA, 1242 bp, Escherichia coli
gtgttcttttcgggattatttcaacgaaaaagtgacgcgccggtgaccacgccagcagagctggcggaggctatcgggctgtcatacgacacctataccggaaagcagatcagcagccagcgggccatgcgactgacggcggttttttcctgcgtcagggtgctggcagagtcggtcgggatgttgccctgcaatctgtatcacctgaacggcagcctgaaacagagggccaccggcgaacgtctgcataagctgatctccacgcatcccaatggctatatgacgccgcaggagttctgggagctggtggtcacctgtctgtgcctgcggggaaacttttacgcctacaaagtgaaagcatttggcgaagtggctgaactgctgcccgtcgatcctggctgtgtggtaccgaagcttaacagtagctgggagccggtctatcaggtcacattctcggacggctccacggatgtgctgagccaggaagatatctggcatgtgcgcacgctgacgctggacggtctggtggggctgaatcccatcgcctatgcccgcgaggcaatatcgctggcagctgcgaccgaagagcacggggccagactgttcagcaatggtgcggtgacgtcgggtgtgttgcgtacagagcagacgctgtcagatcaggcttacgagcgcctgaagaaagattttgaggagcgtcacaccgggcttggtaatgctcaccgcccgatgatccttgagatggggctggactggaagtcgatggcgctgaacgccgaggacagccagttcctggaaacccgcaagtttcagcttgaagaaatctgtcgtctgttccgggtgccgttgcacatggtgcagaacaccgatcgcgccaccttcaacaatattgaagagctggggctgggatttatcaactattcactggtgccgtatctgacccgcatcgagcagcggatcaacaccggactggttcgaaaaagtaagcagggcgtttattacgccaaatttaacgccggggcgttactgcgcggggatatgaagtcccgttttgaagcctacgccaccgggattaactggggaatttactctcccaatgactgccgcgacctggaagatatgaatccccgtcccggtggggatgtctatctcacaccgatgaacatgaccacgaaaccctccgatggcagtaaagccggtaagcagaaggataacgccaatgcagacgaaacaacgtcttga

SEQ ID NO: 2994 - protein, 413 aa, Escherichia coli
MFFSGLFQRKSDAPVTTPAELAEAIGLSYDTYTGKQISSQRAMRLTAVFSCVRVLAESVGMLPCNLYHLNGSLKQRATGERLHKLISTHPNGYMTPQEFWELVVTCLCLRGNFYAYKVKAFGEVAELLPVDPGCVVPKLNSSWEPVYQVTFSDGSTDVLSQEDIWHVRTLTLDGLVGLNPIAYAREAISLAAATEEHGARLFSNGAVTSGVLRTEQTLSDQAYERLKKDFEERHTGLGNAHRPMILEMGLDWKSMALNAEDSQFLETRKFQLEEICRLFRVPLHMVQNTDRATFNNIEELGLGFINYSLVPYLTRIEQRINTGLVRKSKQGVYYAKFNAGALLRGDMKSRFEAYATGINWGIYSPNDCRDLEDMNPRPGGDVYLTPMNMTTKPSDGSKAGKQKDNANADETTS

SEQ ID NO: 2995 - DNA, 651 bp, Escherichia coli
atgcagacgaaacaacgtcttgatgtaccgctgagtctgaaatctgtcagtgactccggtgagtttgaagggtatggctccgtctttggtgtaaaggacagccacgatgatgtggtgatgtccggggcatttgctgcttccctgcgggcgtggagtgacagaaaagcgttacctgcgctgctctggcagcaccgcatggatgaacccatcggtgtttacaccgaaatgaaggaagacgatgtcgggctttacgtcaggggacggttgcttattgatgatgatcccctcgcaaaacgcgcacatgcacacatgaaggccggttcgttaaccggcctttctattgggtacgtcctgaaagactgggaatacgaccggagcaaagaagcctttctgctgaaagaaatcgacctctgggaagtcagcctggtgacgttcccgtctaacgacgaggcgcggatcagcgacgtcaagaacgcactggcccgcggggaaatccccgaacagaaaaaaatcgaaagagtcctgcgtgatgtcggactctcccgtacccaggccaaagcattcatggccgggggctatggcgcactgtccctgcgcgacgctgaggatgtgggctctgcactgaatgcactgaaaaatctgaacttctaa

SEQ ID NO: 2996 - protein, 216 aa, Escherichia coli
MQTKQRLDVPLSLKSVSDSGEFEGYGSVFGVKDSHDDVVMSGAFAASLRAWSDRKALPALLWQHRMDEPIGVYTEMKEDDVGLYVRGRLLIDDDPLAKRAHAHMKAGSLTGLSIGYVLKDWEYDRSKEAFLLKEIDLWEVSLVTFPSNDEARISDVKNALARGEIPEQKKIERVLRDVGLSRTQAKAFMAGGYGALSLRDAEDVGSALNALKNLNF

SEQ ID NO: 2997 - DNA, 1206 bp, Escherichia coli
atggcggttgatattaaagatgtcgaacaggtcgcgcaggagctgcagcagaagtttgacgacttcaaagcaaagaacgacaagcgcgtggatgcgattgagcaggaaaaaggcaaacttgccgggcaggtggaaaccctgaacgggaaactcagcgagctggaaaacctcaaaagcgatcttgaaaaagagctgcttgagctgaaacgtccggcaggtggtgcgcaaaataaactggccaccgagcataaagaagcgtttgtgggcttcctgcgtaaaggccgtgaagatggtctgcgcgatctggagcgcaaggcattgcaggtgggcaccgatgaagacggcggctatgccgtgccggaagcactggatcgcaacattctcaccctgctgaaagatgaagtggtgatgcgccaggaagccacggtgatcaccgttggtggttccgactacaaaaaactggtgaatctgggcggcacggcttccggatgggttggcgagactgacgcgcgctcccagactgccacctcaaaactgggcctgattgaacctttcatgggggaaatctacggtaacccgcaggccacccagaaaatgctggatgatgcctttttcaacgtggaagcatggatcaacagcgagctggcaaccgaatttgccgaacaggaagaaattgcctttaccaccggcgatggtaccaagaagccgaaagggttcctggcgtatgaatccactgatgaaaccgataaggtccgggcgttcggcaaacttcagcatattgtatccggcgaagcgacggcggtgaccgcagacgccattatcaaactgatttacacgctgcgtaaggcacaccgcactggcgcgaagttcatgatgaacaacaacagcctgtttgccatccgtctgcttaaagacagcgagggtaactatctgtggcgtccggggctggaactggggcagccgtcctctctggcgggttacggtatcgctgaaaacgaacagatgccggatatcgccgctgatgcgaaagccattgcatttggtaacttcaaacggggttacaccatcgttgaccgtatcggcacccgcattctgcgtgacccgtacaccaataaaccgtttgtcggtttttataccaccaagcgcaccggcgggatgctggtcgattcgcaggccatcaaactgctgaagattgcagcggcgtaa

SEQ ID NO: 2998 - protein, 401 aa, Escherichia coli
MAVDIKDVEQVAQELQQKFDDFKAKNDKRVDAIEQEKGKLAGQVETLNGKLSELENLKSDLEKELLELKRPAGGAQNKLATEHKEAFVGFLRKGREDGLRDLERKALQVGTDEDGGYAVPEALDRNILTLLKDEVVMRQEATVITVGGSDYKKLVNLGGTASGWVGETDARSQTATSKLGLIEPFMGEIYGNPQATQKMLDDAFFNVEAWINSELATEFAEQEEIAFTTGDGTKKPKGFLAYESTDETDKVRAFGKLQHIVSGEATAVTADAIIKLIYTLRKAHRTGAKFMMNNNSLFAIRLLKDSEGNYLWRPGLELGQPSSLAGYGIAENEQMPDIAADAKAIAFGNFKRGYTIVDRIGTRILRDPYTNKPFVGFYTTKRTGGMLVDSQAIKLLKIAAA

SEQ ID NO: 2999 - DNA, 201 bp, Escherichia coli
atgatcctgaaacaagatctgaaatggtcaccggacggtatgcgtgttgaggtcattcgggccggtgagtatgacgatggggcgcttcctgcccgggtgcaggagattgcacttcaggccgggttagcagagcgcggaatcagtgcaaaaagcagtaaagcggcaaaagagaaaaaagccacgaccagtaaagagggctga

SEQ ID NO: 3000 - protein, 66 aa, Escherichia coli
MILKQDLKWSPDGMRVEVIRAGEYDDGALPARVQEIALQAGLAERGISAKSSKAAKEKKATTSKEG

SEQ ID NO: 3001 - DNA, 324 bp, Escherichia coli
atgcttctgacaatggaagagattaaagcccaactccggctggatgaggatttcgatgctgatgaccgccatctgcaactgctggcctgtgcggcacaaaagcggacggaaacgtatctgaaccggaagctctatgcaccggatgaaaccattccggacagcgatccggacgggctgcacctgccggatgatattcgtctggggatgctgatgcttatcagccatttttacgaaaaccgctcgtcggttacggaagtggagaaactcgacatgccgcagagttttggctggcttgtcggcccgtacaggtactttccgcaatga

SEQ ID NO: 3002 - protein, 107 aa, Escherichia coli
MLLTMEEIKAQLRLDEDFDADDRHLQLLACAAQKRTETYLNRKLYAPDETIPDSDPDGLHLPDDIRLGMLMLISHFYENRSSVTEVEKLDMPQSFGWLVGPYRYFPQ

SEQ ID NO: 3003 - DNA, 411 bp, Escherichia coli
atgaaaattcgtcaggcgcagaccagcgcaacctacattctgccggaccccggtgaactgaataaacgcgtcctgatccgcctgcgggtggatatgcccgcggataactttggcgtggagcctcaatacctgattacgttccggacatgggcgaaggttatccagaccagtgccaccacctggcaggaaaccgcgcagaccggggacgccatcacccattacatcaccattcgttaccgccgggggattaccgctgattatgaggtggtctgcggtgacagtgtgtaccgggtgaaacgtcagcgcgatctgaacggggcgcggcgctttctgctgctggagtgtacggagctgggcgaatgtaggcagagtcacggaggcaacaatgacgacttcctttttgcacgttga

SEQ ID NO: 3004 - protein, 136 aa, Escherichia coli
MKIRQAQTSATYILPDPGELNKRVLIRLRVDMPADNFGVEPQYLITFRTWAKVIQTSATTWQETAQTGDAITHYITIRYRRGITADYEVVCGDSVYRVKRQRDLNGARRFLLLECTELGECRQSHGGNNDDFLFAR

SEQ ID NO: 3005 - DNA, 588 bp, Escherichia coli
atgttcgatatcgccgtcagacccgttaccgggatcgagataatcaacatcaatcgccagcgttcgcagttcatccagactgttcaggtcatcctgctggcgggtatcgtcttcggtcagctctctgatgaccgaaaaatcgaactgataaatcagctcatgacgattcagatccagcagcgtgccgccgtcataggtaatcgggttaccgcacgcttccgggttccagcccagcagggccttaaagagcatctgccggacatcgtccaccacatcatacgaggcaaactgaccgcgctcatcacgtccgttactcagtatgacaaccacggagaagccctctttcagctcctgccagtagtcggtctggcttttgttttctcccggagagtcatcacccggtaccacatatgccgccgggagtctcagctttccgacctccggcagatttttgaactgtgccgcgcctgccacccggttttcaaaatacgggcagcgggcacgcagcgcagcaataacaggcgtcagtttcatctgcgtcgtcgctccggcttcagtgatttacgtaattcccgcgccagaaaatag

SEQ ID NO: 3006 - protein, 195 aa, Escherichia coli
MFDIAVRPVTGIEIININRQRSQFIQTVQVILLAGIVFGQLSDDRKIELINQLMTIQIQQRAAVIGNRVTARFRVPAQQGLKEHLPDIVHHIIRGKLTALITSVTQYDNHGEALFQLLPVVGLAFVFSRRVITRYHICRRESQLSDLRQIFELCRACHPVFKIRAAGTQRSNNRRQFHLRRRSGFSDLRNSRARK

SEQ ID NO: 3007 - DNA, 561 bp, Escherichia coli
atgaaactgacgcctgttattgctgcgctgcgtgcccgctgcccgtattttgaaaaccgggtggcaggcgcggcacagttcaaaaatctgccggaggtcggaaagctgagactcccggcggcatatgtggtaccgggtgatgactctccgggagaaaacaaaagccagaccgactactggcaggagctgaaagagggcttctccgtggttgtcatactgagtaacggacgtgatgagcgcggtcagtttgcctcgtatgatgtggtggacgatgtccggcagatgctctttaaggccctgctgggctggaacccggaagcgtgcggtaacccgattacctatgacggcggcacgctgctggatctgaatcgtcatgagctgatttatcagttcgatttttcggtcatcagagagctgaccgaagacgatacccgccagcaggatgacctgaacagtctggatgaactgcgaacgctggcgattgatgttgattatctcgatcccggtaacgggtctgacggcgatatcgaacatcacaccgaaataccccttccttcctga

SEQ ID NO: 3008 - protein, 186 aa, Escherichia coli
MKLTPVIAALRARCPYFENRVAGAAQFKNLPEVGKLRLPAAYVVPGDDSPGENKSQTDYWQELKEGFSVVVILSNGRDERGQFASYDVVDDVRQMLFKALLGWNPEACGNPITYDGGTLLDLNRHELIYQFDFSVIRELTEDDTRQQDDLNSLDELRTLAIDVDYLDPGNGSDGDIEHHTEIPLPS

SEQ ID NO: 3009 - DNA, 171 bp, Escherichia coli
atgtttgtgaaacctgttaaagggcggtcagtgcctgaccctgcccgcggcgaccttttgcccgccgaagggcgaaatgttgatgagaacaactactggctgcgccgtgaagcagcgggtgatatccggcgcgtgaataaaaaggtgaacaccgatgacgataagctttaa

SEQ ID NO: 3010 - protein, 56 aa, Escherichia coli
MFVKPVKGRSVPDPARGDLLPAEGRNVDENNYWLRREAAGDIRRVNKKVNTDDDKL

SEQ ID NO: 3011 - DNA, 1497 bp, Escherichia coli
atgacgataagctttaacaccattccgtcgaatacgctggttccgctgttttatgcggaaatggataaccaggctgcgaatactgcacaggacagcggagcatcgctgctgattggtcatgccaataacggtgcagagattgttgccaacagtctggtactgatgccgtcggcagactatgcacgccagatttgtggtgcgggaagtcagctggcgcgtatggtcgaggcttatcgccagactgacccgtttggcgagctgtatgtgattgccgttcctgaatccacaggcgcggcggcaacggttacgctgacggtgaccggggcggcaaccgaaaccggcacggtgaatgtgtatgtgggacgtacccgcgtgcaggtaccggtgactaacggcgataacgttacgatgattgccagcagtatccaggatgccatcaatgccgttccgaccctgccgtttacggcttcatcttcggcaggcgtggtcacactgaccgcgcgtcataaggggctttgcgggaatgaaattcctgtcagcctcaattactacggctttggtgggggcgaagtgctgccagcgggcgtacagattgccgtggtgacgggtaccgccggaacgggtgctccggttctcaccggcgctgtggctgcaatggcggatgagccgtttgattatatcggcctgccgttcaacgacacggcctccgttaacacgctggtgaccgagatgaacgataccagcggtcgctggagctatgcgcgtcagctgtatggtcatgtgtatacggcaaagaccggcacgctgtcagaactggtgaccgcaggtgaccagtttaaccagcagcacattaccctggcggggtacgaaaaagacacccagacgcctgccgacgagctggcggcaagccgtaccgcccgcgcagcggtgtttatccgcaacgatccggcacgtcccacgcagaccggtgagctggtgggtatgctgcctgcgccgaaggggaaacggttcacgatgaccgaacaaaagaccctgctgtctcatggcgtggcaacggcgtatgtcgaaagcggggtactgcgcattcagcgtgatgtcaccacgtacaggaaaaacgcttacggggttgcggataacagctacctcgacagcgagacgctgcataccagtgcgtatgtactgcgcaaactgaaatccgtcattaccagtaagtacgggcgtcacaagcttgccagcgacggtacccgctttggtcccggtcaggcgattgtcaccccggcggtgatcaaaggggaactgctggcaacctaccgtcagcttgagcgtgcggggatcgtggaaaactacgaactttttaagcagtacctggttgtggagcgtgatgccagcgatccgaaccgcctgaacacgctgttcccgcctgactatgttaaccagttgcgtgtctttgccgtggttaaccagttccgtcttcagtattcagaggagtccgcataa

SEQ ID NO: 3012 - protein, 498 aa, Escherichia coli
MTISFNTIPSNTLVPLFYAEMDNQAANTAQDSGASLLIGHANNGAEIVANSLVLMPSADYARQICGAGSQLARMVEAYRQTDPFGELYVIAVPESTGAAATVTLTVTGAATETGTVNVYVGRTRVQVPVTNGDNVTMIASSIQDAINAVPTLPFTASSSAGVVTLTARHKGLCGNEIPVSLNYYGFGGGEVLPAGVQIAVVTGTAGTGAPVLTGAVAAMADEPFDYIGLPFNDTASVNTLVTEMNDTSGRWSYARQLYGHVYTAKTGTLSELVTAGDQFNQQHITLAGYEKDTQTPADELAASRTARAAVFIRNDPARPTQTGELVGMLPAPKGKRFTMTEQKTLLSHGVATAYVESGVLRIQRDVTTYRKNAYGVADNSYLDSETLHTSAYVLRKLKSVITSKYGRHKLASDGTRFGPGQAIVTPAVIKGELLATYRQLERAGIVENYELFKQYLVVERDASDPNRLNTLFPPDYVNQLRVFAVVNQFRLQYSEESA

SEQ ID NO: 3013 - DNA, 357 bp, Escherichia coli
atggcccgtatcgggggaacctgttatttcaaaattgacggtcagcagctatcgctgaccggcggcattgaggtgcccatgaacaggacggtcaatgatgacatcatcggcctggacggttcagtggaccgcaaggaaactcaccgtgcgccttatgttaaagggaccttcaaggtgccgaagaattttccggtgagcaaaatcacctcgtctgatgagatgaccatcactgccgagctggcgaacggtcaggtctatgtactgtcgtctgcctggctgcacggcgaagcgaaccataatgccgaagaagggacggttgatcttgagttccacggtgaagaaggggattaccagtaa

SEQ ID NO: 3014 - protein, 118 aa, Escherichia coli
MARIGGTCYFKIDGQQLSLTGGIEVPMNRTVNDDIIGLDGSVDRKETHRAPYVKGTFKVPKNFPVSKITSSDEMTITAELANGQVYVLSSAWLHGEANHNAEEGTVDLEFHGEEGDYQ

SEQ ID NO: 3015 - DNA, 324 bp, Escherichia coli
gtgatcaacgccttaagctcaaattcagccatgtgtgcgtttctcctgctctatcctgtttgcctgactgaccagcaagggaatttcactgatcggcatattcagcaattcgaagggattaatgcgccagtagctggcgcagtcaaagaagcgatcagtgaggtattcagccgtcaggcctggaggaaaaaaccagccacaagccacgccgcagcattcaggtctgccggagacatctggtcgacagagttttgcggcactttcgccagccgcacaatgtatttcgataccacatgcgccagaagtctgacggactcatcctga

SEQ ID NO: 3016 - protein, 107 aa, Escherichia coli
MINALSSNSAMCAFLLLYPVCLTDQQGNFTDRHIQQFEGINAPVAGAVKEAISEVFSRQAWRKKPATSHAAAFRSAGDIWSTEFCGTFASRTMYFDTTCARSLTDSS

SEQ ID NO: 3017 - DNA, 270 bp, Escherichia coli
atgaaagagcttgagttaaagaaaccgattaccgctcatggcgagacactctccgtactggagtttgatgagcccaccgggaaagatgtccgcgagctggggtatccctaccagatgaatcaggatgagtccgtcagacttctggcgcatgtggtatcgaaatacattgtgcggctggcgaaagtgccgcaaaactctgtcgaccagatgtctccggcagacctgaatgctgcggcgtggcttgtggctggttttttcctccaggcctga

SEQ ID NO: 3018 - protein, 89 aa, Escherichia coli
MKELELKKPITAHGETLSVLEFDEPTGKDVRELGYPYQMNQDESVRLLAHVVSKYIVRLAKVPQNSVDQMSPADLNAAAWLVAGFFLQA

SEQ ID NO: 3019 - DNA, 1836 bp, Escherichia coli
atggctgaatttgagcttaaggcgttgatcaccggtgtcgacaggctttctcccgcgctgtcgaaaatgcaaaagaaaatccggggatttaaacgccaggcggaagaagcgtcacagggtgggctggcgcttggtggcggactggctgcgggtctgacgctttccctgaaatcttatgccgatcaggaaaacgccgccaccgggctgaaagttgccatgatggatgcgaacggtgaggtcggaaagcgctttcaggacatcaataaactggctattggtctgggtaaccagctacccggtacaacggctgatttccagaacatgatgcagatgctggtgcgtcaggggatcccggcagaaaacattcttggcggtgtgggtaaagcgacagcttatcttgcggtacaactgaaaaaaacaccggaagcggctgccgagtttgccgcaaagatgcaggatgctaccggaacggcgtcagaagacatgatggggctgttcgacactatccagaaggcgttttatctgggcgttgacgataccaacatgttgtccttcttcactaaaaccagctctgttctgaagatggtgaacaaggacggtcttcaggctgcacagagccttgcccccatcagcgtcatgatggatcagatggggatgaacggggagtcggcaggtaacgccctgcgaaaagttatccagtccggattaagcgttaagaaaatcagggacgtcaataaagtcatggcccgccagaaactcggggtacagctcgattttactgacggcaaagggagttttggcggtcttgataacatgttcaggcaactggcaaagctgcgaaaactgaccgacgttaagcgaactggtgtacttaaggcaatatttggtgatgatgccgaaacccttcaggtggtcaatgcactaatcgataaaggaaaggatggctacgaccagatccagcagaagatgaataaacaggccagtctgaataaacgtgttcaggcacagcttggtacgctgtccaacctgtgggaggcaatgacagggaccgcaactaacggccttgcggctattggcggcgcattttctggtgacgctaaaaatatcacgcaatggctgggggagttgggggagaaattcacgaagtttgcggatgaaaatccccgggttattcgcggcgtcgtcgggcttgctgccggtcttgcgattctgaaactgggattgatgggcgttggcggtgccatcagtattgtcagcaggatcatgtcgatgacgccgattggcatgattgcgacggcgatagccctggctgcgggattaattatcactaactgggatgttgtcggaccttatttcaagaagctctgggaaaccattggtccttattttgaggctggccgggaacttctgaagaaggtttttgcctggtcgccgctggggatggtaatcaataactggggaccggttgttaagtggtttcaggatatgtgggacaagctgaagccaattattgagtggtttaccgacagttccggtgacacggtcgatgccattaactctgcgcagtggggcgcgggtgcttatgatgcttatgggacgggaataccggcacggggatacacaccttatcaggcggtggatccggctcagtcaaacaacgcctccggtgccacaggcccgaatcccttcatgattaacaaagcttctgcgccaaaagttgatggtgagatcaaggtctcttttgtgaattcacctccgggtatgcgggttatggaaacgcgatccagcggttttgatgtcagccatgatgttggctatacgcgctttggcaggtaa

SEQ ID NO: 3020 - protein, 611 aa, Escherichia coli
MAEFELKALITGVDRLSPALSKMQKKIRGFKRQAEEASQGGLALGGGLAAGLTLSLKSYADQENAATGLKVAMMDANGEVGKRFQDINKLAIGLGNQLPGTTADFQNMMQMLVRQGIPAENILGGVGKATAYLAVQLKKTPEAAAEFAAKMQDATGTASEDMMGLFDTIQKAFYLGVDDTNMLSFFTKTSSVLKMVNKDGLQAAQSLAPISVMMDQMGMNGESAGNALRKVIQSGLSVKKIRDVNKVMARQKLGVQLDFTDGKGSFGGLDNMFRQLAKLRKLTDVKRTGVLKAIFGDDAETLQVVNALIDKGKDGYDQIQQKMNKQASLNKRVQAQLGTLSNLWEAMTGTATNGLAAIGGAFSGDAKNITQWLGELGEKFTKFADENPRVIRGVVGLAAGLAILKLGLMGVGGAISIVSRIMSMTPIGMIATAIALAAGLIITNWDVVGPYFKKLWETIGPYFEAGRELLKKVFAWSPLGMVINNWGPVVKWFQDMWDKLKPIIEWFTDSSGDTVDAINSAQWGAGAYDAYGTGIPARGYTPYQAVDPAQSNNASGATGPNPFMINKASAPKVDGEIKVSFVNSPPGMRVMETRSSGFDVSHDVGYTRFGR

SEQ ID NO: 3021 - DNA, 1329 bp, Escherichia coli
atgacgtggaaagacagacttcaggacgcgtcatttcgcggtgtgccgtttaaggttgaagaagaaagtgcgggaaccggtcgtcgtgtggaaacgcacgaatacccgaaccgcgacaaaccctataccgaagacctggggaaaatcactttccgcccgtccatcacagcttatgtggtgggagatgactgctttgaccagcgcgatcgcctgattgacgcgctgaataaacccggtcccggcacgcttgtccatccgacttacggtgagctgaaagtctgtgttgacggggaagttcgggtcagcacatcgaagagtgaagggcgtattgtccgctttgacctgaagtttgtcgaagcgggagaactctcttaccccacttcaggtgcggcgacggcgcagacgctgatgtcatcctgttctgcactggatgactgcatcagtgacagcttcagtggtttcagtatcgatggcgtggcagattttgtgcagaacgacgtcgtcggtaatgccagcacaatgcttgggtatgtttctgatgcgatgaaagtggtggattctgccgtatcggatgccgccaggctgttgcagggggatatctcggtacttctgccgccgccatcgtcaggcaaaaatttcgttgagcaggtgcagaaaatgtggcgtaccgggaaacgcctttatggtaacgccagcgacctggtcaccatgatcaaaacgctttccggtgtcagcctcggcagcgatctgcaaccgcgcggcgtctggaaaacggacagtaaaaccaccgccacggcgacgcagcagcgtaacgtggttgccagcacccttcgtacgaccgcaatcagcgaagcggcgtatgccgtcacacgattgcctgcgcccacaacttccgcggtgatgcagaatgccacagtggggcagtcaacaacacccgcgcagagcaccggctggccttctgtcacgcatccggcactgaacaatgcaccggcggtgaaaaacacggttgacctgccaacgtgggaagaactgaccgacattcgcgacacactgaatacggcaattgataaggagttgtcccgtacaaccagtgatgtgctgtttctggcgctgcgccgggtgaaagcagatctgaatgcggatatcaacacgcgccttgaacagtctgcacggatcattcagcgcacaccggatgaggttttacccgcgctggtgctggcggcgacctggtttgataacgcggcgcgtgacgcggacattatccggcgtaatgccattacgcatcccggctttgtgccggtgatccctctgaaggtgccagtgcaatga

SEQ ID NO: 3022 - protein, 442 aa, Escherichia coli
MTWKDRLQDASFRGVPFKVEEESAGTGRRVETHEYPNRDKPYTEDLGKITFRPSITAYVVGDDCFDQRDRLIDALNKPGPGTLVHPTYGELKVCVDGEVRVSTSKSEGRIVRFDLKFVEAGELSYPTSGAATAQTLMSSCSALDDCISDSFSGFSIDGVADFVQNDVVGNASTMLGYVSDAMKVVDSAVSDAARLLQGDISVLLPPPSSGKNFVEQVQKMWRTGKRLYGNASDLVTMIKTLSGVSLGSDLQPRGVWKTDSKTTATATQQRNVVASTLRTTAISEAAYAVTRLPAPTTSAVMQNATVGQSTTPAQSTGWPSVTHPALNNAPAVKNTVDLPTWEELTDIRDTLNTAIDKELSRTTSDVLFLALRRVKADLNADINTRLEQSARIIQRTPDEVLPALVLAATWFDNAARDADIIRRNAITHPGFVPVIPLKVPVQ

SEQ ID NO: 3023 - DNA, 1080 bp, Escherichia coli
atgaacgataacgtcacgctacgggtaaatggccgggagtggaatggctggacatcggtgcgcatcggtgccggtattgaacggctggcgcgggatttcagtgtggagatcacccgccagtggccgggtgatgagggtatcaccacgcttcagccgcgcattaaaaacggttcaaaagtggaggtgctgattggtgatgagctggtgatcaccggctgggtggaggcgacgcccgttcgttacgatgcccgttcggtcagcaccggtattgccggacgcagtctgaccgctgacctgattgactgtgcagccgaaccgacacagtttaacggacgatcgctggtacagattgcgcaggcgcttgctgcgcctttcggcattgaggtggtgaacaacggtgcgccgtcgggtgttattcctgacgtccagcccgatcacggtgaaacggtgattgaggtaatcaacaaaatactcggtcagcagcaggcactggcttacgacgacccacacggcaggctggtgattggcggtattggctcaacgcgggcacatactgcgctggtactcggggaaaacatcctttcctgcgatacggagaagagtatccgggagcggttttctgtttaccaggtggcggggcagcgtgctggaaacgacgatgatttcggtgaggccaccaccagcgcgctgcgggcccgcacagaggacgcatttattgcccgttaccgtccgatgtatatcaggcagacagggcaggctacgggggcaggctgtattgcgcgtgctgactttgaagcccgacaacgggcggcgcggacggatgaaaccacctatgtggtgcagggctggcgacagggtaacggtacgctgtggcagcccaaccagcgggtgattgtcttcgatccggtctgtggtttcgacaataccgaactgcttgtctcggaagtcacgtttactcaggaccagaacggcaccctgacggaaatccgtgtcggcccacctgatgcttatctgcctgaacccgaagcccccggcgcgcggaaaaagaaaaaagccagagtacaggaggacccgttctga

SEQ ID NO: 3024 - protein, 359 aa, Escherichia coli
MNDNVTLRVNGREWNGWTSVRIGAGIERLARDFSVEITRQWPGDEGITTLQPRIKNGSKVEVLIGDELVITGWVEATPVRYDARSVSTGIAGRSLTADLIDCAAEPTQFNGRSLVQIAQALAAPFGIEVVNNGAPSGVIPDVQPDHGETVIEVINKILGQQQALAYDDPHGRLVIGGIGSTRAHTALVLGENILSCDTEKSIRERFSVYQVAGQRAGNDDDFGEATTSALRARTEDAFIARYRPMYIRQTGQATGAGCIARADFEARQRAARTDETTYVVQGWRQGNGTLWQPNQRVIVFDPVCGFDNTELLVSEVTFTQDQNGTLTEIRVGPPDAYLPEPEAPGARKKKKARVQEDPF

SEQ ID NO: 3025 - DNA, 549 bp, Escherichia coli
atgagtacgattgaagccatgcagcgacaactcctcggcctgattgggcgggcagtggtgaaaagcatcagtgccgccacgaaatgtcagaccgtggatgtgtccctgattgccggtgaacccaaagccggggttgaacatcttgaaccctacggttttaccgcaagggcaaacagcggtgcggaagcggtggtgttgtttccggatggtgaccgttctcatgcggtggttgttacggtgtcggaccggcgctaccgcctgaaagggctgcagacgggtgaggtggcggtctatgacgatcaggggcagtctgtgacgctgacccgggaggggatcgtggtggacggtgcaggtaaaacgatcacgtttcgcaatgcacctgaagcacgttttgaaatggacctggaagtgacaggacaggtgaaagacctgtgcgactccagcggcaccaccatgtcagcgatgcggcttgcctataacgggcatcgtcacagagagaacggtcagggcagtaacaccgacaaacctgataaagcgatggaggcatga

SEQ ID NO: 3026 - protein, 182 aa, Escherichia coli
MSTIEAMQRQLLGLIGRAVVKSISAATKCQTVDVSLIAGEPKAGVEHLEPYGFTARANSGAEAVVLFPDGDRSHAVVVTVSDRRYRLKGLQTGEVAVYDDQGQSVTLTREGIVVDGAGKTITFRNAPEARFEMDLEVTGQVKDLCDSSGTTMSAMRLAYNGHRHRENGQGSNTDKPDKAMEA

SEQ ID NO: 3027 - DNA, 426 bp, Escherichia coli
atggaactgtggctgacggtgaacggtaaacgcacctgcgccagcgcaccgctggatccgctgacccgcgccgtggtgatttccctgtttacctggcggcgggcggagcctgatgacaacgccgacgtcccgatgggatggtggggggatacctggcctgcggtacagaatgaccgttacggctcccgactgtggctgcttcagcgcagcaaactgaccaatcagctggtgcagacggtaagggggtatatccgcgaatgcctgcaatggatgattgatgacggcgtggtgtcccgtattgatctggatatcctccgcaccgggattaatgaactgggtaacagtatcactctctggcgtcgtgacggaccggtaatgatttctttagatgatctgtggagtgcgataacgcatggcggacagtga

SEQ ID NO: 3028 - protein, 141 aa, Escherichia coli
MELWLTVNGKRTCASAPLDPLTRAVVISLFTWRRAEPDDNADVPMGWWGDTWPAVQNDRYGSRLWLLQRSKLTNQLVQTVRGYIRECLQWMIDDGVVSRIDLDILRTGINELGNSITLWRRDGPVMISLDDLWSAITHGGQ

SEQ ID NO: 3029 - DNA, 1059 bp, Escherichia coli
atggcggacagtgaatttcagcgcccgacgctggcagaaaatatcagtatgctccgtaacgatttattcgccaggctggacgtcagcgacacgctccggcgcatggatgaagacgtgcgggcaaaggtgtatgcggcggcgctgcatacggtttacgggtacatcgattatctggcaatgaacatgctgcctgacctgtgcgatgagtcctggctggcgcgacatgctgcgatgaaacggtgtccgcgcaagggggccacgactgccagcgggtatatgcgctgggaaggcgtcagcgatggcctgaaggtgaccgccgggagtgttattcagcgcgatgacctgattcagtacacggcaactgccgatgcaaccagcgccggtggtgtcctgcgcgtgccgatcgcctgctcaagtgcaggcgcggtcggtaacgctgacgacggtacgtcattaatcctggtcacgccggttaatggtctgccgtcttccggcgtggcagacactctgacaggtggatttgatactgaagagctggaaacgtggcgcgcccgcgtcattgagcggtattactggacgcctcagggcggggctgacggggactatgttgtctgggctaaagaattgcccggcattacccgcgcatgggcataccgtcactggatgggaacggggactgtcggtgtgatgattgccagcagtgacctgattaatcccattccggaagaatcaacggaaacggcggcaagacaacatatcgggccactggccccggtggcaggctctgatttgtatgtgttcaggccggtggcgcatacggtggattttcatatccgtgtgacgccggatacaccggaaatacgggctgccatcaccgcggagttgcgttcgttcctgctgcgtgatggttatccgcagggagaactgaaggtgtcgcgtatcagtgaagcgatttccggtgcgaacggggaatacagccatcaattgcttgcaccggcggaaaatatctccattgcaaaaaatgaactggcggttctggggacgatttcatgggcgtga

SEQ ID NO: 3030 - protein, 352 aa, Escherichia coli
MADSEFQRPTLAENISMLRNDLFARLDVSDTLRRMDEDVRAKVYAAALHTVYGYIDYLAMNMLPDLCDESWLARHAAMKRCPRKGATTASGYMRWEGVSDGLKVTAGSVIQRDDLIQYTATADATSAGGVLRVPIACSSAGAVGNADDGTSLILVTPVNGLPSSGVADTLTGGFDTEELETWRARVIERYYWTPQGGADGDYVVWAKELPGITRAWAYRHWMGTGTVGVMIASSDLINPIPEESTETAARQHIGPLAPVAGSDLYVFRPVAHTVDFHIRVTPDTPEIRAAITAELRSFLLRDGYPQGELKVSRISEAISGANGEYSHQLLAPAENISIAKNELAVLGTISWA

SEQ ID NO: 3031 - DNA, 585 bp, Escherichia coli
atgggcgtgacaaacgatgattacatccgtctgttgtcggcactgctgccgcccggtccggcgtggtcagccagcgatccggcgattgccggtgcggcacagtcattaacccgcgttcatcagcgtgcggatgccctgatgcgggagctggatccgcgcaccaccaccgaactgataaatcgctgggagcgtctgtgcggcctgccggatgaatgtattcccgcaggaacacagacccttcgccagcgtcagcaacgactggatgcgaaggttaacctggcgggcggcatcaatgaggatttttaccttgcacagcttgctgccctgggcagaccagacgccaccatcacgcgatacgacaaaagcacgttcacctgctcatcggcctgtactgacgcggtgaatgcgccggaatggcggtattactggcaggtcaacatgccagccgccaccaacagcacctggatgacatgtggcgatccctgtgattccgcgctgcgtatctggggcgacaccgtcgtcgaatgtgtgcttaacaaactctgcccttcgcatacctacgtaatttttaaatatccggagtaa

SEQ ID NO: 3032 - protein, 194 aa, Escherichia coli
MGVTNDDYIRLLSALLPPGPAWSASDPAIAGAAQSLTRVHQRADALMRELDPRTTTELINRWERLCGLPDECIPAGTQTLRQRQQRLDAKVNLAGGINEDFYLAQLAALGRPDATITRYDKSTFTCSSACTDAVNAPEWRYYWQVNMPAATNSTWMTCGDPCDSALRIWGDTVVECVLNKLCPSHTYVIFKYPE

SEQ ID NO: 3033 - DNA, 744 bp, Escherichia coli
atgcatcgtatagacacgaaaaccgcgcagaaggataagttcggcgcgggtaagaacggttttacccgtggtaacccccagacaggcacgcctgccaccgatctggatgatgactactttgacatgttgcaggaagaactctgcagcgtggtggaggcatccggtgccagtctggagaaggcgcggcacgaccagctgcttaccgcgcttcgtgcgctgctgttaagccgcaagaatccgtttagcgatatcaaatcggacggcacggtgaaaacggctctcgaaaaccttggtttgggagaaggctctgcattacctgttggtgtgcctgttccatggccttcagccacaccgccaacaggctggctgaaatgcaacggtgcggctttttctgctgaagaatacccggaactggcaaaggcttatccgacaaataaattgcctgatttacgtggtgagtttattcgtggctgggatgatgggcgcggcgttgattcaaggcgtgcggtgctgtcaacacaagagccaactgtaggtactttttatgtggagctagctatcatctcgggaactttgagcggctcaggtgctaaatttaccgattcagtagggattggatcaaccagtagtaacattaccgttagcaacggtaatgaccagtccgtgtcgggtacagtggccgttaaccccgtcgatacccgtccacgcaacattgcatttaactatatcgtgagagcagcataa

SEQ ID NO: 3034 - protein, 247 aa, Escherichia coli
MHRIDTKTAQKDKFGAGKNGFTRGNPQTGTPATDLDDDYFDMLQEELCSVVEASGASLEKARHDQLLTALRALLLSRKNPFSDIKSDGTVKTALENLGLGEGSALPVGVPVPWPSATPPTGWLKCNGAAFSAEEYPELAKAYPTNKLPDLRGEFIRGWDDGRGVDSRRAVLSTQEPTVGTFYVELAIISGTLSGSGAKFTDSVGIGSTSSNITVSNGNDQSVSGTVAVNPVDTRPRNIAFNYIVRAA

SEQ ID NO: 3035 - DNA, 444 bp, Escherichia coli
atgaactcagtattcttttcacccggaagtaaaagtttttatctgcaagaattgtttccagaatatgaggatgcgggaacgcttcctgatgatgttattgaaattaccagagaaacatatgagcaatttcttggtctgcatccagaagggaaagaaattggcgctgacagttcaggacggccagtatggattaattccccacccccttcaaaagaggatgaggtgttgacggctgaaatgaaaaaaatatctttggtttcagaagtcaatacctacatcaatacccatcagtggcctggcaaagctgctattggtcgtctgaaaggcgaggaactggcgcaatataattcgtggctggattatctggacgcactggaactggtcgatacttcctgtgcgccagatattgaatggcctacgcctccggcagttcaggccagatga

SEQ ID NO: 3036 - protein, 147 aa, Escherichia coli
MNSVFFSPGSKSFYLQELFPEYEDAGTLPDDVIEITRETYEQFLGLHPEGKEIGADSSGRPVWINSPPPSKEDEVLTAEMKKISLVSEVNTYINTHQWPGKAAIGRLKGEELAQYNSWLDYLDALELVDTSCAPDIEWPTPPAVQAR

SEQ ID NO: 3037 - DNA, 603 bp, Escherichia coli
atggataaagcaatattaaatagtggacttgttgctacaaaggcaggggatattaccgtttataactatgatggtgaaactcgggaatatatttccacttcaagtgaatatcttgccgttggtgttggtatcccggcatattcctgtctggatgcaccaggtatacataaggcgggttatgctatctgtcgttctgtgaatttaaattcatgggaatatgtgccagaccatcgcggtgaaatcgtctataacaccgaaacgggagaatcaaaacaaatcacagcaccgggtgattaccccgaaaatacaaccactattgccccattaacgccatacgataaatgggatggtgagaaatgggtgaccgatactgaggcacagcatagcgccgcagtagacgcggcagaagcacagcgtcagtcactgattgatgctgcaatggcttccatcggtctgattcagctgaaattacaggccggacggaagctgatgcaggcagaaacaacccggcttaacgctgtgctggattacattgacgcggtgacggcaacaaataccagcacagcgccggatgtcatctggcctgaactgccggaggcgtag

SEQ ID NO: 3038 - protein, 200 aa, Escherichia coli
MDKAILNSGLVATKAGDITVYNYDGETREYISTSSEYLAVGVGIPAYSCLDAPGIHKAGYAICRSVNLNSWEYVPDHRGEIVYNTETGESKQITAPGDYPENTTTIAPLTPYDKWDGEKWVTDTEAQHSAAVDAAEAQRQSLIDAAMASIGLIQLKLQAGRKLMQAETTRLNAVLDYIDAVTATNTSTAPDVIWPELPEA

SEQ ID NO: 3039 - DNA, 183 bp, Escherichia coli; identical to SEQ ID NO: 1303

SEQ ID NO: 3040 - protein, 60 aa, Escherichia coli; identical to SEQ ID NO: 1304

SEQ ID NO: 3041 - DNA, 384 bp, Escherichia coli
  n 4, 5, 6, 7, 8: n is any nucleotide
atgnnnnncgccattacctacaaagccctgcgcgacaaaaatgccagagaactgaagctggcgaacgcggcaattactgacatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctgatcactatgcaaaaacaactggaaggaacccagaagtatattaatgagcagtgcagatag

SEQ ID NO: 3042 - protein, 127 aa, Escherichia coli
  Xaa 2, 3: Xaa is any amino acid
MXXAITYKALRDKNARELKLANAAITDMQMRQRDVAALDAKYTKELADAKAENDALRDDVAAGRRRLHIKAVCQSVREATTASGVDNAASPRLADTAERDYFTLRERLITMQKQLEGTQKYINEQCR

SEQ ID NO: 3043 - DNA, 342 bp, Escherichia coli
ttgttgtcacataggattctgccgtttttaacaatgcaggataataagatgaaaaaaatgttgttttctgccgctctggcaatgcttattacaggatgtgctcaacagacgtttactgttggaaacaaacctacagcagtaacaccaaaggaaaccatcacccatcatttcttcgtttcgggaattgggcagaagaaaactgtcgatgcagcaaaaatttgtggtggtgcagaaaatgttgttaaaacagaaacccagcaaacattcgtaaatggattgctcggttttattactttaggcatttatactccgctggaagcgcgggtgtattgctcaaaataa

SEQ ID NO: 3044 - protein, 113 aa, Escherichia coli
MLSHRILPFLTMQDNKMKKMLFSAALAMLITGCAQQTFTVGNKPTAVTPKETITHHFFVSGIGQKKTVDAAKICGGAENVVKTETQQTFVNGLLGFITLGIYTPLEARVYCSK

SEQ ID NO: 3045 - DNA, 99 bp, Escherichia coli; identical to SEQ ID NO: 1309

SEQ ID NO: 3046 - protein, 32 aa, Escherichia coli; identical to SEQ ID NO: 1310

SEQ ID NO: 3047 - DNA, 183 bp, Escherichia coli; identical to SEQ ID NO: 1313

SEQ ID NO: 3048 - protein, 60 aa, Escherichia coli; identical to SEQ ID NO: 1314

SEQ ID NO: 3049 - DNA, 348 bp, Escherichia coli
atggtgacgaaaaccatcactgaacagcgtgcggaagtacgtatttttgccggtaatgatccggctcataccgccacaggcagcagcgggatttcctcgccaacaccggcactgacgcccctgatgctggatgaagccaccgggaaactggtggtctgggacggacagaaagccggtagtgcggttggcatactggtactgccgcttgaaggcacagagacggcgctgacgtattacaagtcgggaacctttgcgacggaggcaatccactggcctgaaagtgtggatgaacacaaaaaggccaacgcctttgctggcagtgccctgagtcacgcggcgctgccgtaa

SEQ ID NO: 3050 - protein, 115 aa, Escherichia coli
MVTKTITEQRAEVRIFAGNDPAHTATGSSGISSPTPALTPLMLDEATGKLVVWDGQKAGSAVGILVLPLEGTETALTYYKSGTFATEAIHWPESVDEHKKANAFAGSALSHAALP

SEQ ID NO: 3051 - DNA, 1029 bp, Escherichia coli
atgggattgtttacgacccgccagttactcggttataccgaacaaaaagttaaatttcgtgcgctgtttctggagctgtttttccgccgtacggtgaatttccataccgaagaggtgatgctggacaaaattaccggaaaaacgccggtggcggcctatgtctccccggttgttgaaggaaaagtgctgcgtcatcgtggtggtgaaacccgcgtgttgcgtccgggctacgtcaagccgaaacacgaatttaattaccagcaggcggttgagcgccttcctggtgaagatccatctcaactgaatgatccggcttaccgccgtctgcgtatcattaccgataacctcaaacaggaagagcacgcgattgtccaggtggaagaaatgcaggcggtaaatgctgtgttgtatggcaaatacaccatggaaggagaccagttcgagaaaattgaggtcgattttggcaggtcgacgaagaataacatcactcagggtagtggtaaggagtggtcaaaacaggatcgtgacacgttcgatcctacacatgatattgacctctactgcgacctggccagcggtcttgtgaatattgccattatggacggtaccgtctggcgtcttctgaatggttttaagctgttccgcgaaaaactggatacccgtcgcggttcaaattctcaactcgaaacggcagtgaaagatctgggcgcagtggtgtccttcaaggggtattacggcgatctggccattgtggtggcgaaaacgtcttatatagcagaagacggtatcgaaaaacgttatcttccagatggcatgctggttctggggaatactgctgcagatgggatccgttgttacggtgccattcaggatgctcaggcgttgtccgaaggtgtggtggcctcttcccgttatccgaaacactggctgacggtaggggatcccgcccgtgaatttaccatgacgcagtccgcgccgctgatggtgttgccggacccggatgagtttgtggtggtacaggtgaaataa

SEQ ID NO: 3052 - protein, 342 aa, Escherichia coli
MGLFTTRQLLGYTEQKVKFRALFLELFFRRTVNFHTEEVMLDKITGKTPVAAYVSPVVEGKVLRHRGGETRVLRPGYVKPKHEFNYQQAVERLPGEDPSQLNDPAYRRLRIITDNLKQEEHAIVQVEEMQAVNAVLYGKYTMEGDQFEKIEVDFGRSTKNNITQGSGKEWSKQDRDTFDPTHDIDLYCDLASGLVNIAIMDGTVWRLLNGFKLFREKLDTRRGSNSQLETAVKDLGAVVSFKGYYGDLAIVVAKTSYIAEDGIEKRYLPDGMLVLGNTAADGIRCYGAIQDAQALSEGVVASSRYPKHWLTVGDPAREFTMTQSAPLMVLPDPDEFVVVQVK

SEQ ID NO: 3053 - DNA, 375 bp, Escherichia coli
atggcaacgaaagagcaaaatctgaaacggcttgatgaactggccctgattctggggcgtgagccggatatatccgggagtgccgcagagatagcgcagcgggtggcagaatgggaagaggaaatgcagtcatccggcgatgatgtacaggttatgaatatggatatccgggagcgggaaaccgcggctcatgatgttcgtgaggaaacatccggcgcgttaacgcgcatcagagttctgacctgcctccatctctgtggcgttgatggtgaaacgggggaatccgttgagcttgcggatgttggtcgggtgattctgattatgtcctcagatgcaaaaacacacgttgatggtggaatggctgtttatgcgtga

SEQ ID NO: 3054 - protein, 124 aa, Escherichia coli
MATKEQNLKRLDELALILGREPDISGSAAEIAQRVAEWEEEMQSSGDDVQVMNMDIRERETAAHDVREETSGALTRIRVLTCLHLCGVDGETGESVELADVGRVILIMSSDAKTHVDGGMAVYA

SEQ ID NO: 3055 - DNA, 375 bp, Escherichia coli
ttgatggtggaatggctgtttatgcgtgattttcagaatgcctttgatgccgcccttgccggggtggacagtacgattgttgaagtgatgggcatcagtgcgcagttcacctccggtgcacagcgtggcggcgaggttcatggcgtttttgacgatccggagtcgctgggttttgccagtagtgggatccgtattgaaggaagtaacccgtcattatttgtgcttacggatacggtttgtgctgtacggcgtggtgacacgctgaccattaacggcgagatgttctgggtggaccgtgtttctccggatgacggagggagttgttatctctggctcaaccgggggcaaccacctgccgccagccgtcgccgctga

SEQ ID NO: 3056 - protein, 124 aa, Escherichia coli
MMVEWLFMRDFQNAFDAALAGVDSTIVEVMGISAQFTSGAQRGGEVHGVFDDPESLGFASSGIRIEGSNPSLFVLTDTVCAVRRGDTLTINGEMFWVDRVSPDDGGSCYLWLNRGQPPAASRRR

SEQ ID NO: 3057 - DNA, 579 bp, Escherichia coli
atggccataaaaggtcttgagcaggccgttgaaaacctcagccgtatcagcaaaacggcagtgcctggtgccgccgcaatggccattaaccgcgttgcttcatccgcgatatcgcagtcggcgtcactggttgcccgtgagacaaaggtacgccggaaactggtaaaggaaagggccaggctgaaaagggccacggtcaaaaatccgcaggccagaatcaaagttaaccggggggatttgcccgtaatcaggctgggtaacgcgcgggttgtcctgtcccgacgcaggcgtcgtaaaaaggggcagcgttcatccctgaaaggtggcggcagcgtgcttgtggtgggaaaccgtcgtattcccggcgcgtttattcagcaactgaaaaatggccggtggcatgtcatgcagcgtgtggccgggaaaaaccgttaccccattgatgtggtgaaaatcccgatggcggtgccgctgaccacggcgtttaaacagaatattgagcggatacggcgtgagcgtcttccgaaagagctgggctatgcgctgcagcatcaactgagaatggtaataaagcgatga

SEQ ID NO: 3058 - protein, 192 aa, Escherichia coli
MAIKGLEQAVENLSRISKTAVPGAAAMAINRVASSAISQSASLVARETKVRRKLVKERARLKRATVKNPQARIKVNRGDLPVIRLGNARVVLSRRRRRKKGQRSSLKGGGSVLVVGNRRIPGAFIQQLKNGRWHVMQRVAGKNRYPIDVVKIPMAVPLTTAFKQNIERIRRERLPKELGYALQHQLRMVIKR

SEQ ID NO: 3059 - DNA, 135 bp, Escherichia coli
  n 116, 117, 118, 119, 120: n is any nucleotide
atgaaacatactgaactccgtgcagccgtactggatgcactggagaagcatgacaccggggcgacgctttttgatggtcgccctgctgtttttgatgaggaagattttccggcaannnnncattccattcattaa

SEQ ID NO: 3060 - protein, 44 aa, Escherichia coli
  Xaa 39, 40: Xaa is any amino acid
MKHTELRAAVLDALEKHDTGATLFDGRPAVFDEEDFPAXXHSIH

SEQ ID NO: 3061 - DNA, 216 bp, Escherichia coli
  n 198, 199, 200, 201, 202: n is any nucleotide
ttgattctggcctgcggatttttgaccgtggcccttttcagcctggccctttcctttaccagtttccggcgtacctttgtctcacgrgcaaccwgtgacgcmgactgcgatatcgcggatgaagcaacgcggttaatggccattgcggcggcaccgggcacygccgttttgctgatacggctgagttttcaacggccnnnnncattcattcattaa

SEQ ID NO: 3062 - protein, 71 aa, Escherichia coli
  Xaa 32, 67, 68: Xaa is any amino acid
MILACGFLTVALFSLALSFTSFRRTFVSRATXDADCDIADEATRLMAIAAAPGTAVLLIRLSFQRPXXFIH

SEQ ID NO: 3063 - DNA, 519 bp, Escherichia coli
gtgcccggtgccgccgcaatggccattaaccgcgttgcttcatccgcgatatcgcagtckgcgtcacwggttgcycgtgagacaaaggtacgccggaaactggtaaaggaaagggccaggctgaaaagggccacggtcaaaaatccgcaggccagaatcaaagttaaccggggggatttgcccgtaatcargctgggtaaygcgcgggttgtcctgtcccgmcgcaggcgtcgtaaaaaggggcagcgttcatccctgaaaggtggcggcagcgtgcttgtggtgggwaaccgtcgtattcccggcgcgtttattcagcaactgaaaaayggccggtggcatgtyatgcagcgtgtggccgggaaaaaccgttaccccattgatgtggtgaaaatcccgatggcggtgccgctgaccacggcgtttaaacagaatattgarcggatacggcgtgarcgtcttccgaaagagctgggctatgcgctgcagcatcaactgagaatggtaataaagcgatga

SEQ ID NO: 3064 - protein, 172 aa, Escherichia coli
  Xaa 23, 64: Xaa is any amino acid
MPGAAAMAINRVASSAISQSASXVARETKVRRKLVKERARLKRATVKNPQARIKVNRGDLPVIXLGNARVVLSRRRRRKKGQRSSLKGGGSVLVVGNRRIPGAFIQQLKNGRWHVMQRVAGKNRYPIDVVKIPMAVPLTTAFKQNIERIRRERLPKELGYALQHQLRMVIKR

SEQ ID NO: 3065 - DNA, 342 bp, Escherichia coli
atgaaacatactgaactccgtgcagccgtactggatgcactggagaagcatgacaccggggcgacgctttttgatggtcgcccygctgtttttgatgaggaagattttccggcaattgccgtttatctcaccggcgctgaatacacgggcgaagagctggacagcgatacctggcaggcggagctgcatattgaagttttcctgcctgctcaggtgccggattcagagctggattcgtggatggagtcccggatttatccggtgatgagcgatatcccggcactgtcagatttgatcaccagtatggtggccagyggctatgactaccggcgcgacggatga

SEQ ID NO: 3066 - protein, 113 aa, Escherichia coli
MKHTELRAAVLDALEKHDTGATLFDGRPAVFDEEDFPAIAVYLTGAEYTGEELDSDTWQAELHIEVFLPAQVPDSELDSWMESRIYPVMSDIPALSDLITSMVASGYDYRRDG

SEQ ID NO: 3067 - DNA, 333 bp, Escherichia coli
  n 12, 13, 14, 15, 16: n is any nucleotide
atgaatgaatgnnnnncgcgggttgtcctgtcccgacgcaggcgtcgtaaaaaggggcagcgttcatccctgaaaggtggcggcagcgtgcttgtggtgggaaaccgtcgtattcccggcgcgtttattcagcaactgaaaaatggccggtggcatgtcatgcagcgtgtggccgggaaaaaccgttaccccattgatgtggtgaaaatcccgatggcggtgccgctgaccacggcgtttaaacagaatattgagcggatacggcgtgagcgtcttccgaaagagctgggctatgcgctgcagcatcaactgagaatggtaataaagcgatga

SEQ ID NO: 3068 - protein, 110 aa, Escherichia coli
  Xaa 4, 5, 6: Xaa is any amino acid
MNEXXXRVVLSRRRRRKKGQRSSLKGGGSVLVVGNRRIPGAFIQQLKNGRWHVMQRVAGKNRYPIDVVKIPMAVPLTTAFKQNIERIRRERLPKELGYALQHQLRMVIKR

SEQ ID NO: 3069 - DNA, 396 bp, Escherichia coli
atgaaacatactgaactccgtgcagccgtactggatgcactggagaagcatgacaccggggcgacgctttttgatggtcgccctgctgtttttgatgaggaagattttccggcaattgccgtttatctcaccggcgctgaatacacgggcgaagagctggacagcgatacctggcaggcggagctgcatattgaagttttcctgcctgctcaggtgccggattcagagctggattcgtggatggagtcccggatttatccggtgatgagcgatatcccggcactgtcagatttgatcaccagtatggtggccagtggctatgactaccggcgcgacgatgatgcgggcctgtggagttcagccgatctgacttatgtcattacctatgaaatgtga

SEQ ID NO: 3070 - protein, 131 aa, Escherichia coli; identical to SEQ ID NO: 1336

SEQ ID NO: 3071 - DNA, 741 bp, Escherichia coli
atgccaacaccaaatcctctggcaccggtgaaaggggccgggaccacactgtgggtttataacgggagcggcgacccttatgcaaacccgctttcagacaatgactggtcgcgtctggcaaaaattaaagacctgacgcccggcgaactgaccgctgagtcctatgacgacagttatctcgatgatgaagatgcggactggaccgcgaccgggcaggggcagaaatccgccggagataccagcttcacgctggcgtggatgcccggagagcaggggcagcaggcgctgctggcgtggtttaatgaaggtgatacccgtgcctataaaatccgcttcccgaacggcacggtcgatgtgttccgtggctgggtcagcagtatcggtaaggcggtgacggcgaaggaagtgatcacccgtacggtgaaggtcaccaatgtgggccgtccgtcaatggcagaagatcgcagtacggtgacggcggcaaccggtatgaccgtgacgcctgccagctcctcggtggtgaaagggcagagcaccacgctgaccgtggccttccagccggagggcgcaactgacaagagcttccgtgcggtgtcagcggataaaacaaaagccaccgtgtcggtcagtggtatgaccatcaccgtgaacggcgttgctgcaggcaaggtcaacattccggttgtatccggtaatggtgaacttgctgcggttgcagaaatcactgtcaccgacagttaa

SEQ ID NO: 3072 - protein, 246 aa, Escherichia coli
MPTPNPLAPVKGAGTTLWVYNGSGDPYANPLSDNDWSRLAKIKDLTPGELTAESYDDSYLDDEDADWTATGQGQKSAGDTSFTLAWMPGEQGQQALLAWFNEGDTRAYKIRFPNGTVDVFRGWVSSIGKAVTAKEVITRTVKVTNVGRPSMAEDRSTVTAATGMTVTPASSSVVKGQSTTLTVAFQPEGATDKSFRAVSADKTKATVSVSGMTITVNGVAAGKVNIPVVSGNGELAAVAEITVTDS

SEQ ID NO: 3073 - DNA, 423 bp, Escherichia coli
atgttcctgaaaaccgaatcatttgaacataacggcgtgaccgtcacgctttctgaactgtcagccctgcagcgtattgagcatctcgccctgatgaaacagcaggcagaacaggcggagtcagacagcaaccggcaggttactgtggaagacgccatcagaaccggtgcttttgtggtggcgatgtccctgtggcataaccatccgcagaagacaaagcagccttccatgaatgaagccgttaaacagattgagcaggaagtgcttaccacctggcccgcggaggcaatttctcatgctgaaaacgtggtgtaccggctgtccggtatgtatgggtttgtggtgaatgatgcccctgaccaggcagaggactccgggcctgcagagcctgtttctgcgggaaagtgttcgacggtgagctga

SEQ ID NO: 3074 - protein, 140 aa, Escherichia coli
MFLKTESFEHNGVTVTLSELSALQRIEHLALMKQQAEQAESDSNRQVTVEDAIRTGAFVVAMSLWHNHPQKTKQPSMNEAVKQIEQEVLTTWPAEAISHAENVVYRLSGMYGFVVNDAPDQAEDSGPAEPVSAGKCSTVS

SEQ ID NO: 3075 - DNA, 123 bp, Escherichia coli
  n 104, 105, 106, 107, 108: n is any nucleotide
gtgttcgacggtgagctgagttttgccctgaaactggcgcgagagaaggggcgacctgactggcgcgccatgcttgccgggatgtcatccacggagtatgccgnnnnncattccattcattaa

SEQ ID NO: 3076 - protein, 40 aa, Escherichia coli
  Xaa 35, 36: Xaa is any amino acid
MFDGELSFALKLAREKGRPDWRAMLAGMSSTEYAXXHSIH

SEQ ID NO: 3077 - DNA, 297 bp, Escherichia coli
  n 12, 13, 14, 15, 16: n is any nucleotide
atgaatgaatgnnnnntgcacttttccgggctgacgtacactgtgctcagctgtttttcagcgatccgggatatgcatccgctggatttcagtttgctgaaccggcgtgaggatgacgaagagcctgaagatgatgtgctgatgcagaaagcggcagggcttaccggaggcgtccgctttgacccggacggaaatgaagttatccccgcttccccggatatggcgggcatgacggaggatgacgtaatgctgatgacagtatcagaagggatcgcaggaggagtccggtatggctga

SEQ ID NO: 3078 - protein, 98 aa, Escherichia coli
  Xaa 4, 5, 6: Xaa is any amino acid
MNEXXXHFSGLTYTVLSCFSAIRDMHPLDFSLLNRREDDEEPEDDVLMQKAAGLTGGVRFDPDGNEVIPASPDMAGMTEDDVMLMTVSEGIAGGVRYG

SEQ ID NO: 3079 - DNA, 1623 bp, Escherichia coli
  n 1604, 1605, 1606, 1607, 1608: n is any nucleotide
atggctgaaccggtaggcgatctggtcgttgatttaagtctggatgcggccagatttgacgagcagatggccagagtcaggcgtcatttttccggtacggaaagtgatgcgaaaaaaacagcggcagtcgttgaacagtcgctgagccgacaggcgctggctgcacagaaagcggggatttccgtcgggcagtataaagccgccatgcgtatgctgcctgcacagttcaccgacgtggccacgcagcttgcaggcgggcaaagcccgtggctgatcctgctgcaacagggtggtcaggttaaggactccttcggcgggatgatccccatgttccgggggcttgccggtgcgatcaccctgccgatggtcggggccacctcgctggcggtggcgaccggtgcgctggcgtatgcctggtatcagggtaactcaaccctgtccgatttcaacaaaacgctggtcctttccggcaatcagtcgggtctgacggcagatcgtatgctggtcctgtccagagccgggcaggcggcagggctgacgtttaaccagaccagcgagtcactcagcgcactggttaaggcgggagtaagcggtgaggctcagattgcatccatcagccagagtgtggcgcgtttctcctctgcatccggcgtggaggtggacaaggtcgctgaagccttcgggaagctgaccactgacccgacgtcggggctgacggcgatggcgcgccagttccataacgtaacggcggagcagattgcgtatgttgctcagttgcagcgttccggcgatgaatccggggcattgcaggcggcgaacgaggccgcaacgaaagggtttgatgaccagacccgacgcctgaaagagaacatgggcacgctggaaacctgggcagacaggacagcacgggcattcaaatccatgtgggatgcggtgctggatattggtcgtcctgataccgctcaggagatgctgattaaggcagaggctgcgtttaagaaagcggacgacatctggaatctgcgcaaggatgattattttgttaacgatgaagcgcgggcgcgttactgggatgatcgtgaaaaggcccgtcttgcgcttgaagccgcccgaaagaaggctgaacagcagagtcaacaggacaaaaatgcgcagcagcagagcgataccgaagcatcacggctgaaatataccgaagaggcgcagaaggcttacgaacggctgcagacaccgctggagaaatataccgcccgtcaggaagaactgaacaaggcactgaaagacgggaaaatcctgcaggcagattacaacacgctgatggcggcggcgaaaaaggattatgaagcgacgctgaaaaagccgaaacagtccggcgtgaaggtgtctgcgggcgatcgtcaggaagacagtgctcatgctgccctgctgacgcttcaggctgaactccggacgctggagaagcatgccggagcaaatgagaaaatcagccagcagcgccgggatttgtggaaggcggagagtcagttcgcggtactggaggaggcggcgcaacgtcgccagctgtctgcacaggagaaatccctgctggcgcataaagatgagannnnncattccattcattaa

SEQ ID NO: 3080 - protein, 540 aa, Escherichia coli
  Xaa 535, 536: Xaa is any amino acid
MAEPVGDLVVDLSLDAARFDEQMARVRRHFSGTESDAKKTAAVVEQSLSRQALAAQKAGISVGQYKAAMRMLPAQFTDVATQLAGGQSPWLILLQQGGQVKDSFGGMIPMFRGLAGAITLPMVGATSLAVATGALAYAWYQGNSTLSDFNKTLVLSGNQSGLTADRMLVLSRAGQAAGLTFNQTSESLSALVKAGVSGEAQIASISQSVARFSSASGVEVDKVAEAFGKLTTDPTSGLTAMARQFHNVTAEQIAYVAQLQRSGDESGALQAANEAATKGFDDQTRRLKENMGTLETWADRTARAFKSMWDAVLDIGRPDTAQEMLIKAEAAFKKADDIWNLRKDDYFVNDEARARYWDDREKARLALEAARKKAEQQSQQDKNAQQQSDTEASRLKYTEEAQKAYERLQTPLEKYTARQEELNKALKDGKILQADYNTLMAAAKKDYEATLKKPKQSGVKVSAGDRQEDSAHAALLTLQAELRTLEKHAGANEKISQQRRDLWKAESQFAVLEEAAQRRQLSAQEKSLLAHKDEXXHSIH

SEQ ID NO: 3081 - DNA, 297 bp, Escherichia coli; identical to SEQ ID NO: 3077
  n 12, 13, 14, 15, 16: n is any nucleotide

SEQ ID NO: 3082 - protein, 98 aa, Escherichia coli; identical to SEQ ID NO: 3078
  Xaa 4, 5, 6: Xaa is any amino acid

SEQ ID NO: 3083 - DNA, 1362 bp, Escherichia coli
  n 1339, 1340, 1341, 1342, 1343: n is any nucleotide
atggctgaaccggtaggcgatctggtcgttgatttaagtctggatgcggccagatttgacgagcagatggccagagtcaggcgtcatttttccggtacggaaagtgatgcgaaaaaaacagcggcagtcgttgaacagtcgctgagccgacaggcgctggctgcacagaaagcggggatttccgtcgggcagtataaagccgccatgcgtatgctgcctgcacagttcaccgacgtggccacgcagcttgcaggcgggcaaagcccgtggctgatcctgctgcaacagggtggtcaggttaaggactccttcggcgggatgatccccatgttccgggggcttgccggtgcgatcaccctgccgatggtcggggccacctcgctggcggtggcgaccggtgcgctggcgtatgcctggtatcagggtaactcaaccctgtccgatttcaacaaaacgctggtcctttccggcaatcagtcgggtctgacggcagatcgtatgctggtcctgtccagagccgggcaggcggcagggctgacgtttaaccagaccagcgagtcactcagcgcactggttaaggcgggagtaagcggtgaggctcagattgcatccatcagccagagtgtggcgcgtttctcctctgcatccggcgtggaggtggacaaggtcgctgaagccttcgggaagctgaccactgacccgacgtcggggctgacggcgatggcgcgccagttccataacgtaacggcggagcagattgcgtatgttgctcagttgcagcgttccggcgatgaatccggggcattgcaggcggcgaacgaggccgcaacgaaagggtttgatgaccagacccgacgcctgaaagagaacatgggcacgctggaaacctgggcagacaggacagcacgggcattcaaatccatgtgggatgcggtgctggatattggtcgtcctgataccgctcaggagatgctgattaaggcagaggctgcgtttaagaaagcggacgacatctggaatctgcgcaaggatgattattttgttaacgatgaagcgcgggcgcgttactgggatgatcgtgaaaaggcccgtcttgcgcttgaagccgcccgaaagaaggctgaacagcagagtcaacaggacaaaaatgcgcagcagcagagcgataccgaagcatcacggctgaaatataccgaagaggcgcagaaggcttacgaacggctgcagacaccgctggagaaatataccgcccgtcaggaagaactgaacaaggcactgaaagacgggaaaatcctgcaggcagattacaacacgctgatggcggcggcgaaaaaggatnnnnncattccattcattaattaa

SEQ ID NO: 3084 - protein, 453 aa, Escherichia coli
  Xaa 447, 448: Xaa is any amino acid
MAEPVGDLVVDLSLDAARFDEQMARVRRHFSGTESDAKKTAAVVEQSLSRQALAAQKAGISVGQYKAAMRMLPAQFTDVATQLAGGQSPWLILLQQGGQVKDSFGGMIPMFRGLAGAITLPMVGATSLAVATGALAYAWYQGNSTLSDFNKTLVLSGNQSGLTADRMLVLSRAGQAAGLTFNQTSESLSALVKAGVSGEAQIASISQSVARFSSASGVEVDKVAEAFGKLTTDPTSGLTAMARQFHNVTAEQIAYVAQLQRSGDESGALQAANEAATKGFDDQTRRLKENMGTLETWADRTARAFKSMWDAVLDIGRPDTAQEMLIKAEAAFKKADDIWNLRKDDYFVNDEARARYWDDREKARLALEAARKKAEQQSQQDKNAQQQSDTEASRLKYTEEAQKAYERLQTPLEKYTARQEELNKALKDGKILQADYNTLMAAAKKDXXIPFIN

SEQ ID NO: 3085 - DNA, 1260 bp, Escherichia coli
  n 12, 13, 14, 15, 16, 1233, 1234, 1235, 1236, 1237: n is any nucleotide
atgaatgaatgnnnnncgtatgttgctcagttgcagcgttccggcgatgaatccggggcattgcaggcggcgaacgaggccgcaacgaaagggtttgatgaccagacccgacgcctgaaagagaacatgggcacgctggaaacctgggcagacaggacagcacgggcattcaaatccatgtgggatgcggtgctggatattggtcgtcctgataccgctcaggagatgctgattaaggcagaggctgcgtttaagaaagcggacgacatctggaatctgcgcaaggatgattattttgttaacgatgaagcgcgggcgcgttactgggatgatcgtgaaaaggcccgtcttgcgcttgaagccgcccgaaagaaggctgaacagcagagtcaacaggacaaaaatgcgcagcagcagagcgataccgaagcatcacggctgaaatataccgaagaggcgcagaaggcttacgaacggctgcagacaccgctggagaaatataccgcccgtcaggaagaactgaacaaggcactgaaagacgggaaaatcctgcaggcagattacaacacgctgatggcggcggcgaaaaaggattatgaagcgacgctgaaaaagccgaaacagtccggcgtgaaggtgtctgcgggcgatcgtcaggaagacagtgctcatgctgccctgctgacgcttcaggctgaactccggacgctggagaagcatgccggagcaaatgagaaaatcagccagcagcgccgggatttgtggaaggcggagagtcagttcgcggtactggaggaggcggcgcaacgtcgccagctgtctgcacaggagaaatccctgctggcgcataaagatgagacgctggagtacaaacgccagctggctgcacttggcgacaaggttacgtatcaggagcgcctgaacgcgctggcgcagcaggcggataaattcgcacagcagcaacgggcaaaacgggccgctattgatgcgaaaagccgggggctgactgaccggcaggcagaacgggaagccacggaacagcgcctgaaggaacagtatggcgataatcctctggcgctgaataacgtcatgtcagagcagaaaaagacctgggcggctgaagacctgcttcgcgggaactggatggcaggcctgaagtccggctggagtgagtgggaagagagtgccacggacagtatgtcgcaggttaaaagtgctgccacgcagaccttnnnnncattccattcattaattaattaa

SEQ ID NO: 3086 - protein, 419 aa, Escherichia coli
  Xaa 4, 5, 6, 411, 412, 413: Xaa is any amino acid
MNEXXXYVAQLQRSGDESGALQAANEAATKGFDDQTRRLKENMGTLETWADRTARAFKSMWDAVLDIGRPDTAQEMLIKAEAAFKKADDIWNLRKDDYFVNDEARARYWDDREKARLALEAARKKAEQQSQQDKNAQQQSDTEASRLKYTEEAQKAYERLQTPLEKYTARQEELNKALKDGKILQADYNTLMAAAKKDYEATLKKPKQSGVKVSAGDRQEDSAHAALLTLQAELRTLEKHAGANEKISQQRRDLWKAESQFAVLEEAAQRRQLSAQEKSLLAHKDETLEYKRQLAALGDKVTYQERLNALAQQADKFAQQQRAKRAAIDAKSRGLTDRQAEREATEQRLKEQYGDNPLALNNVMSEQKKTWAAEDLLRGNWMAGLKSGWSEWEESATDSMSQVKSAATQTXXXFHSLIN

SEQ ID NO: 3087 - DNA, 111 bp, Escherichia coli
  n 92, 93, 94, 95, 96: n is any nucleotide
atgctgccgcagcatagcgatattgaaatagcctggtatgcttcgatacagcaggagccgaatggctggaagaccgtcaccacacagttctnnnnncattccattcattaa

SEQ ID NO: 3088 - protein, 36 aa, Escherichia coli
  Xaa 31, 32: Xaa is any amino acid
MLPQHSDIEIAWYASIQQEPNGWKTVTTQFXXHSIH

SEQ ID NO: 3089 - DNA, 201 bp, Escherichia coli
  n 174, 175, 176, 177, 178: n is any nucleotide
atgctgccgcagcatagcgatattgaaatagcctggtatgcttcgatacagcaggagccgaatggctggaagaccgtcactacacagttctacatccaggaattcagtgagtatattgcgccactgcaggatgctgtagatctggaaatcgcaacggaggaagaaagatcgttnnnnncattccattcattaattaattaa

SEQ ID NO: 3090 - protein, 66 aa, Escherichia coli
  Xaa 58, 59, 60: Xaa is any amino acid
MLPQHSDIEIAWYASIQQEPNGWKTVTTQFYIQEFSEYIAPLQDAVDLEIATEEERSXXXFHSLIN

SEQ ID NO: 3091 - DNA, 954 bp, Escherichia coli
atgcgggcaaaacttctgggaatagtyctgacamcccctattgcgatcagctcttttgcttctaccgagactwtatcgtttactcctgacaacataaatgcggacattagtcttggaactctgagcggaaaaacaaaagagcgygtttatctagcygaagaaggaggccgaaaagtcagtcaactygactggaaattcaataacgctgcaattattaaaggtgcaattaattgggatttgatgccccagatatctatyggggctgckggctggacwacwctcgrcagccgaggtggcaatatggtcgatcaggactggatggattccagtaaccccggaacctggacrgatgaaagtagrcaccctgatacacaactcaattatgccaacgaatttgatctgaatatcaaaggctggctcctcaacgaacccaattaccgcctgggactcatggccggatatcaggaaagccgttatagctttacagccagaggtggttcctatatctacagttctgaggagggattcagagatgatatcggctccttcccgaatggagaaagagcaatcggctacaaacaacgttttaaaatkccctacattggcttgactggaagttatcgttatgaagattttgagctaggtggcacatttaaatacagcggctgggtggaagcatctgataacgatgagcactatgacccaggaaaaagaatcacttatcgcagtaaagtcaaagaccaaaattactattctgttgcagtcaatgcaggttattacgtaacacctaacgcaaargtttatgttgaaggcgcatggaatcgggttacgaataaaaaaggtaatacttcactttatgatcacaatgataacacttcwgactacagcaaaaatggtgcaggcatagaaaactataacttcatcactactgctggtcttaagtacaccttttaa

SEQ ID NO: 3092 - protein, 317 aa, Escherichia coli
  Xaa 12, 25, 95, 198: Xaa is any amino acid
MRAKLLGIVLTXPIAISSFASTETXSFTPDNINADISLGTLSGKTKERVYLAEEGGRKVSQLDWKFNNAAIIKGAINWDLMPQISIGAAGWTTLXSRGGNMVDQDWMDSSNPGTWTDESRHPDTQLNYANEFDLNIKGWLLNEPNYRLGLMAGYQESRYSFTARGGSYIYSSEEGFRDDIGSFPNGERAIGYKQRFKXPYIGLTGSYRYEDFELGGTFKYSGWVEASDNDEHYDPGKRITYRSKVKDQNYYSVAVNAGYYVTPNAKVYVEGAWNRVTNKKGNTSLYDHNDNTSDYSKNGAGIENYNFITTAGLKYTF

SEQ ID NO: 3093 - DNA, 654 bp, Escherichia coli
atggtcgatcaggactggatggattccagtaaccccggaacctggacggatgaaagtagacaccctgatacacaactcaattatgccaacgaatttgatctgaatatcaaaggctggctcctcaacgaacccaattaccgcctgggactcatggccggatatcaggaaagccgttatagctttacagccagaggtggttcctatatctacagttctgaggagggattcagagatgatatcggctccttcccgaatggagaaagagcaatcggctacaaacaacgttttaaaattccctacattggcttgactggaagttatcgttatgaagattttgagctaggtggcacatttaaatacagcggctgggtggaagcatctgataacgatgagcactatgacccaggaaaaagaatcacttatcgcagtaaagtcaaagaccaaaattactattctgttgcagtcaatgcaggttattacgtaacacctaacgcaaaagtttatgttgaaggcgcatggaatcgggttacgaataaaaaaggtaatacttcactttatgatcacaatgataacacttctgactacagcaaaaatggtgcaggcatagaaaactataacttcatcactactgctggtcttaagtacaccttttaa

SEQ ID NO: 3094 - protein, 217 aa, Escherichia coli
MVDQDWMDSSNPGTWTDESRHPDTQLNYANEFDLNIKGWLLNEPNYRLGLMAGYQESRYSFTARGGSYIYSSEEGFRDDIGSFPNGERAIGYKQRFKIPYIGLTGSYRYEDFELGGTFKYSGWVEASDNDEHYDPGKRITYRSKVKDQNYYSVAVNAGYYVTPNAKVYVEGAWNRVTNKKGNTSLYDHNDNTSDYSKNGAGIENYNFITTAGLKYTF

SEQ ID NO: 3095 - DNA, 954 bp, Escherichia coli; identical to SEQ ID NO: 1371

SEQ ID NO: 3096 - protein, 317 aa, Escherichia coli; identical to SEQ ID NO: 1372

SEQ ID NO: 3097 - DNA, 993 bp, Escherichia coli
  n 975, 976, 977, 978, 979: n is any nucleotide
atgagtaaagtctttatttgcgccgccattccggacgaacaggyaataaaggaagaaggtgcmgtcgctgtagccactgccattgaagccggtgatgaacgtcgcgcccgcgcaaaatttcactggcaattcctggaacattatccggctgctcaggactgcgcttataaatttcttgtttgcgaggataaaccyggtataccccgccctgccctcgattcctgggatgctgaatatatgcaggaaaaccgctgggatgaggmgtctgcttcctttgtyccggtygagactgaatcmgatccgatgaacgtcacttttgacaagctggcccctgaagtacagaacgctgtcatggttaagttcgacacatgtgaaaacatcaccgttgatatggtkattagcgcrcaggaaytrttgcaggaagacatggcaacattcgacggacatatcgttgaagcgttgatgaaaatgccagaagttaacgccatgtatccggagcttaagytgcaygccatygggtgggttaagcataaatgtawkcctggtgcyaaatggcccgaaattcaggcagagatgcgcatctggaaaaaacgtcgcgaaggtgaacgcaaggaaaccggaaaatacacgtctgttgttgatctcgcccgcgccagagccaatcaacagyacactgaaaattcaacaggaaaaatcagcccggtcattgctgccattcatcgcgaatacaagcagacatggaaaacactggatgacgaactggcctacgctctctggcctggtgatgtggatgccggaaacattgacggcagcatccatcgctgggcaaaaaatgaagttatcgacaacgaccgcgaagactggaagcgtatctcggcatcaatgcgcaaacagcctgatgcccttcgctacgaccgccagactatttttggccttgtccgtgaacgcccgatcgacattcacaaagaccctgtnnnnncattcattcattaa

SEQ ID NO: 3098 - protein, 330 aa, Escherichia coli
  Xaa 15, 88, 180, 224, 326, 327: Xaa is any amino acid
MSKVFICAAIPDEQXIKEEGAVAVATAIEAGDERRARAKFHWQFLEHYPAAQDCAYKFLVCEDKPGIPRPALDSWDAEYMQENRWDEXSASFVPVETESDPMNVTFDKLAPEVQNAVMVKFDTCENITVDMVISAQELLQEDMATFDGHIVEALMKMPEVNAMYPELKLHAIGWVKHKCXPGAKWPEIQAEMRIWKKRREGERKETGKYTSVVDLARARANQQXTENSTGKISPVIAAIHREYKQTWKTLDDELAYALWPGDVDAGNIDGSIHRWAKNEVIDNDREDWKRISASMRKQPDALRYDRQTIFGLVRERPIDIHKDPVXXFIH

SEQ ID NO: 3099 - DNA, 1590 bp, Escherichia coli
  n 4, 5, 6, 7, 8, 1563, 1564, 1565, 1566, 1567: n is any nucleotide
atgnnnnnagctaatgcagccggtgcgatagctacagggcttttatctctcattattcctgttccactgacgacagttcagtgggccaataaacattattaccttcctaaagagtcgtcttataccccggggcgatgggaaacactgccgtttcaggttggcatcatgaactgtatgggcaacgatctgattcgcacggttaacctgattaaatctgcccgtgttggttatacaaagatgttgctgggagtggaggcttattttattgagcataaatcacgcaacagccttctttttcagcccacggactcagctgctgaagattttatgaaatctcatgttgagccaacgataagggatgttcctgcattgctggagctggctccatggttcggaagaaaacaccgcgataatacgctcaccctgaagcgtttttcctccggtgtgggtttctggtgtctggggggagcggcagcaaaaaactaccgtgaaaaatccgtggatgtggtctgttatgacgagctttcctcgttcgaaccggatgttgaaaaagagggttcgccaaccctgctgggggataaacgtattgagggctctgtatggccaaaatccattcgcggctcgacgcctaaaatcaaaggctcctgccagatcgaaaaagccgctaacgagtcggcacacttcatgcgtttttatgtgccctgtccgcactgtggggaggagcagtatctgaaatttggcgatgatgcctcgcctttcggtcttaagtgggagaagaataagccagaaagtgttttctacctttgtgagcatcatggctgtgtgatccatcagtctgagcttgaccagagtaacgggcggtggatctgtgaaaacacgggcatgtggacccgtgacggcctgatgtttttcagcgcccggggtgatgaaattccgccgccgcgctccatcactttccatatctggacggcgtacagtccgttcaccacctgggtacagattgtctatgactggctggatgcactgaaagatcccaacggcctgaaaacctttgtgaacaccacgctgggcgagacctgggaagaggctgtgggcgaaaaactcgatcaccaggtgctgatggataaggttgtgcgttacacggcggcggtgcctgcccgggtggtttatctgacggcgggcattgactcgcagcgaaaccgttttgagatgtatgtctggggatgggctccgggagaggaagcctttctggtggataaaatcatcattatggggcgtcccgatgaggaagagacgctgttacgtgtggatgcggcgatcaacaaaaaataccgccatgcagacggaaccgaaatgaccatttcccgtgtctgctgggacatcggggggatcgatggcgaaatcgtttatcagaggtcaaaaaaacacggtgttttccgggtgctgccggtaaaaggcgcatctgtctatggcaagccggtgatcaccatgccaaaaacccgcaatcagcggggcgtgtatctgtgtgaagtggggacggacaccgcaaaagaaattctctannnnncattccattcattaattaattaa

SEQ ID NO: 3100 - protein, 529 aa, Escherichia coli
  Xaa 2, 3, 521, 522, 523: Xaa is any amino acid
MXXANAAGAIATGLLSLIIPVPLTTVQWANKHYYLPKESSYTPGRWETLPFQVGIMNCMGNDLIRTVNLIKSARVGYTKMLLGVEAYFIEHKSRNSLLFQPTDSAAEDFMKSHVEPTIRDVPALLELAPWFGRKHRDNTLTLKRFSSGVGFWCLGGAAAKNYREKSVDVVCYDELSSFEPDVEKEGSPTLLGDKRIEGSVWPKSIRGSTPKIKGSCQIEKAANESAHFMRFYVPCPHCGEEQYLKFGDDASPFGLKWEKNKPESVFYLCEHHGCVIHQSELDQSNGRWICENTGMWTRDGLMFFSARGDEIPPPRSITFHIWTAYSPFTTWVQIVYDWLDALKDPNGLKTFVNTTLGETWEEAVGEKLDHQVLMDKVVRYTAAVPARVVYLTAGIDSQRNRFEMYVWGWAPGEEAFLVDKIIIMGRPDEEETLLRVDAAINKKYRHADGTEMTISRVCWDIGGIDGEIVYQRSKKHGVFRVLPVKGASVYGKPVITMPKTRNQRGVYLCEVGTDTAKEILXXXFHSLIN

SEQ ID NO: 3101 - DNA, 1257 bp, Escherichia coli
  n 4, 5, 6, 7, 8, 1230, 1231, 1232, 1233, 1234: n is any nucleotide
atgnnnnnagctaatgcagccggtgcgatagctacagggcttttatctctcattattcctgttccactgacgacagttcagtgggccaataaacattattaccttcctaaagagtcgtcttataccccggggcgatgggaaacactgccgtttcaggttggcatcatgaactgtatgggcaacgatctgattcgcacggttaacctgattaaatctgcccgtgttggttatacaaagatgttgctgggagtggaggcttattttattgagcataaatcacgcaacagccttctttttcagcccacggactcagctgctgaagattttatgaaatctcatgttgagccaacgataagggatgttcctgcattgctggagctggctccatggttcggaagaaaacaccgcgataatacgctcaccctgaagcgtttttcctccggtgtgggtttctggtgtctggggggagcggcagcaaaaaactaccgtgaaaaatccgtggatgtggtctgttatgacgagctttcctcgttcgaaccggatgttgaaaaagagggttcgccaaccctgctgggggataaacgtattgagggctctgtatggccaaaatccattcgcggctcgacgcctaaaatcaaaggctcctgccagatcgaaaaagccgctaacgagtcggcacacttcatgcgtttttatgtgccctgtccgcactgtggggaggagcagtatctgaaatttggcgatgatgcctcgcctttcggtcttaagtgggagaagaataagccagaaagtgttttctacctttgtgagcatcatggctgtgtgatccatcagtctgagcttgaccagagtaacgggcggtggatctgtgaaaacacgggcatgtggacccgtgacggcctgatgtttttcagcgcccggggtgatgaaattccgccgccgcgctccatcactttccatatctggacggcgtacagtccgttcaccacctgggtacagattgtctatgactggctggatgcactgaaagatcccaacggcctgaaaacctttgtgaacaccacgctgggcgagacctgggaagaggctgtgggcgaaaaactcgatcaccaggtgctgatggataaggttgtgcgttacacggcggcggtgcctgcccgggtggtttatctgacggcgggcattgactcgcagcgaaaccgttttgagatgtatgtctggggatgggcnnnnncattccattcattaattaattaa

SEQ ID NO: 3102 - protein, 418 aa, Escherichia coli
  Xaa 2, 3, 411, 412: Xaa is any amino acid
MXXANAAGAIATGLLSLIIPVPLTTVQWANKHYYLPKESSYTPGRWETLPFQVGIMNCMGNDLIRTVNLIKSARVGYTKMLLGVEAYFIEHKSRNSLLFQPTDSAAEDFMKSHVEPTIRDVPALLELAPWFGRKHRDNTLTLKRFSSGVGFWCLGGAAAKNYREKSVDVVCYDELSSFEPDVEKEGSPTLLGDKRIEGSVWPKSIRGSTPKIKGSCQIEKAANESAHFMRFYVPCPHCGEEQYLKFGDDASPFGLKWEKNKPESVFYLCEHHGCVIHQSELDQSNGRWICENTGMWTRDGLMFFSARGDEIPPPRSITFHIWTAYSPFTTWVQIVYDWLDALKDPNGLKTFVNTTLGETWEEAVGEKLDHQVLMDKVVRYTAAVPARVVYLTAGIDSQRNRFEMYVWGWAXXFHSLIN

SEQ ID NO: 3103 - DNA, 1158 bp, Escherichia coli
  n 8, 9, 10, 11, 12, 1131, 1132, 1133, 1134, 1135: n is any nucleotide
atgaatgnnnnngtgggtttctggtgtctggggggagcggcagcaaaaaactaccgtgaaaaatccgtggatgtggtctgttatgacgagctttcctcgttcgaaccggatgttgaaaaagagggttcgccaaccctgctgggggataaacgtattgagggctctgtatggccaaaatccattcgcggctcgacgcctaaaatcaaaggctcctgccagatcgaaaaagccgctaacgagtcggcacacttcatgcgtttttatgtgccctgtccgcactgtggggaggagcagtatctgaaatttggcgatgatgcctcgcctttcggtcttaagtgggagaagaataagccagaaagtgttttctacctttgtgagcatcatggctgtgtgatccatcagtctgagcttgaccagagtaacgggcggtggatctgtgaaaacacgggcatgtggacccgtgacggcctgatgtttttcagcgcccggggtgatgaaattccgccgccgcgctccatcactttccatatctggacggcgtacagtccgttcaccacctgggtacagattgtctatgactggctggatgcactgaaagatcccaacggcctgaaaacctttgtgaacaccacgctgggcgagacctgggaagaggctgtgggcgaaaaactcgatcaccaggtgctgatggataaggttgtgcgttacacggcggcggtgcctgcccgggtggtttatctgacggcgggcattgactcgcagcgaaaccgttttgagatgtatgtctggggatgggctccgggagaggaagcctttctggtggataaaatcatcattatggggcgtcccgatgaggaagagacgctgttacgtgtggatgcggcgatcaacaaaaaataccgccatgcagacggaaccgaaatgaccatttcccgtgtctgctgggacatcggggggatcgatggcgaaatcgtttatcagaggtcaaaaaaacacggtgttttccgggtgctgccggtaaaaggcgcatctgtctatggcaagccggtgatcaccatgccaaaaacccgcaatcagcggggcgtgtatctgtgtgaagtggggacggacaccgcaaaagaaattctctannnnncattccattcattaattaattaa

SEQ ID NO: 3104 - protein, 385 aa, Escherichia coli
  Xaa 3, 4, 377, 378, 379: Xaa is any amino acid
MNXXVGFWCLGGAAAKNYREKSVDVVCYDELSSFEPDVEKEGSPTLLGDKRIEGSVWPKSIRGSTPKIKGSCQIEKAANESAHFMRFYVPCPHCGEEQYLKFGDDASPFGLKWEKNKPESVFYLCEHHGCVIHQSELDQSNGRWICENTGMWTRDGLMFFSARGDEIPPPRSITFHIWTAYSPFTTWVQIVYDWLDALKDPNGLKTFVNTTLGETWEEAVGEKLDHQVLMDKVVRYTAAVPARVVYLTAGIDSQRNRFEMYVWGWAPGEEAFLVDKIIIMGRPDEEETLLRVDAAINKKYRHADGTEMTISRVCWDIGGIDGEIVYQRSKKHGVFRVLPVKGASVYGKPVITMPKTRNQRGVYLCEVGTDTAKEILXXXFHSLIN

SEQ ID NO: 3105 - DNA, 336 bp, Escherichia coli
  n 12, 13, 14, 15, 16: n is any nucleotide
atgaatgaatgnnnnncacgggcacgttttgatttttatcaggcgcgatcagcctggtcacgggcagagtggattggtgccggaagaatggccattgacgggctcaaggaagtccaggaatcagtgatgcgcattgaggccggactgagcacgtatgagaaagagctggcgctgatgggcgaggattatcaggacattttccgccagcaggtcagggaatctgctgagcggcaaaaagccggactctcacgtccggtgtggatagagcaggcgtatcagcagcagatagcggagagtcgtaggccggaagaggagacaacaccacgtgagacgtaa

SEQ ID NO: 3106 - protein, 111 aa, Escherichia coli
  Xaa 4, 5, 6: Xaa is any amino acid
MNEXXXRARFDFYQARSAWSRAEWIGAGRMAIDGLKEVQESVMRIEAGLSTYEKELALMGEDYQDIFRQQVRESAERQKAGLSRPVWIEQAYQQQIAESRRPEEETTPRET

SEQ ID NO: 3107 - DNA, 459 bp, Escherichia coli
gtgagacgtaatctttcacacattattgccgcagcattcaatgaaccgctgcttctggagcccgcctatgcgcgggttttcttttgcgcgctcgggcgcgagatgggggcagcaagtctttcggtaccacaacagcaggtacagtttgatgctcccggaatgctggctgaaacggacgagtacatggccggaggtaaacgaccggcccgtgtttaccgggtggtgaacggtattgctgtactgccggtgaccggcacgctggtgcaccggctgggggggatgcggccattttccggaatgacaggctatgacggcattgtcgcctgtcttcagcaggcaatggcggcattgtcgcctgtcttcagcaggcaatggcggatagccaggtgcggggcgtactgctggacattgacagtccgggcgggcaggccgccggcgcgtttgactgcgctgacatga

SEQ ID NO: 3108 - protein, 152 aa, Escherichia coli
MRRNLSHIIAAAFNEPLLLEPAYARVFFCALGREMGAASLSVPQQQVQFDAPGMLAETDEYMAGGKRPARVYRVVNGIAVLPVTGTLVHRLGGMRPFSGMTGYDGIVACLQQAMAALSPVFSRQWRIARCGAYCWTLTVRAGRPPARLTALT

SEQ ID NO: 3109 - DNA, 1083 bp, Escherichia coli
atgatttaccgcctccgtcagcagaagccggtctgggcactgtgcaatgacacggcctgttctgcagccatgctgctggcgtcggcctgctcccgacggctggttacccagacatcccgtatcggctccattggcgtgatgatgagccatgtcagctatgccggtcatctggcgcaggccggtgtggatatcacgctgatttactcaggggcgcacaaggtggatggcaatcagtttgaagcgttgccggcagaggttcgccaggacatgcagcagcggattgatgcggcgcgccggatgtttgccgaaaaagtggcgatgtataccggtctgtctgttgatgccgtcacgggaacagaggctgccgtttttgaaggtcagtccggcattgaggccgggctggcggatgaattaatcaatgcgtcggatgccatcagtgtgatggccacggcgctgaacagtaatgtcagaggaggcactatgccgcaattaactgcaacggaagccgccgcgcaggagaaccagcgagtgatggggatcctgacatgccaggaagcgaaaggacgtgaacagcttgccacgatgctggcaggacaacagggcatgagcgttgaacaggcccgggcgattctggccgcggcggcaccgcagcagccggtggcatccacgcagagtgaagccgatcgcattatggtgtgtgaagaagcgaacggtcgtgaacaactggcggcaacgctggcggcgatgccggagatgacggtggaaaaagcccgcccgatcctggctgcttcaccgcaggcggatgccggaccatcactccgtgatcagatcatggcactggatgaggcaaaaggggctgaggcgcaggctgaacagctggctgcctgcccgggaatgacagtggagagcgcccgggctgtgctggctgcgggatcaggtaaggcagaaccggtctctgcatccacaaccgccatgtttgaacatttcatggcgaaccattcaccggcagcggtacagggtggcgtggcacagacgtcagcagacggtgatgcggacgtgaaaatgctcatggccatgccatga

SEQ ID NO: 3110 - protein, 360 aa, Escherichia coli
MIYRLRQQKPVWALCNDTACSAAMLLASACSRRLVTQTSRIGSIGVMMSHVSYAGHLAQAGVDITLIYSGAHKVDGNQFEALPAEVRQDMQQRIDAARRMFAEKVAMYTGLSVDAVTGTEAAVFEGQSGIEAGLADELINASDAISVMATALNSNVRGGTMPQLTATEAAAQENQRVMGILTCQEAKGREQLATMLAGQQGMSVEQARAILAAAAPQQPVASTQSEADRIMVCEEANGREQLAATLAAMPEMTVEKARPILAASPQADAGPSLRDQIMALDEAKGAEAQAEQLAACPGMTVESARAVLAAGSGKAEPVSASTTAMFEHFMANHSPAAVQGGVAQTSADGDADVKMLMAMP

SEQ ID NO: 3111 - DNA, 348 bp, Escherichia coli; identical to SEQ ID NO: 3049

SEQ ID NO: 3112 - protein, 115 aa, Escherichia coli; identical to SEQ ID NO: 3050

SEQ ID NO: 3113 - DNA, 1029 bp, Escherichia coli; identical to SEQ ID NO: 3051

SEQ ID NO: 3114 - protein, 342 aa, Escherichia coli; identical to SEQ ID NO: 3052

SEQ ID NO: 3115 - DNA, 375 bp, Escherichia coli; identical to SEQ ID NO: 3053

SEQ ID NO: 3116 - protein, 124 aa, Escherichia coli; identical to SEQ ID NO: 3054

SEQ ID NO: 3117 - DNA, 375 bp, Escherichia coli; identical to SEQ ID NO: 3055

SEQ ID NO: 3118 - protein, 124 aa, Escherichia coli; identical to SEQ ID NO: 3056

SEQ ID NO: 3119 - DNA, 579 bp, Escherichia coli; identical to SEQ ID NO: 3057

SEQ ID NO: 3120 - protein, 192 aa, Escherichia coli; identical to SEQ ID NO: 3058

SEQ ID NO: 3121 - DNA, 396 bp, Escherichia coli; identical to SEQ ID NO: 3069

SEQ ID NO: 3122 - protein, 131 aa, Escherichia coli; identical to SEQ ID NO: 1336

SEQ ID NO: 3123 - DNA, 741 bp, Escherichia coli; identical to SEQ ID NO: 3071

SEQ ID NO: 3124 - protein, 246 aa, Escherichia coli; identical to SEQ ID NO: 3072

SEQ ID NO: 3125 - DNA, 423 bp, Escherichia coli; identical to SEQ ID NO: 3073

SEQ ID NO: 3126 - protein, 140 aa, Escherichia coli; identical to SEQ ID NO: 3074

SEQ ID NO: 3127 - DNA, 123 bp, Escherichia coli; identical to SEQ ID NO: 3075
  n 104, 105, 106, 107, 108: n is any nucleotide

SEQ ID NO: 3128 - protein, 40 aa, Escherichia coli; identical to SEQ ID NO: 3076
  Xaa 35, 36: Xaa is any amino acid

SEQ ID NO: 3129 - DNA, 336 bp, Escherichia coli; identical to SEQ ID NO: 3105
  n 12, 13, 14, 15, 16: n is any nucleotide

SEQ ID NO: 3130 - protein, 111 aa, Escherichia coli; identical to SEQ ID NO: 3106
  Xaa 4, 5, 6: Xaa is any amino acid

SEQ ID NO: 3131 - DNA, 459 bp, Escherichia coli; identical to SEQ ID NO: 3107

SEQ ID NO: 3132 - protein, 152 aa, Escherichia coli; identical to SEQ ID NO: 3108

SEQ ID NO: 3133 - DNA, 759 bp, Escherichia coli
  n 740, 741, 742, 743, 744: n is any nucleotide
atgatttaccgcctccgtcagcagaagccggtctgggcactgtgcaatgacacggcctgttctgcagccatgctgctggcgtcggcctgctcccgacggctggttacccagacatcccgtatcggctccattggcgtgatgatgagccatgtcagctatgccggtcatctggcgcaggccggtgtggatatcacgctgatttactcaggggcgcacaaggtggatggcaatcagtttgaagcgttgccggcagaggttcgccaggacatgcagcagcggattgatgcggcgcgccggatgtttgccgaaaaagtggcgatgtataccggtctgtctgttgatgccgtcacgggaacagaggctgccgtttttgaaggtcagtccggcattgaggccgggctggcggatgaattaatcaatgcgtcggatgccatcagtgtgatggccacggcgctgaacagtaatgtcagaggaggcactatgccgcaattaactgcaacggaagccgccgcgcaggagaaccagcgagtgatggggatcctgacatgccaggaagcgaaaggacgtgaacagcttgccacgatgctggcaggacaacagggcatgagcgttgaacaggcccgggcgattctggccgcggcggcaccgcagcagccggtggcatccacgcagagtgaagccgatcgcattatggtgtgtgagagcgacggtcgtgacactggcggcacgctggcggcgannnnncattccattcattaa

SEQ ID NO: 3134 - protein, 252 aa, Escherichia coli
  Xaa 247, 248: Xaa is any amino acid
MIYRLRQQKPVWALCNDTACSAAMLLASACSRRLVTQTSRIGSIGVMMSHVSYAGHLAQAGVDITLIYSGAHKVDGNQFEALPAEVRQDMQQRIDAARRMFAEKVAMYTGLSVDAVTGTEAAVFEGQSGIEAGLADELINASDAISVMATALNSNVRGGTMPQLTATEAAAQENQRVMGILTCQEAKGREQLATMLAGQQGMSVEQARAILAAAAPQQPVASTQSEADRIMVCESDGRDTGGTLAAXXHSIH

SEQ ID NO: 3135 - DNA, 939 bp, Escherichia coli
  n 4, 5, 6, 7, 8: n is any nucleotide
atgnnnnncagctatgccggtcatctggcgcaggccggtgtggatatcacgctgatttactcaggggcgcacaaggtggatggcaatcagtttgaagcgttgccggcagaggttcgccaggacatgcagcagcggattgatgcggcgcgccggatgtttgccgaaaaagtggcgatgtataccggtctgtctgttgatgccgtcacgggaacagaggctgccgtttttgaaggtcagtccggcattgaggccgggctggcggatgaattaatcaatgcgtcggatgccatcagtgtgatggccacggcgctgaacagtaatgtcagaggaggcactatgccgcaattaactgcaacggaagccgccgcgcaggagaaccagcgagtgatggggatcctgacatgccaggaagcgaaaggacgtgaacagcttgccacgatgctggcaggacaacagggcatgagcgttgaacaggcccgggcgattctggccgcggcggcaccgcagcagccggtggcatccacgcagagtgaagccgatcgcattatggtgtgtgaagaagcgaacggtcgtgaacaactggcggcaacgctggcggcgatgccggagatgacggtggaaaaagcccgcccgatcctggctgcttcaccgcaggcggatgccggaccatcactccgtgatcagatcatggcactggatgaggcaaaaggggctgaggcgcaggctgaacagctggctgcctgcccgggaatgacagtggagagcgcccgggctgtgctggctgcgggatcaggtaaggcagaaccggtctctgcatccacaaccgccatgtttgaacatttcatggcgaaccattcaccggcagcggtacagggtggcgtggcacagacgtcagcagacggtgatgcggacgtgaaaatgctcatggccatgccatga

SEQ ID NO: 3136 - protein, 312 aa, Escherichia coli
  Xaa 2, 3: Xaa is any amino acid
MXXSYAGHLAQAGVDITLIYSGAHKVDGNQFEALPAEVRQDMQQRIDAARRMFAEKVAMYTGLSVDAVTGTEAAVFEGQSGIEAGLADELINASDAISVMATALNSNVRGGTMPQLTATEAAAQENQRVMGILTCQEAKGREQLATMLAGQQGMSVEQARAILAAAAPQQPVASTQSEADRIMVCEEANGREQLAATLAAMPEMTVEKARPILAASPQADAGPSLRDQIMALDEAKGAEAQAEQLAACPGMTVESARAVLAAGSGKAEPVSASTTAMFEHFMANHSPAAVQGGVAQTSADGDADVKMLMAMP

SEQ ID NO: 3137 - DNA, 348 bp, Escherichia coli; identical to SEQ ID NO: 3049

SEQ ID NO: 3138 - protein, 115 aa, Escherichia coli; identical to SEQ ID NO: 3050

SEQ ID NO: 3139 - DNA, 1017 bp, Escherichia coli
  n 4, 5, 6, 7, 8: n is any nucleotide
atgnnnnntcgccagctgtctgcacaggagaaatccctgctggcgcataaagatgagacgctggagtacaaacgccagctggctgcacttggcgacaaggttacgtatcaggagcgcctgaacgcgctggcgcagcaggcggataaattcgcacagcagcaacgggcaaaacgggccgctattgatgcgaaaagccgggggctgactgaccggcaggcagaacgggaagccacggaacagcgcctgaaggaacagtatggcgataatcctctggcgctgaataacgtcatgtcagagcagaaaaagacctgggcggctgaagacctgcttcgcgggaactggatggcaggcctgaagtccggctggagtgagtgggaagagagtgccacggacagtatgtcgcaggttaaaagtgctgccacgcagacctttgatggtattgcgcagaatatggcggcgatgctgaccggcagtgaacagaactggcgcagcttcacccgttccgtgctgtccatgatgacagaaattctgcttaagcaggcaatggtggggattgtcgggagtatcggcagcgctattggcggggctgttggtggcggcgcatccgcgtcaggcggtacagccattcaggccgctgcggcgaaactccattttgcaaccggaggatttacgggaaccggcggcaaatatgagccagcggggattgttcaccgtggtgaatttgtcttcacgaaggaggcaaccagccggattggcgtgggaaatctctaccggctgatgcgcggctatgccaccggcggttatgtcggtggcaccggaagtccggcgcaaatgcggcgttcagagggtatcaggtttgagcagaacaacaacgtggtgattcagaacgacggtacgaatggtctgccaggtccacagatgatgaaggcggtgtatgacatggcccgcaagggtgcccgtgatgaaatccaggcacagatgcgcgatggtggtctgttctccggaggtggacgatga

SEQ ID NO: 3140 - protein, 338 aa, Escherichia coli
  Xaa 2, 3: Xaa is any amino acid
MXXRQLSAQEKSLLAHKDETLEYKRQLAALGDKVTYQERLNALAQQADKFAQQQRAKRAAIDAKSRGLTDRQAEREATEQRLKEQYGDNPLALNNVMSEQKKTWAAEDLLRGNWMAGLKSGWSEWEESATDSMSQVKSAATQTFDGIAQNMAAMLTGSEQNWRSFTRSVLSMMTEILLKQAMVGIVGSIGSAIGGAVGGGASASGGTAIQAAAAKLHFATGGFTGTGGKYEPAGIVHRGEFVFTKEATSRIGVGNLYRLMRGYATGGYVGGTGSPAQMRRSEGIRFEQNNNVVIQNDGTNGLPGPQMMKAVYDMARKGARDEIQAQMRDGGLFSGGGR

SEQ ID NO: 3141 - DNA, 330 bp, Escherichia coli; identical to SEQ ID NO: 1773

SEQ ID NO: 3142 - protein, 109 aa, Escherichia coli; identical to SEQ ID NO: 1774

SEQ ID NO: 3143 - DNA, 327 bp, Escherichia coli
  n 308, 309, 310, 311, 312: n is any nucleotide
atgcaggatatccggcaggaaacattgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggcgacagtatcagccgtatcccattcaggggagtagttttgaactgaatggcaaaggcaccagtacgcgccccacgctgacggtttctaacctgtacggtatggtcaccgggatggtggaagatctgcagagtctggtcggcggaacggnnnnncattccattcattaa

SEQ ID NO: 3144 - protein, 108 aa, Escherichia coli
  Xaa 103, 104: Xaa is any amino acid
MQDIRQETLNECTRAEQSASVVLWEIDLTEVGGERYFFCNEQNEKGEPVTWQGRQYQPYPIQGSSFELNGKGTSTRPTLTVSNLYGMVTGMVEDLQSLVGGTXXHSIH

SEQ ID NO: 3145 - DNA, 180 bp, Escherichia coli
  n 8, 9, 10, 11, 12: n is any nucleotide
atgaatgnnnnnattaattttaatcagaacaatcacgtggtgattcagaacgacggtacgaatggtctgccaggtccacagatgatgaaggcggtgtatgacatggcccgcaagggtgcccgtgatgaaatccaggcacagatgcgcgatggtggtctgttctccggaggtggacgatga

SEQ ID NO: 3146 - protein, 59 aa, Escherichia coli
  Xaa 3, 4: Xaa is any amino acid
MNXXINFNQNNHVVIQNDGTNGLPGPQMMKAVYDMARKGARDEIQAQMRDGGLFSGGGR

SEQ ID NO: 3147 - DNA, 330 bp, Escherichia coli
atgaaaaccttccgctggaaagtgaaacccgggatggatgtgacatcggctccttccgtcagggaggtgcgctttggtgatggctattcccagcgtgcgcctgccgggctgaacgctgacctgaaaacgtacagcgtgacgctgtctgtctcccgtgaggaggccacggcgctggagtcgtttctggctgagcacgggggctggaaggcctttctgtggacgccgccttatggttacaggcagataaaggtgacctgcgcaaaatggtcgtcgcaggtcagtatgttgcgtgttgggttcagcgcagagtttaaacaggtggtgaactga

SEQ ID NO: 3148 - protein, 109 aa, Escherichia coli
MKTFRWKVKPGMDVTSAPSVREVRFGDGYSQRAPAGLNADLKTYSVTLSVSREEATALESFLAEHGGWKAFLWTPPYGYRQIKVTCAKWSSQVSMLRVGFSAEFKQVVN

SEQ ID NO: 3149 - DNA, 564 bp, Escherichia coli
  n 545, 546, 547, 548, 549: n is any nucleotide
atgcaggatatccggcaggaaacactgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggaggcagtatcaggcgtatcccattcaggggagcggttttgaactgaatggcaaaggcaccagtacgcggcccacgctggcagtctctaacctgtacggcatggtcaccggtatggtggaagatatgcagagtctggtcggcggaacggtggtccggcgtaaggtttacgcccgttttctggatgcggtgaacttcgtcaacggaaacagagacgccgatccggagcaggaggtgatcagccgctggcgcatcgagcagtgcagcgaactgagcgcggtgagtgcctcctttgtactgtccacgccgacggaaacggatggcgctgtttttccggggcgtatcatgctggccaacacctgcacctggacctatcgcggtgatgagtnnnnncattccattcattaa

SEQ ID NO: 3150 - protein, 187 aa, Escherichia coli
  Xaa 182, 183: Xaa is any amino acid
MQDIRQETLNECTRAEQSASVVLWEIDLTEVGGERYFFCNEQNEKGEPVTWQGRQYQAYPIQGSGFELNGKGTSTRPTLAVSNLYGMVTGMVEDMQSLVGGTVVRRKVYARFLDAVNFVNGNRDADPEQEVISRWRIEQCSELSAVSASFVLSTPTETDGAVFPGRIMLANTCTWTYRGDEXXHSIH

SEQ ID NO: 3151 - DNA, 180 bp, Escherichia coli; identical to SEQ ID NO: 3145
  n 8, 9, 10, 11, 12: n is any nucleotide

SEQ ID NO: 3152 - protein, 59 aa, Escherichia coli; identical to SEQ ID NO: 3146
  Xaa 3, 4: Xaa is any amino acid

SEQ ID NO: 3153 - DNA, 330 bp, Escherichia coli; identical to SEQ ID NO: 3147

SEQ ID NO: 3154 - protein, 109 aa, Escherichia coli; identical to SEQ ID NO: 3148

SEQ ID NO: 3155 - DNA, 564 bp, Escherichia coli; identical to SEQ ID NO: 3149
  n 545, 546, 547, 548, 549: n is any nucleotide

SEQ ID NO: 3156 - protein, 187 aa, Escherichia coli; identical to SEQ ID NO: 3150
  Xaa 182, 183: Xaa is any amino acid

SEQ ID NO: 3157 - DNA, 315 bp, Escherichia coli
  n 289, 290, 291, 292, 293: n is any nucleotide
atgaccgtcgaaacgcaacttaatcccacacagcctgtcaatcagcagatttatcgtattcttcgccgcgacattgtccattgcctgattgcaccaggcacaccgttgtcggaaaaagaagtttctgttcgtttcaatgtgtcacgccagccggttcgtgaagcctttattaaactggcggaaaacggtctgattcaaattcgtccgcagcgtggcagctacgtcaacaaaatttccatggcccaggtgcgcaacggcmgttttatccgtcaggccattgagtgcgcgnnnnncattcattcattaattaattaa

SEQ ID NO: 3158 - protein, 104 aa, Escherichia coli
  Xaa 87, 97, 98: Xaa is any amino acid
MTVETQLNPTQPVNQQIYRILRRDIVHCLIAPGTPLSEKEVSVRFNVSRQPVREAFIKLAENGLIQIRPQRGSYVNKISMAQVRNGXFIRQAIECAXXIHSLIN

SEQ ID NO: 3159 - DNA, 747 bp, Escherichia coli
atgatcgttttagtaactggagcaacggcaggttttggtgaatgcattactcgtcgttttattcaacaagggcataaagttatcgccactggccgtcgccaggagcggttgcaggagttaaaagacgaactgggagataatctgtatatcgcccaactggacgttcgcaaccgcgccgctattgaagagatgctggcatcgcttcctgccgagtggagcaatattgatatcctggtaaataatgccggtctggcgttgggcatggagcctgcgcataaagccagcgttgaagactgggaaacgatgattgataccaacaacaaaggcctggtatatatgacgcgcgccgtcttaccgggtatggttgaacgtaatcatggtcatattattaacattggctcaacggcaggcagctggccgtatgccggtggtaacgtttacggtgcgacgaaagcgtttgttcgtcagtttagcctgaatctgcgtacggacctgcatggtacggcggtgcgcgtcaccgacatcgaaccgggtctggtgggtggcaccgagttttccaatgtccgctttaaaggcgatgacggtaaagcggaaaaaacctatcaaaataccgttgcattgacgccagaagatgtcagcgaagccgtctggtgggtgtcaacgctgcctgctcacgtcaatatcaataccctggaaatgatgccggttacccaaagctatgccggactgaatgtccaccgtcagtaa

SEQ ID NO: 3160 - protein, 248 aa, Escherichia coli
MIVLVTGATAGFGECITRRFIQQGHKVIATGRRQERLQELKDELGDNLYIAQLDVRNRAAIEEMLASLPAEWSNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 3161 - DNA, 948 bp, Escherichia coli
atgacaacaatgaatcctttccttgtgcaaagcacactgccgtatctggctccccattttgatcaaattgccaaccatcactatcgcccggcattcgatgagggaatacagcaaaagcgggcagaaattgctgccatcgcgcttaacccgcaaacacctgatttcaaaaatactattctggcactggaacaaagcggagaattacttacccgcgttaccagcgtcttttttgcgatgactgcggcgcataccaatgatgaattacagcgtcttgatgaacagttttccgctgaactggcggaacttgcgaatgatatctatctgaacggggaattattcgcgcgggtagatgctgtctggcaacgccgtgaatccttggggcttgatagtgaatccatccgcctggtggaggtgattcatcaacgttttgtccttgccggagccaaacttgagcaagctgataaagcaaaattaaaagtactgaatacagaagctgcgaccctgaccagccagtttaaccagcggttactggcagcaaataaatccggcggtctggttgtgaacgatatcgcgcagctggcaggaatgagtgaacaagagattgcgctggcggcagaggcggctcgcgagaaaggtctggataacaactggctgattccgctgctgaataccacccagcaaccagtgcttgctgaactgcgcgatcgcgcgacgcgtgaaaaactgtttactgcgggctggacgcgagcggaaaaaatgatgccaatgatacccgcgctatcattcaacgtctggtggagatccgcgtgcagcaggcgaaactgcttggttttcctcattatgccgcatggaaaatcgccgatcagatggcaaaaacgccagaagcagcactcaactttatgcgggaaattgttccagcggcgcgtcaacgtgcgagcgatgaattag

SEQ ID NO: 3162 - protein, 315 aa, Escherichia coli
MTTMNPFLVQSTLPYLAPHFDQIANHHYRPAFDEGIQQKRAEIAAIALNPQTPDFKNTILALEQSGELLTRVTSVFFAMTAAHTNDELQRLDEQFSAELAELANDIYLNGELFARVDAVWQRRESLGLDSESIRLVEVIHQRFVLAGAKLEQADKAKLKVLNTEAATLTSQFNQRLLAANKSGGLVVNDIAQLAGMSEQEIALAAEAAREKGLDNNWLIPLLNTTQQPVLAELRDRATREKLFTAGWTRAEKMMPMIPALSFNVWWRSACSRRNCLVFLIMPHGKSPIRWQKRQKQHSTLCGKLFQRRVNVRAMN

SEQ ID NO: 3163 - DNA, 1146 bp, Escherichia coli
atgcgggaaattgttccagcggcgcgtcaacgtgcgagcgatgaattagcctccatacaggcggttatcgataagcagcagggcgggtttagcgcgcagccgtgggactgggcattttatgccgagcaggtaagacgtgagaaattcgatctcgatgaatcgcagctcaagccatattttgaattaaacacggtgttgaatgaaggtgtattctggaccgcgaatcagctcttcggtattaagtttgtcgaacgttttgatattcctgtctaccatcctgacgttcgagtgtgggaaatttttgatcataatggcgtggggctggcgttattttacggtgatttcttcgcccgtgattcaaaaagcggcggtgcatggatgggcaattttgttgagcaatcaacgctgaatgaaacgcacccggtaatttataacgtctgcaattatcagaaacccgctgccggtgagcctgcgttgttactctgggatgatgtaataaccttattccatgaatttggtcatacgctgcacggcctttttgcccgccagcgttatgccacgctttccggcaccaacacgccgcgtgattttgtcgaatttccgtcgcaaatcaacgaacactgggcaacacatccgcaggtatttgctcgctacgcccggcattatcagagcggggccgcaatgcctgacgaacttcaacagaaaatgcgtaatgccagtctgttcaataaagggtatgagatgagcgaactgcttagcgccgcacttctcgatatgcgctggcattgcctggaagaaaacgaagcaatgcaggacgtcgatgatttcgaattgcgggcgctggtggcggaaaatatggatcttcctgctataccgccacgctatcgcagcagttatttcgcccatatttttggtggcggatatgccgcaggttattacgcttatctgtggacgcaaatgttggccgatgatggttaccagtggtttgttgagcagggcggattaacgcgtgaaaatgggcggcgttttcgcgaggcgattctttccagaggtaacagcgaagatctggaacgcctgtatcgacaatggcgcggtaaggcacctcagattatgccgatgctgcaacatcgtggcttgaacgtataa

SEQ ID NO: 3164 - protein, 381 aa, Escherichia coli
MREIVPAARQRASDELASIQAVIDKQQGGFSAQPWDWAFYAEQVRREKFDLDESQLKPYFELNTVLNEGVFWTANQLFGIKFVERFDIPVYHPDVRVWEIFDHNGVGLALFYGDFFARDSKSGGAWMGNFVEQSTLNETHPVIYNVCNYQKPAAGEPALLLWDDVITLFHEFGHTLHGLFARQRYATLSGTNTPRDFVEFPSQINEHWATHPQVFARYARHYQSGAAMPDELQQKMRNASLFNKGYEMSELLSAALLDMRWHCLEENEAMQDVDDFELRALVAENMDLPAIPPRYRSSYFAHIFGGGYAAGYYAYLWTQMLADDGYQWFVEQGGLTRENGRRFREAILSRGNSEDLERLYRQWRGKAPQIMPMLQHRGLNV

SEQ ID NO: 3165 - DNA, 153 bp, Escherichia coli
atgagtgacccgaacgacggtcggcgcgcttttcttatccagactgccgctaatgttgctcatctggtccggctgaatttgaaaattattataacggaagggtatacaaaaaaagtaattttgctggcgactgcgaaacggcattcgcattag

SEQ ID NO: 3166 - protein, 50 aa, Escherichia coli
MSDPNDGRRAFLIQTAANVAHLVRLNLKIIITEGYTKKVILLATAKRHSH

SEQ ID NO: 3167 - DNA, 891 bp, Escherichia coli
atgatcaagaagacaacggaaattgatgccatcttgttaaatctcaataaggctatcgatgcccactaccagtggctggtaagtatgtttcgcagcgtagtcgcgagagatgccagtaagccagaaataacggataaccattcttatggactgtgccagtttggtcggtggattgatcatctgggaccactcgataacgatgaattaccttatgttcggctaatggattctgcccatcaacatatgcataactgtggtcgggaattaatgctggctattgttgaaaatcactggcaggacgcgcatttcgacgcttttcaggaagggttgctttcttttactgcggcattaaccgattacaaaatttatttgctgacgatccgtagcagtatggatgttctgacgggattgccgggtcgtcgggttcttgatgaatccttcgatcatcagttacgcaatgctgaacctctgaatctttatttaatgttgttggatatagaccgatttaaattggttaatgatacctacgggcatttaatcggcgatgtagtattacgcaccctcgcaacttacttagccagttggacgcgcgattacgaaacggtttatcgctacgggggcgaagaatttatcattattgtcaaagcgactaatgatgaagaagcatgtcgtgcaggtgtcagaatttgccagttagtcgataaccatgccatcacacattctgaagggcatatcaacattaccgtgactgctggtgtgagtcgtgcatttcctgaagagcctctggatgtggtcattggaagagcggacagggcaatgtatgagggtaagcaaaccggaaggaatcgctgcatgtttattgacgaacaaaatgtgattaaccgagtttaa

SEQ ID NO: 3168 - protein, 296 aa, Escherichia coli
MIKKTTEIDAILLNLNKAIDAHYQWLVSMFRSVVARDASKPEITDNHSYGLCQFGRWIDHLGPLDNDELPYVRLMDSAHQHMHNCGRELMLAIVENHWQDAHFDAFQEGLLSFTAALTDYKIYLLTIRSSMDVLTGLPGRRVLDESFDHQLRNAEPLNLYLMLLDIDRFKLVNDTYGHLIGDVVLRTLATYLASWTRDYETVYRYGGEEFIIIVKATNDEEACRAGVRICQLVDNHAITHSEGHINITVTAGVSRAFPEEPLDVVIGRADRAMYEGKQTGRNRCMFIDEQNVINRV

SEQ ID NO: 3169 - DNA, 96 bp, Escherichia coli
atgctgggtaatatgaatgtttttatggccgtactgggaataattttattttctgggtttctggccgcgtatttcagccacaaatgggatgactaa

SEQ ID NO: 3170 - protein, 31 aa, Escherichia coli
MLGNMNVFMAVLGIILFSGFLAAYFSHKWDD

SEQ ID NO: 3171 - DNA, 1188 bp, Escherichia coli
atgaacttatccctacgacgctctaccagcgcccttcttgcctcgtcgttgttattaaccatcggacgcggcgctacgctgccgtttatgaccatttacttgagtcgccagtacagcctgagtgtcgatctaatcggttatgcgatgacaattgcgctcactattggcgtcatttttagcctcggttttggtatcctggcggataagttcgacaagaaacgctatatgttactggcaattaccgccttcgctagcggttttattgccattcctttagtgaataacgtgacgctggtggtgctcttttttgcccttattaactgcgcctactccgtttttgctaccgtgctgaaagcctggtttgccgacaatctttcgtccaacagcaaaacgaagattttctcaatcaactacaccatgctcaacattggctggaccatcggtccgccactcggcacgctgttggtgatgcagagcatcaatctgcccttctggctggcagctatctgttccgcgttccccatgcttttcattcaaatttgggtaaagcgcagcgagaaaatcatcgccacggaaacaggcagtgtctggtcgccgaaagttttattacaagataaagcactgttgtggtttacctgctctggctttctggcttcttttgttagcggcgcatttgcttcatgcatttcacaatatgtgatggtgattgctgatggtgattttgccgaaaaggtggtcgcggttgttcttccggtgaatgctgccatggtggttacgttgcaatattccgtgggccgccgccttaacccggctaacatccgcgcgctgatgacagcaggcaccctctgtttcgtcatcgggctggtcggttttattttttccggcaacagcctgctattgtggggtatgtcagctgcggtatttactgtcggtgaaatcatttatgcgccgggcgagtatatgttgattgaccatattgcgccgccaggaatgaaagccagctatttttccgcccagtctttaggctggcttggtgctgcgattaacccattagtgagtggcatagtacttaccagtctgccgcctttctcgctgtttatcatcttagcgttggtgatcgttgttgcgtgggtgctgatgttaaaaggaattcgtgcaagaccgtgggggcagcccgcgctttgttga

SEQ ID NO: 3172 - protein, 395 aa, Escherichia coli
MNLSLRRSTSALLASSLLLTIGRGATLPFMTIYLSRQYSLSVDLIGYAMTIALTIGVIFSLGFGILADKFDKKRYMLLAITAFASGFIAIPLVNNVTLVVLFFALINCAYSVFATVLKAWFADNLSSNSKTKIFSINYTMLNIGWTIGPPLGTLLVMQSINLPFWLAAICSAFPMLFIQIWVKRSEKIIATETGSVWSPKVLLQDKALLWFTCSGFLASFVSGAFASCISQYVMVIADGDFAEKVVAVVLPVNAAMVVTLQYSVGRRLNPANIRALMTAGTLCFVIGLVGFIFSGNSLLLWGMSAAVFTVGEIIYAPGEYMLIDHIAPPGMKASYFSAQSLGWLGAAINPLVSGIVLTSLPPFSLFIILALVIVVAWVLMLKGIRARPWGQPALC

SEQ ID NO: 3173 - DNA, 900 bp, Escherichia coli
atgtcgcgaaaagatggggtgttggcgctactggtagtggttgtatgggggctaaattttgtggtcatcaaagtggggcttcataacatgccaccgctgatgctggccggtttgcgctttatgctggttgctttcccggccatcttttttgtcgcacgaccgaaagtaccactgaatttgctgctggggtatggattaaccatcagttttgcgcagtttgcctttctgttctgcgctattaactttggtatgcctgctggactggcctcgttggtgttacaggcacaagcgttttttactatcgtgcttggcgcgtttactttcggtgaacgactacatggcaaacaattggcggggatcgccttagcgatttttggcgtactggtgttaatcgaagatagtctgaacggtcagcatgtggcgatgctcggctttatgttgaccctggcggcagcatttagttgggcgtgtggcaacatcttcaataaaaagatcatgtcgcacgcaacgcgtccggcagtgatgtcgctggtaatctggagcgcattaatcccaatcattcccttctttgttgcctcgctgattctcgatggttccgcaaccatgattcacagtctggttactatcgatatgaccaccatcttgtctctgatgtatctggcgtttgtggcgacaattgttggttatgggatctgggggacgttactgggacgctatgaaacctggcgggttgcaccgttatcgttactggtgcctgtagttggactggcaagtgcggcactattgttggatgaacgcttaacgggtctgcaatttttcggtgcggtgctcattatgaccgggctgtatatcaatgtatttggcttgcggtggcgtaaagcggtaaaggtcagaggctaa

SEQ ID NO: 3174 - protein, 299 aa, Escherichia coli
MSRKDGVLALLVVVVWGLNFVVIKVGLHNMPPLMLAGLRFMLVAFPAIFFVARPKVPLNLLLGYGLTISFAQFAFLFCAINFGMPAGLASLVLQAQAFFTIVLGAFTFGERLHGKQLAGIALAIFGVLVLIEDSLNGQHVAMLGFMLTLAAAFSWACGNIFNKKIMSHATRPAVMSLVIWSALIPIIPFFVASLILDGSATMIHSLVTIDMTTILSLMYLAFVATIVGYGIWGTLLGRYETWRVAPLSLLVPVVGLASAALLLDERLTGLQFFGAVLIMTGLYINVFGLRWRKAVKVRG

SEQ ID NO: 3175 - DNA, 699 bp, Escherichia coli
gtgatttttcaaaagattgcccgcttacttaaatccgagatcaatggcaattcatggcatgttggtgatttgttgccgtcagaagcggaactcgctgttcgttataatgtttcgcgtaataccctgcgtaaggcattatccctgctggaaggcgaaggaattattcacagaaagcatggttcaggaacatacattcaaaaaaagaattttgttgcacacattgatcacatgaacagtttcagtgaaattgcacataaaagcggcaaagaggcaggaagtcagattatgaaatttgaagtgcaggatgcttctcctactattgcgactgagctgaatttagtgactggtgagcaggtttattacataaagagactgcgattcattgaggataatgcagcacaattagaagaaacgtggatgtcagtggcacgttttcctgatttaaccgtatcgcatatgcaaaaatccaaattttcgtatattgagaacgaatgcgggatcaaaatcattggcacctttgaaactttctccccgacttttcctaccccagaaatcgccagtattttacggatcagcccacgggatcccatacttaaaattcagacccaggctgtggatagtaactctattccgctggattattcgttactttacagcaatattttcgagttccaggtaaagtacttttttccgcgataa

SEQ ID NO: 3176 - protein, 232 aa, Escherichia coli
MIFQKIARLLKSEINGNSWHVGDLLPSEAELAVRYNVSRNTLRKALSLLEGEGIIHRKHGSGTYIQKKNFVAHIDHMNSFSEIAHKSGKEAGSQIMKFEVQDASPTIATELNLVTGEQVYYIKRLRFIEDNAAQLEETWMSVARFPDLTVSHMQKSKFSYIENECGIKIIGTFETFSPTFPTPEIASILRISPRDPILKIQTQAVDSNSIPLDYSLLYSNIFEFQVKYFFPR

SEQ ID NO: 3177 - DNA, 312 bp, Escherichia coli
atgaaaaagatattgttagtttgcgctgcgggcatgtcaaccagtatgctggttaaacgtatgattgatcatgctaccgctatttcacttgaagttaatatttccgcattggcgattgcagaggctaaagggaaaattaaaaataacgaagttgacgttgttttacttggtccgcaagttcgctttcagaaaccagagattgaagccgttgcacaggggaaaatgcctgtagccgttatcgagatgaaagactatggcacaatgaacggacaggcagttcttgaatttgcgatgaaactactgcaagagtaa

SEQ ID NO: 3178 - protein, 103 aa, Escherichia coli
MKKILLVCAAGMSTSMLVKRMIDHATAISLEVNISALAIAEAKGKIKNNEVDVVLLGPQVRFQKPEIEAVAQGKMPVAVIEMKDYGTMNGQAVLEFAMKLLQE

SEQ ID NO: 3179 - DNA, 1362 bp, Escherichia coli
ttgggatgtataaatatccagaacaacaggtataaaaaaatgggattaatggcatcattcgaacgtggaatggaacgttttcttgttccagttgctatcaagttaaactcacaaaaacatgttgcagcggtgagagatggattcgtttttacgtttccaattatcatggcaagctcattaattatattaattaactttgccatattatcgcccgacggttttattgccggattactgcatctgaacagcattttccccaaccttgaaaaagcacaagctatttttactccggtaatgaatggttctgtaaatatcatgtcaattatgattgctttcctggtcgctaggaatgtggcgattagctatgagcaagatgatcttttatgcggattaacggcaataggagcattttttattgtttataccccataccagatgatagatgggcaggcattcctgacgaccaaatatctcggcgcgcaggggttgtttgttgctgttatcgttgcattgatcaccagtgaaatattttgtcgcttagctcgaaaccccaaaatcaccataacgatgccggcagctgtacctcctgcggtagcgcgttcatttaaagttttattgccaatattttttgtcatggtgttcttttccgcacttaattattgcctgacattgatatccccggcaggattaaatgatctcatttacacattaatccagacgccgctcaaacatatgggaacgaatatctttgcggtaattatcctgggggctgtgggtaatttcctctgggtgctggggatccacggacctaatacaacgtcggcaattcgagaaaccgttttttctgaggctaatctggagaatctctcctgggccgctcaacacggcactacctggggcgcgccatatccgattacctggacttctattaatgatgcattcgccaactgcggcggttcaggtatgacgttggggttattgttggctatttttatcgcttctaagcgtgcggaataccgtgatctggcaaaaatgtcatttatccccggtattttcaatatcaatgaaccgataatgttcggccttcctattgtacttaaccccatcatgatggtgccgtttattatggttcccattgttaactgtgccattggttacttctttgtttcgatggaaattattccaccggttgcttatgccgtgccctggactacgcccggacctttaattgctttcctcggaaccgggggaaactggctggcattactggttggttttttatgtttaggtgtggcgataatgatctatttaccttttgttatcgccgccaacaaagtcaataacatggcaactaacggataa

SEQ ID NO: 3180 - protein, 453 aa, Escherichia coli
MGCINIQNNRYKKMGLMASFERGMERFLVPVAIKLNSQKHVAAVRDGFVFTFPIIMASSLIILINFAILSPDGFIAGLLHLNSIFPNLEKAQAIFTPVMNGSVNIMSIMIAFLVARNVAISYEQDDLLCGLTAIGAFFIVYTPYQMIDGQAFLTTKYLGAQGLFVAVIVALITSEIFCRLARNPKITITMPAAVPPAVARSFKVLLPIFFVMVFFSALNYCLTLISPAGLNDLIYTLIQTPLKHMGTNIFAVIILGAVGNFLWVLGIHGPNTTSAIRETVFSEANLENLSWAAQHGTTWGAPYPITWTSINDAFANCGGSGMTLGLLLAIFIASKRAEYRDLAKMSFIPGIFNINEPIMFGLPIVLNPIMMVPFIMVPIVNCAIGYFFVSMEIIPPVAYAVPWTTPGPLIAFLGTGGNWLALLVGFLCLGVAIMIYLPFVIAANKVNNMATNG

SEQ ID NO: 3181 - DNA, 312 bp, Escherichia coli
atgtttgcagatgaagaacttgttatggagttactgatcaacgcgggacaggctcgttctgatgcgatggaagccatacgttgtgccgggcaaaaagactggcagggcgcaactaaactaatggccagctctgaatctgcctgtcttcaggcgcataagattcagaccgcgttaattagtcaggatgaaggctgtggcaaaatagaagttaatttaattctgatacatgcacaggatcatttgatgaatgcaatattatgccaggatttagccagggaaattatttcattaagaaaagagctccatgcctga

SEQ ID NO: 3182 - protein, 103 aa, Escherichia coli
MFADEELVMELLINAGQARSDAMEAIRCAGQKDWQGATKLMASSESACLQAHKIQTALISQDEGCGKIEVNLILIHAQDHLMNAILCQDLAREIISLRKELHA

SEQ ID NO: 3183 - DNA, 1674 bp, Escherichia coli
atgaatataaagacgcttaacgtcagccttttgtctatttctattattacagcattgtttccgttgaacgcgatggcaacaaaattaaccatagagcagcgccttgaattgcttgaaaatgaattgtcgcaaaataaacaagagctgaaagcaacacagaatgaactgggagtatataaattccgactttcgacattacaaaaaagcatcacagaaaataaatatcaatcggcctcgcttgccgaaatatcagcgacatctcccgttgctgataacatcaaaaatgaaaacggtgaacagaactcgtttgccgcagcacatactataaatggatcgcagcaaattgccgttattgaaagtaaaggcgataaaaccactatcgaaagcgtgaccctgaaagatatcagtaaatatataaaggatgatattggattcagctatcaggggtacttccgctcaggctggggcaccggtaatcacggctcaccacaaacttatgcagcgggttctctgggacgttttggtaacaagatgagtggttggtttgacctgaccttaaatcagcgtgtttataatcaggacggtagaacggcaaatgcggtcgttacctatgatggaaacgtaggtcagcagtataacgatgcctggtttggtgacagtgccaatgaaaatatcatgcagttcagtgatatttatctgacaacgcgaggttttttacccttcgcacgagaggcagaattctgggtcggcaaacataaactcccgcaatatgagatccaaatgctggactggaaaaccttaaccacggatgttgccgcgggtgtggggattgaaaactgggcgcttggtgtagggctgtttgatatgtccttaagccgagatgatgtcgatgtttactctcgtgattttacgcgtaccagtcagatgaataccaattctgtggatgttcgttatcgcaatatcccgttatgggatgatgcgacgttgtcattaatggctaaatattccgcacctaataaaacggatcaacaacaagataatgaaaatgacgacagttattttgaaatgaaagatagctggatgctggcttctgttttacggcaaaacttgcaacgcgatacgtttaatgaatttacgttacaggttgccaataattcctatgccagcagttttgccagtttctcagatgccagtaatacgatggcgcatggtcgctattactatggtgaccataccaatgggatcgcctggcgtttaatctctcagggcgagatgtatctgactgacaatattattatggctaacgcgcttgtctattctcatggcgaagatgtttatagttatgaaagtggcgctcatagtgattttgacagtattcgcaccgtaataagaccggcctggatctggaatacatggaatcagacggggcttgaattaggctggtttaagcaacagaacaaaactcagcagggggtaacgctaaatgaatcggcttataaaacgacactctggcatgcattgaaagtgggtgaaagtattttaggttcacgaccagaaattcgcttctacgggacgtatatcaatattctggataacgaattatcgaattttaagtttaatgagaacagcaaagacgagtttatggccggcatccaggcggaagtctggtggtaa

SEQ ID NO: 3184 - protein, 557 aa, Escherichia coli
MNIKTLNVSLLSISIITALFPLNAMATKLTIEQRLELLENELSQNKQELKATQNELGVYKFRLSTLQKSITENKYQSASLAEISATSPVADNIKNENGEQNSFAAAHTINGSQQIAVIESKGDKTTIESVTLKDISKYIKDDIGFSYQGYFRSGWGTGNHGSPQTYAAGSLGRFGNKMSGWFDLTLNQRVYNQDGRTANAVVTYDGNVGQQYNDAWFGDSANENIMQFSDIYLTTRGFLPFAREAEFWVGKHKLPQYEIQMLDWKTLTTDVAAGVGIENWALGVGLFDMSLSRDDVDVYSRDFTRTSQMNTNSVDVRYRNIPLWDDATLSLMAKYSAPNKTDQQQDNENDDSYFEMKDSWMLASVLRQNLQRDTFNEFTLQVANNSYASSFASFSDASNTMAHGRYYYGDHTNGIAWRLISQGEMYLTDNIIMANALVYSHGEDVYSYESGAHSDFDSIRTVIRPAWIWNTWNQTGLELGWFKQQNKTQQGVTLNESAYKTTLWHALKVGESILGSRPEIRFYGTYINILDNELSNFKFNENSKDEFMAGIQAEVWW

SEQ ID NO: 3185 - DNA, 1440 bp, Escherichia coli
atgtcaggatttaaagaagattttttatggggcggtgcggtagccgcacatcaattggaaggtggctggaatgaaggaggaaaaggcatcagtatcgctgatgtaatgactgctggcgctcacggggtgccgcgtgaagtgacagaaggcgttatcgacggacttaattatcccaatcatgaagcaattgatttttatcatcgctataaaacagatattcagttatttgccgggatgggattcaaatgctttcgaacttccattgcctggacacgaatctttccgcaaggtgacgaacaggagccgaatgaagagggtttacaattttatgatgatctcttcgatgaatgcctgaagcagggaatggaacctgtggtgacgctttcgcattttgagatgccttatcatctggtgacaaaatatggtggctggcgaaaccgtaaactgatcgacttttttatccacttcgcatcaacggtcttcacgcgctataaagcaaaagtaaagtactggatgacgtttaacgaaatcaataatcaggtgaatttcagcgaaagcctgtgtccatttactaattccggtatcttgtattcgccagaggaagatctcaatgagcgcgaacaaataatgtaccaggcggtacattatgagttagttgccagtgccctggcggtacagactggaaaactgatcaatcctgaatttaatatcggctgtatgattgctatgtgccccatctatcctctgacgtgtgcacccaacgatatgatgatggccacgaaagcgatgcatcgtcgttactggtttactgatgttcatgctcgtggatattatccgcaacatatgctgaattactttgcaaggaaaggattcaacctcgatatcacaccagatgataacgcgattcttgccagaggttgtgtcgactttatcggctttagctactacatgtcttttacgacgcaattttcgccagataatccgcaactggattatgttgaaccacgagatttggtcagcaacccttatatcgatacatccgaatggggatggcaaattgatccggcagggctacgttattcactcaactggttctgggatcatttccagttgccgctgtttattgtcgaaaatggatttggtgcggttgaccagagacaagctgacggcacggtgaacgatcactatcgcattgattacttttcctcccatattcgggaaatgaaaaaagccgtagttgaagatggtgttgacttaattggctacaccccgtggggttgcattgacctggtttctgccggaacaggagaaatgaaaaaacgctacggaatgatttatgtcgataaagacaacgaagggaagggaacgctggaacggatacgtaaagcatcgttttactggtatcgggatctcatcgccaacaatggcgaaaatatatga

SEQ ID NO: 3186 - protein, 479 aa, Escherichia coli
MSGFKEDFLWGGAVAAHQLEGGWNEGGKGISIADVMTAGAHGVPREVTEGVIDGLNYPNHEAIDFYHRYKTDIQLFAGMGFKCFRTSIAWTRIFPQGDEQEPNEEGLQFYDDLFDECLKQGMEPVVTLSHFEMPYHLVTKYGGWRNRKLIDFFIHFASTVFTRYKAKVKYWMTFNEINNQVNFSESLCPFTNSGILYSPEEDLNEREQIMYQAVHYELVASALAVQTGKLINPEFNIGCMIAMCPIYPLTCAPNDMMMATKAMHRRYWFTDVHARGYYPQHMLNYFARKGFNLDITPDDNAILARGCVDFIGFSYYMSFTTQFSPDNPQLDYVEPRDLVSNPYIDTSEWGWQIDPAGLRYSLNWFWDHFQLPLFIVENGFGAVDQRQADGTVNDHYRIDYFSSHIREMKKAVVEDGVDLIGYTPWGCIDLVSAGTGEMKKRYGMIYVDKDNEGKGTLERIRKASFYWYRDLIANNGENI

SEQ ID NO: 3187 - DNA, 219 bp, Escherichia coli
atgaaaccacttttatccgcaatagcaactgcgcttattctcttttctgcgcagggcgttgcggaacaaaccacgcagccggttgttacttcctgtggcaatgtcgtggttgttcccacatcgcaggaacaaccaccgtttgatttaaatcacatgggtactggcagtgataagtcggatgcgctcggcgtgccctattataatcaacacgctatgtag

SEQ ID NO: 3188 - protein, 72 aa, Escherichia coli
MKPLLSAIATALILFSAQGVAEQTTQPVVTSCGNVVVVPTSQEQPPFDLNHMGTGSDKSDALGVPYYNQHAM

SEQ ID NO: 3189 - DNA, 384 bp, Escherichia coli
atgtccagacgcaatactgacgctattaccattcatagcattttggactggatcgaggacaacctggaatcgccactgtcactggagaaagtgtcagagcgttcgggttactccaaatggcacctgcaacggatgtttaaaaaagaaaccggtcattcattaggccaatacatccgtagccgtaagatgacggaaatcgcgcaaaagctgaaggaaagtaacgagccgatactctatctggcggaacgatatggcttcgagtcccaacaaactctgacccgaaccttcaaaaattactttgatgttccgccgcataaataccggatgaccaatatgcagggtgaatcgcgctttttacatccattaaatcattacaacaactag

SEQ ID NO: 3190 - protein, 127 aa, Escherichia coli
MSRRNTDAITIHSILDWIEDNLESPLSLEKVSERSGYSKWHLQRMFKKETGHSLGQYIRSRKMTEIAQKLKESNEPILYLAERYGFESQQTLTRTFKNYFDVPPHKYRMTNMQGESRFLHPLNHYNN

SEQ ID NO: 3191 - DNA, 435 bp, Escherichia coli
gtgaaaaataccagcgatctgttcaatgaaattattccattgggtcgcttaatccatatggttaatcagaagaaagatcgcctgcttaacgagtatctgtctccgctggatattaccgcggcacagtttaaggtgctctgctctatccgctgcgcggcgtgtattactccggttgaactgaaaaaagtgttgtcggtcgacctgggggcactgacccgtatgctggatcgcctggtctgtaaaggctgggtggaaaggttgccgaacccgaatgataagcgcggcgtactggtaaaacttaccaccagcggcgcggcaatatgtgaacaatgccatcaattagttggccaggacctgcatcaagaattaacaaaaaacctgacggcggacgaagtggcaacacttgagcatttgcttaagaaagtcctgccgtaa

SEQ ID NO: 3192 - protein, 144 aa, Escherichia coli
MKNTSDLFNEIIPLGRLIHMVNQKKDRLLNEYLSPLDITAAQFKVLCSIRCAACITPVELKKVLSVDLGALTRMLDRLVCKGWVERLPNPNDKRGVLVKLTTSGAAICEQCHQLVGQDLHQELTKNLTADEVATLEHLLKKVLP

SEQ ID NO: 3193 - DNA, 627 bp, Escherichia coli
gtgttactgccgttagctaacccattgacaactgtcgcgttatttcttggcctggcaggcaacatgagcagtgccgaacgtaatcgtcagtcgttgatggcctcggtgtacgtatttgccatcatgatggtggcgtattacgccgggcaactggtgatggatacatttggcatttcgattcccggtctgcgaattgcaggcggcttaatcgtcgcgtttatcggttttcggatgctctttccgcaacagaaagcgattgattcaccggaagcgaaaagcaagtcggaagagctggaagatgaacccagtgccaatattgcttttgtaccactggcaatgccaagtaccgccggtccgggaaccattgcgatgattattagctcggcctccacagtgcgtcagagttcaaccttcgctgattgggtactgatggttgcgccgccgctgatctttttcctggtggcggttattttgtggggaagtctacgcagctctggcgcaattatgcggctggtgggcaaggggggtattgaagcgatctcccgtctgatgggattcctgctggtatgtatgggcgtgcagtttattattaacggcatcctggaaatcattaaaacgtatcattaa

SEQ ID NO: 3194 - protein, 208 aa, Escherichia coli
MLLPLANPLTTVALFLGLAGNMSSAERNRQSLMASVYVFAIMMVAYYAGQLVMDTFGISIPGLRIAGGLIVAFIGFRMLFPQQKAIDSPEAKSKSEELEDEPSANIAFVPLAMPSTAGPGTIAMIISSASTVRQSSTFADWVLMVAPPLIFFLVAVILWGSLRSSGAIMRLVGKGGIEAISRLMGFLLVCMGVQFIINGILEIIKTYH

SEQ ID NO: 3195 - DNA, 1191 bp, Escherichia coli
atgacaacaaacactgtttcccgcaaagtagcgtggctacgggtcgttacgctggcagtcgccgcctttatcttcaataccaccgaatttgtccctgttggcctgctctctgacattgcgcatagttttcacatgcaaaccgctcaggtcggcatcatgttgacaatttatgcatgggtagtggcgctaatgtcattgccttttatgttaatgaccagccaggttgaacgccgcaaattactgatctgcctgtttgtggtgtttattgccagccacgtactgtcgtttttatcgtggagttttaccgttctggtgatcagtcgtattggtgtggcttttgcacatgcgattttctggtctattacggcgtctctggcgatccgtatggctccggccgggaagcgagcacaggcattgagtttaattgccaccggtacagcactggcaatggtattaggtttacctctcgggcgcattgtggggcagtattttggctggcgaatgaccttcttcgcgattggtatcggggcgcttattacccttttgtgcctgattaagttacttcccttgctgcccagtgagcattccggttcattgaaaagcctcccgctattgttccgccgcccggcattgatgagcatttatttgttaactgtggtggttgtcaccgcccattacacggcatacagctatatcgagccttttgtacaaaacattgcgggattcagcgccaactttgccacggcattactgttattactcggtggtgcgggcattattggcagcgtgattttcggtaaactgggtaatcagtatgcgtctgcgttggtgagtacagcgattgcgctattgctggtgtgcctggcgctgctgctacctgcggcgaacagtgaaatacacctcggggtgctgagtattttctgggggatcgcgatgatgatcatcgggcttggtatgcaggttaaagtgctggcgctggcaccagatgccaccgacgtcgcgatggcgctattctccgggatatttaatattggaatcggcgcgggtgcgttggtaggtaatcaggtgagtctgcactggtcaatgtcgatgattggttatgtgggcgcggtgcctgcttttgctgcgttaatatggtcaatcatcatttttcgccgctggccagtgacactcgaagaacagacacaatag

SEQ ID NO: 3196 - protein, 396 aa, Escherichia coli
MTTNTVSRKVAWLRVVTLAVAAFIFNTTEFVPVGLLSDIAHSFHMQTAQVGIMLTIYAWVVALMSLPFMLMTSQVERRKLLICLFVVFIASHVLSFLSWSFTVLVISRIGVAFAHAIFWSITASLAIRMAPAGKRAQALSLIATGTALAMVLGLPLGRIVGQYFGWRMTFFAIGIGALITLLCLIKLLPLLPSEHSGSLKSLPLLFRRPALMSIYLLTVVVVTAHYTAYSYIEPFVQNIAGFSANFATALLLLLGGAGIIGSVIFGKLGNQYASALVSTAIALLLVCLALLLPAANSEIHLGVLSIFWGIAMMIIGLGMQVKVLALAPDATDVAMALFSGIFNIGIGAGALVGNQVSLHWSMSMIGYVGAVPAFAALIWSIIIFRRWPVTLEEQTQ

SEQ ID NO: 3197 - DNA, 882 bp, Escherichia coli
atggatctgacccaactggagatgttcaacgcggttgccgaagctggcagcattacccaggctgcagcaaaagtgcatcgcgtgccgtcgaatctcactacccgtctacgccagctggaaacagaactgggggttgatctgtttattcgcgagaatcagcgtttacgtctctcgcctgccgggcataactttttacgctatagccaacaaattctcacgttagtggatgaagcgcggagcgttgtcgctggcgatgagccgcaaggtttattttctctgggatcgctggaaagcaccgctgcagtgcgcattccggccacgctggcggaatttaaccgtcgttatcccaaaattcagttttcactttccaccggcccttccggcactatgctggaaggtgtgctggagggaaaactgaatgcggcgtttattgatgggcccattaaccatactgccattgacgggataccggtataccgcgaggaactgatgatcgtcacgccacaaggacatgcgccagtaacccgtgccagtcaggtgaatggcagtaacatttatgccttccgcgccaattgttcgtatcgtcgccacttcgaaagctggtttcatgctgacggtgccgctccgggaactattcacgagatggagtcttatcacgggatgttggcctgtgtggtcgcaggagcaggcattgcgcttattccacgctctatgctggaaagtatgccggggcatcaccaggttgaagcgtggccgttagctgagcaatggcgttggttaacaacctggctggtctggcgtcgtggtgcgaaaacgcgtccgcttgaggcatttattcaactgctggatgcgcctgactcggcaaaacagggttaccaatga

SEQ ID NO: 3198 - protein, 293 aa, Escherichia coli
MDLTQLEMFNAVAEAGSITQAAAKVHRVPSNLTTRLRQLETELGVDLFIRENQRLRLSPAGHNFLRYSQQILTLVDEARSVVAGDEPQGLFSLGSLESTAAVRIPATLAEFNRRYPKIQFSLSTGPSGTMLEGVLEGKLNAAFIDGPINHTAIDGIPVYREELMIVTPQGHAPVTRASQVNGSNIYAFRANCSYRRHFESWFHADGAAPGTIHEMESYHGMLACVVAGAGIALIPRSMLESMPGHHQVEAWPLAEQWRWLTTWLVWRRGAKTRPLEAFIQLLDAPDSAKQGYQ

SEQ ID NO: 3199 - DNA, 1389 bp, Escherichia coli
atgaccattactccggcaactcatgcaatttcgataaatcctgccaccggtgaacaactttctgtgctgccgtgggctggtgttgacgatatcgaaaacgcgcttcagctggcggcagcaggctttcgcgactggcgcgagacaaatatagattatcgtgctgaaaaactgcgtgatatcggtaaggctctgcgcgcccgtagcgaagaaatggcgcaaatgatcacccgtgaaatgggcaaaccaatcaaccaggcgcgcgctgaagtggcgaaatcggcgaatttgtgtgactggtatgcagaacatggtccggcaatgctgaaggcagaacctacgctggtggaaaatcagcaggcggttattgagtatcgaccgttggggacgattctggcgattatgccgtggaattttccgttatggcaggtgatgcgtggcgctgttcccatcattcttgctggtaacggctacttacttaaacatgcgccgaatgtgatgggctgtgcacagctcattgcccaggtgtttaaagatgcgggtatcccacaaggcgtatatggctggctgaatgccgacaacgacggtgtcagtctgatgattaaagactcgcgcattgctgctgtcacagtgaccggaagtgttcgtgctggagcggctattggcgcacaggctggagcggcactgaaaaaatgcgtactggaactgggtggttcggatccgtttattgtgcttaacgatgccgatctggaactggcggtgaaagcggcggtagccggacgttatcagaataccggacaggtttgtgcagcggcaaaacgctttatcatcgaagagggaattgcttcggcatttaccgaacgttttgtggcagctgcggcagccttgaaaatgggcgatccccgtgatgaagagaacgctctcggaccaatggctcgttttgatttacgtgatgagctgcatcatcaggtggaaaaaacactggcgcagggtgcgcgtttgttactgggaggggaaaagattgctggggcaggtaactactatccgccaacggttctggcgaatgttaccccagaaatgaccgcgtttcgggaagaaatgtttggccccgttgcggcaatcaccattgcgaaagatgcagaacatgcgctggaactggctaatgatagtgagttcggcctttcagcgaccattttcaccaccgacgaaacacaggccagacagatggcggcacgtctggaatgcggtggggtgtttatcaatggttattgtgccagcgatgcgcgagtcgcctttggtggcgtgaagaagagtggctttgggcgtgagctttcccattttggcttacacgaattctgtaatatccagacggtgtggaaagaccggaactga

SEQ ID NO: 3200 - protein, 462 aa, Escherichia coli
MTITPATHAISINPATGEQLSVLPWAGVDDIENALQLAAAGFRDWRETNIDYRAEKLRDIGKALRARSEEMAQMITREMGKPINQARAEVAKSANLCDWYAEHGPAMLKAEPTLVENQQAVIEYRPLGTILAIMPWNFPLWQVMRGAVPIILAGNGYLLKHAPNVMGCAQLIAQVFKDAGIPQGVYGWLNADNDGVSLMIKDSRIAAVTVTGSVRAGAAIGAQAGAALKKCVLELGGSDPFIVLNDADLELAVKAAVAGRYQNTGQVCAAAKRFIIEEGIASAFTERFVAAAAALKMGDPRDEENALGPMARFDLRDELHHQVEKTLAQGARLLLGGEKIAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRN

SEQ ID NO: 3201 - DNA, 915 bp, Escherichia coli
atggataatgcaattttagaaaacatcttgcggcaagtgcggccgctcattggtcagggtaaagtcgcggattatattccggcgctggctacggtagacggttcccgattggggattgctatctgtaccgttgacggacagctttttcaggccggagacgcgcaagaacgtttttccattcagtctatttccaaagtgctgagtctcgttgtcgccatgcgtcattactccgaagaggaaatctggcaacgcgtcggcaaagatccgtctggatcaccgttcaattctttagtgcaactggaaatggagcagggtattccgcgtaatccgtttattaatgccggtgcgctggtggtctgcgatatgttgcaagggcgattaagcgctcctcggcaacgtatgctggaagtcgtgcgcggcttaagtggtgtgtctgatatttcctacgatacggtggtagcgcgttccgaatttgaacattccgcgcgaaatgcggctatcgcatggctgatgaagtcgtttggcaatttccatcatgacgtgacaaccgttctgcaaaactactttcattactgcgctctgaaaatgagctgtgtagagctggcccggacgtttgtctttctggcgaatcaggggaaagctattcatattgatgaacctgtggtgacgccaatgcaggcgcggcaaattaacgcgctgatggcgaccagcggtatgtaccagaacgcgggggagtttgcctggcgggtgggactaccggcaaaatctggcgttggtggcggtattgtggcgattgttccgcatgaaatggccatcgctgtctggagtccggaactggatgatgccggtaactcgcttgcgggcattgcagtccttgaacaattgacgaaacaattagggcgttcagtttattaa

SEQ ID NO: 3202 - protein, 304 aa, Escherichia coli
MDNAILENILRQVRPLIGQGKVADYIPALATVDGSRLGIAICTVDGQLFQAGDAQERFSIQSISKVLSLVVAMRHYSEEEIWQRVGKDPSGSPFNSLVQLEMEQGIPRNPFINAGALVVCDMLQGRLSAPRQRMLEVVRGLSGVSDISYDTVVARSEFEHSARNAAIAWLMKSFGNFHHDVTTVLQNYFHYCALKMSCVELARTFVFLANQGKAIHIDEPVVTPMQARQINALMATSGMYQNAGEFAWRVGLPAKSGVGGGIVAIVPHEMAIAVWSPELDDAGNSLAGIAVLEQLTKQLGRSVY

SEQ ID NO: 3203 - DNA, 360 bp, Escherichia coli
atgcagtctctcgatccactcttcgcgcgtttatcccgttcaaaatttcgctctcgctttcgtttgggtgtgaaagagcgtcagtattgtctggagaaaggcgcgccagtcattgaacaacatgcggcggattttgtcgctaaacgtcttgctccggcattaccggctaacgacggtaagcaaacccccatgcgcgggcatccggtttttatcgctcaacacgccaccgcgacctgttgtcgcggttgtctggctaagtggcataacattcctcagggggaagcgttaagtgaggagcaacaacgttatattgtgacggtaatctaccactggctggttatacagatgaatcagccatga

SEQ ID NO: 3204 - protein, 119 aa, Escherichia coli
MQSLDPLFARLSRSKFRSRFRLGVKERQYCLEKGAPVIEQHAADFVAKRLAPALPANDGKQTPMRGHPVFIAQHATATCCRGCLAKWHNIPQGEALSEEQQRYIVTVIYHWLVIQMNQP

SEQ ID NO: 3205 - DNA, 1419 bp, Escherichia coli
atgcatgtacagcccatttcaactttccgtttgttccaggaaggtcatctgctacgtaatagcatcgctatttttgtgctaaccacgctgttctattttattggtgcagagttacgactggttcacgaactttctcttttctggccgctgaatggcgtaatggcgggggtgtttgcccgctatgtctggcttaatcgactgcattactatgcgatcagttatgtggcgatgctggtttatgatgccataaccaccgaatgggggctggtttcactggctatcaatttctccaatatgatgtttattgttaccgtcgccttactggtcgcgcgggataagagtctgggaaaaaataagtatgagccagtaagtgccttacggctatttaattactgtctgcttgccgcattattatgcgctattgtcggggcgattggttcggtcagtattgatagtctggatttctggcctttgcttgccgactggtttagtgagcaattctcaacgggcgtgttgatcgtgccttgtatgctgacgttggcaattcctggagtgctgccgcgctttaaagcagagcagatgatgcctgctatcgcgcttattgtgtcggttattgcctcggtagtcattggtggagcggggagtctggcgtttccgctccctgcattaatctggtgtgcagtgcgctatacgccgcaggtaacatgtctgttgacctttgtcaccggtgcggtggaagtcgtactggtggcaaattcggtgattgatatctcggtcggttcgccgttctctattccgcaaatgttctccgcacgtctcggtattgccacgatggcgatatgcccaattatggtttcctttagcgtggcagcgatccattcgctaatgaagcaagttgcgctgcgagccgactttgattttctgactcaggtttactcacggtctggtctttatgaggcgctgaaaagtccatcgctgaaacagacacaacatctgacggtcatgctgcttgatatcgactatttcaaaagcattaacgataactatggacatgaatgtggcgataaagtgttaagcgtgtttgcccagcatattcagaagattgtcggtgataaggggctggtggcgcgaatgggcggcgaagaatttgctgttgcagtgccgtcggtgaatcctgtcgatggcctgctaatggcggaaaaaatccgtaaaggcgtagaacttcaaccgttcacctggcaacaaaaaacgctttatctcacggtaagtattggcgtcggtagtggttgcgcatcgtaccgaacgctgaccgatgactttaataaattgatggtcgaagccgatacgtgtctgtatcgctcgaagaaagatgggcgcaaccgtaccagcactatgcgttacggtgaggaagttgtctga

SEQ ID NO: 3206 - protein, 472 aa, Escherichia coli
MHVQPISTFRLFQEGHLLRNSIAIFVLTTLFYFIGAELRLVHELSLFWPLNGVMAGVFARYVWLNRLHYYAISYVAMLVYDAITTEWGLVSLAINFSNMMFIVTVALLVARDKSLGKNKYEPVSALRLFNYCLLAALLCAIVGAIGSVSIDSLDFWPLLADWFSEQFSTGVLIVPCMLTLAIPGVLPRFKAEQMMPAIALIVSVIASVVIGGAGSLAFPLPALIWCAVRYTPQVTCLLTFVTGAVEVVLVANSVIDISVGSPFSIPQMFSARLGIATMAICPIMVSFSVAAIHSLMKQVALRADFDFLTQVYSRSGLYEALKSPSLKQTQHLTVMLLDIDYFKSINDNYGHECGDKVLSVFAQHIQKIVGDKGLVARMGGEEFAVAVPSVNPVDGLLMAEKIRKGVELQPFTWQQKTLYLTVSIGVGSGCASYRTLTDDFNKLMVEADTCLYRSKKDGRNRTSTMRYGEEVV

SEQ ID NO: 3207 - DNA, 1452 bp, Escherichia coli
gtgaaaacactaaatcgtcgcgattttcccggtgcacagtatccagaacgtatcattcagtttggtgaaggtaacttcctgcgcgcctttgttgactggcaaatcgatctcctgaatgagcacaccgatctgaattctggcgtggtcgttgttcgtccgattgaaacttcattcccgccgtcactgagcacgcaggatggtctttataccaccattatccgtggcctgaatgagaagggtgaagcggtcagcgacgcgcgcctgattcgctcggttaatcgtgaaatcagcgtctacagtgaatacgatgaattcctgaaactggctcacaatccggaaatgcgctttgttttctctaacaccaccgaagcgggtatcagctaccatgcgggcgataaattcgatgacgcgccagcggtaagttatccggcaaaactgacccgtctgctgttcgaacgttttagccatttcaacggtgcgctggataaaggttggatcatcatcccgtgtgagttgattgactataatggcgacgcgttgcgtgaactggtgctgcgctatgcgcaagagtgggcactgccagaagcatttattcaatggctggatcaggctaacagcttctgttctacgctggtggaccgtatcgttaccggttatccgcgtgatgaagtggctaaactggaagaagaactgggctaccacgatggtttcctcgacaccgctgaacacttttacctgtttgtgattcaggggccgaaatccttagcgactgaacttcgtctggacaaatatccgctcaacgtgctgatcgttgacgatattaaaccgtataaagaacgcaaagtggcaatcctcaacggtgcgcacaccgcgctggtgccggtggcgttccaggcagggctggataccgtaggtgaagcgatgaacgatgctgaaatttgcgcattcgttgaaaaagccatctacgaagaaattattccggtactggatttgccacgcgatgagctggagtctttcgccagtgcagtcaccggacgtttccgtaacccgtacatcaagcatcaactgctgtctatcgcgctcaacggtatgaccaagttccgcacacgcatcctgccgcagctgctggcagggcagaaggcaaacggcacacttccggcgcgccttactttcgcattagcggcattgattgcgttctatcgcggtgagcgtaatggagaaacatatccggtacaggacgatgcacactggctggaacgttatcagcaactctggagccagtatcgtgaccgtgttatcgggacccaggaactggtagcgattgtgttggcagaaaaagaccactgggagcaggacctgacgcaagtgcctggtctggtcgagcaggttgctaatgacctggatgcgattctcgaaaaagggatgcgcgaagctgtacgcccgttgtgctaa

SEQ ID NO: 3208 - protein, 483 aa, Escherichia coli
MKTLNRRDFPGAQYPERIIQFGEGNFLRAFVDWQIDLLNEHTDLNSGVVVVRPIETSFPPSLSTQDGLYTTIIRGLNEKGEAVSDARLIRSVNREISVYSEYDEFLKLAHNPEMRFVFSNTTEAGISYHAGDKFDDAPAVSYPAKLTRLLFERFSHFNGALDKGWIIIPCELIDYNGDALRELVLRYAQEWALPEAFIQWLDQANSFCSTLVDRIVTGYPRDEVAKLEEELGYHDGFLDTAEHFYLFVIQGPKSLATELRLDKYPLNVLIVDDIKPYKERKVAILNGAHTALVPVAFQAGLDTVGEAMNDAEICAFVEKAIYEEIIPVLDLPRDELESFASAVTGRFRNPYIKHQLLSIALNGMTKFRTRILPQLLAGQKANGTLPARLTFALAALIAFYRGERNGETYPVQDDAHWLERYQQLWSQYRDRVIGTQELVAIVLAEKDHWEQDLTQVPGLVEQVANDLDAILEKGMREAVRPLC

SEQ ID NO: 3209 - DNA, 966 bp, Escherichia coli
gtgatcgtaatcacgtttaatagggcgacttttccacgcctgaagataaccatgattgttcgtccacaacaacactggctgcgccgtatttttgtctggcacggttcagtattatccaagatatcctcgcgcttactactcaattttctcttttctatcgctgttattttcatgctgccctggtacacgcatttgggcattaaattcaccctcgcaccgttcagcattctcggtgtcgccatcgccatttttcttggttttcgtaataatgccgggtacgcccgttacgttgaagcgcgaaaactttgggggcagttgatgattgcctcacggtcgttactgcgcgaggtaaaaacgacattgccagattcggcaagtgtaagggagtttgcccggctgcaaatcgccttcgctcactgtttacgcatgacattacgcaaacaaccacaggcggaagtgctggctcaatatctcaagacggaagatcttcagcgtgtactggcttcgaactctccagctaaccgtatcttgttaataatgggggagtggttggcggttcagcgccgcaatgggcagctttcagatatcctgtttattagcctcaacgatcggcttaatgatatttcagcagttctggcaggctgcgagcgcattgcctacacgccaattccctttgcctacaccctgattttgcatcgtaccgtttatctgttttgtatcatgctgccgttcgcgctggtcgtggatctgcattacatgacgccttttatctctgtgctgatttcctacacttttatttcgctggattgtctggcggaagaactggaagatcccttcggtactgaaaacaatgatttaccgctggatgccatctgcaacgctattgaaattgacctgttacagatgaacgatgaagcagaaattccagcgaaaattcttcccgatcgccattaccagctgacgtga

SEQ ID NO: 3210 - protein, 321 aa, Escherichia coli
MIVITFNRATFPRLKITMIVRPQQHWLRRIFVWHGSVLSKISSRLLLNFLFSIAVIFMLPWYTHLGIKFTLAPFSILGVAIAIFLGFRNNAGYARYVEARKLWGQLMIASRSLLREVKTTLPDSASVREFARLQIAFAHCLRMTLRKQPQAEVLAQYLKTEDLQRVLASNSPANRILLIMGEWLAVQRRNGQLSDILFISLNDRLNDISAVLAGCERIAYTPIPFAYTLILHRTVYLFCIMLPFALVVDLHYMTPFISVLISYTFISLDCLAEELEDPFGTENNDLPLDAICNAIEIDLLQMNDEAEIPAKILPDRHYQLT

SEQ ID NO: 3211 - DNA, 759 bp, Escherichia coli
atgtctgactggaacccctctttatatctacactttgccgctgaacgatcgcgtccggcggtggagctgcttgccagggtgtcgctggagaatatcgaatacattgccgatcttggctgtggcccaggtaacagcaccgcccttctacaccaacgttggcctgctgccaggataacgggcatcgactcatctccggcgatgattgctgaagcgcgcagtgctttgccagactgcctgtttgtggaagcagatatccgcaactggcaaccggaacaggcactcgatctgatttttgctaatgcctcgctgcaatggctgcccgaccactacgaattgtttcctcatttggtttcgttactcagtccgctgggcgtgctggcagtacagatgccagataactggctggagccgacccatgtgctcatgcgcgaagttgcctgggaacaaaactacccggatcgcgggcgtgagccgctggctggcgttcatgcttactacgatattctgagtgaagccggatgtgaggtcgatatctggcgaaccacttactatcaccagatgccgtcgcaccaggcgattatcgattgggtgaccgccactggattacgtccgtggttacaggatctgaccgagagcgaacagcagcattttcttacgcgctaccatcagatgctggaagagcaatatcccctccaggagaacggacagatattgctggcatttccgcgtctgtttattgttgcccgccgtacggagtaa

SEQ ID NO: 3212 - protein, 252 aa, Escherichia coli
MSDWNPSLYLHFAAERSRPAVELLARVSLENIEYIADLGCGPGNSTALLHQRWPAARITGIDSSPAMIAEARSALPDCLFVEADIRNWQPEQALDLIFANASLQWLPDHYELFPHLVSLLSPLGVLAVQMPDNWLEPTHVLMREVAWEQNYPDRGREPLAGVHAYYDILSEAGCEVDIWRTTYYHQMPSHQAIIDWVTATGLRPWLQDLTESEQQHFLTRYHQMLEEQYPLQENGQILLAFPRLFIVARRTE

SEQ ID NO: 3213 - DNA, 285 bp, Escherichia coli
ttgctgtggacgtatgacatgatgagctttcagaagatctatagcccaatgcaattggcgaatgcaatgaaactggttcgccagcaaaacggctggacgcagagcgagttggcgaaaaaaatcggcattaagcaggcgacaatttccaatttcgaaaacaatcctaacaatacctcgctcacgacattttttaagattttacagtcgcttgaactctcaatgacgctatgcgacgcaaaaaatgcctcgccagaagcaacagaacagcaagatctggagtggtga

SEQ ID NO: 3214 - protein, 94 aa, Escherichia coli
MLWTYDMMSFQKIYSPMQLANAMKLVRQQNGWTQSELAKKIGIKQATISNFENNPNNTSLTTFFKILQSLELSMTLCDAKNASPEATEQQDLEW

SEQ ID NO: 3215 - DNA, 1323 bp, Escherichia coli
atgcctaaactagtcacttggatgaacaaccagcgggtaggcgagttaacgaagttagccaacggcgcgcacacctttaagtatgcacctgagtggttagccagccgttatgccagaccgttgtcactttcgctgccattgcagaggaggaatatcacctctgatgccgtatttaacttcttcgataacctgttacccgatagcccgattgtacgtgaccggatcgttaaacgttatcatgctaaatccagacaaccgtttgatttattgtcagaaatagggcgagacagcgttggtgccgtgacgttaatccccgaagatgaaaccgtaatgtgtccgataatggcatgggaaaagcttactgaagccagacttgaagaagtattaacggcttataaagcagatatcccgttaggcatgattagagaagaaaatgactttcgcatctcggttgctggcgcacaggagaagactgcgctgctcagaataggcaatgactggtgcattccgaagggaataacgccaacgacgcacattatcaaattgccgattggcgaaatcagacagcccaatgcgacgctcgatcttagccaaagcgttgataatgagtattactgtttgctgctggcgaaagaactcgggttgaatgttccggacgcagaaatcattaaagcgggaagggtgcgcgcgttagcggtcaaacgttttgacaggcgttggaatactgagcgaacggttttacttcgcttgccacaggaggatatgtgccagacattcggtttaccttcatcggtgaaatatgaatcagatggaggccccggtatcgcgcaaattatggcttttttgatggggtccagcgaggcgctgaaagatcgctatgattttatgaagtttcaggtcttccagtggttgattggcgcaacagatggccatgcaaaaaacttctccgtatttattcaggctggcggcagttatcggctcacaccattttatgacatcatttcggcatttccggtccttggcggtacgggaatacacatcagcgatctcaaactggcaatggggcttaacgcatccaaaggcaaaaaaacggcaatcgataaaatttatccgcgacattttctggcgacagcaaaggtgctgaaattcccggaagtgcagatgcatgaaatcctgagtgactttgccagaatgattccggcagcactggataacgtgaagacttcattaccgacagattttccggagaacgtggtgacggcagttgaaaccaatgtgttgaggttgcacggtcggttaagccgagaatacggtattaagtaa

SEQ ID NO: 3216 - protein, 440 aa, Escherichia coli
MPKLVTWMNNQRVGELTKLANGAHTFKYAPEWLASRYARPLSLSLPLQRRNITSDAVFNFFDNLLPDSPIVRDRIVKRYHAKSRQPFDLLSEIGRDSVGAVTLIPEDETVMCPIMAWEKLTEARLEEVLTAYKADIPLGMIREENDFRISVAGAQEKTALLRIGNDWCIPKGITPTTHIIKLPIGEIRQPNATLDLSQSVDNEYYCLLLAKELGLNVPDAEIIKAGRVRALAVKRFDRRWNTERTVLLRLPQEDMCQTFGLPSSVKYESDGGPGIAQIMAFLMGSSEALKDRYDFMKFQVFQWLIGATDGHAKNFSVFIQAGGSYRLTPFYDIISAFPVLGGTGIHISDLKLAMGLNASKGKKTAIDKIYPRHFLATAKVLKFPEVQMHEILSDFARMIPAALDNVKTSLPTDFPENVVTAVETNVLRLHGRLSREYGIK

SEQ ID NO: 3217 - DNA, 258 bp, Escherichia coli
atgcgctttgaagggaatgcttctacaaggaaatctattcaacaacgtcttaagcaggcttcagatgcacgagctcaggaagtcgccggtagcgaagtgctttactccggtgatgccaacctgactgatgaacagatcgctaaattaccttttgcgttatatcgccagggctacgagtactactggaaaacccacgcacacccaaacatattcagaagcgtgagggatatagtgccatcaaagcgctggctgctgtaa

SEQ ID NO: 3218 - protein, 85 aa, Escherichia coli
MRFEGNASTRKSIQQRLKQASDARAQEVAGSEVLYSGDANLTDEQIAKLPFALYRQGYEYYWKTHAHPNIFRSVRDIVPSKRWLL

SEQ ID NO: 3219 - DNA, 783 bp, Escherichia coli
atgagaatactcgttgctggcgcaacaggaagtattggtattcatgttgtgaatactgctattgcaatgggccatcagcccgtgactctggtcaggaatcggcggaaaatcaagttactccctcgtggaacagatattttctatggcgatgtttcaatacctgaaacacttaccgatttaccgaaagatattgatgccatcatttttacactcggctctgatggtcagggacgtattggcgccagagcaatagattacggcggtgtacgtaacattttgcgaatattcatggatacacctgttcgcatcgccctgatgacaacgattggcgtaactgagcggctcagtagctggaatcaacgtactgaagttcatgactggaagagacgctctgaacgcctggtcagagccagtgggcatatctacactatcgtcagacccggctggtttgattacaacaatgatgatgagcacagaatcgtcatgcttcagggggacagacgccatgcgggaacgccggaagatggtgttatctcccgggagcaaatcgcccaggttcttgtaacagctctgagcaacgatgcggcaaaaaataaaacgttcgaactggtcgcagagcgaggagaagcacagcaggatctcactcctctgtttgcagagctgcggaatgataatccacaaaaaaatgatggggttttcgatatagacaatatgccccttactgaagaacctgagtgcgttattaacgacctgaatctgtattcgaaaaattcaaaaatctaa

SEQ ID NO: 3220 - protein, 260 aa, Escherichia coli
MRILVAGATGSIGIHVVNTAIAMGHQPVTLVRNRRKIKLLPRGTDIFYGDVSIPETLTDLPKDIDAIIFTLGSDGQGRIGARAIDYGGVRNILRIFMDTPVRIALMTTIGVTERLSSWNQRTEVHDWKRRSERLVRASGHIYTIVRPGWFDYNNDDEHRIVMLQGDRRHAGTPEDGVISREQIAQVLVTALSNDAAKNKTFELVAERGEAQQDLTPLFAELRNDNPQKNDGVFDIDNMPLTEEPECVINDLNLYSKNSKI

SEQ ID NO: 3221 - DNA, 612 bp, Escherichia coli
ttgttaactctctttattcagctacttaaatataaattttggagaattatgaaactcaaacatgtcggtattattgtcgtttctgtgttggcgatgtcgtctgctgcggtaagcgcagccgagggtgatgaatcagtaacgaccactgttaatggcggtgtaattcattttaaaggtgaagtggtaaatgccgcttgtgcgattgattcagaatcaatgaaccaaacggttgagctgggtcaggttcgttcttctcgcctggctaaagcgggtgacctcagctccgccgttggcttcaatatcaagctgaatgattgtgataccaatgtttccagtaatgcagctgttgcattcctgggtactactgtcaccagtaatgacgatacattagcgctgcagagttcagcggcaggctctgcccaaaatgtcggtatccaaattttggaccgtacaggggaggtattagtacttgatggtgctacttttagcgctaaaactgacttgattgatggcacgaatatactgccgttccaggctcgttatattgctctcgggcagtcagtagctggtactgcaaacgctgatgcgaccttcaaagttcaatatctataa

SEQ ID NO: 3222 - protein, 203 aa, Escherichia coli
MLTLFIQLLKYKFWRIMKLKHVGIIVVSVLAMSSAAVSAAEGDESVTTTVNGGVIHFKGEVVNAACAIDSESMNQTVELGQVRSSRLAKAGDLSSAVGFNIKLNDCDTNVSSNAAVAFLGTTVTSNDDTLALQSSAAGSAQNVGIQILDRTGEVLVLDGATFSAKTDLIDGTNILPFQARYIALGQSVAGTANADATFKVQYL

SEQ ID NO: 3223 - DNA, 711 bp, Escherichia coli
atgcaaactacgcgtaccccctactctgtttcctttatggcgacagtgttacttttattgctctttgcttgccatagcaccattgccaacgcagctgtcgcacttggtgcgacgcgggtaatttatccggcaaaccagaaacaggttttattgcctgtcacgaataatgatcctgccagtgtctatctcattcagtcatggatagaaaatgcgggtgaccagaaagatacccagtttgtcattaccccaccgcttttttccatgcaaggtaaaaaagagaatacgcttcggataatcaacgccactaatcatcagttaccaggcgaccgtgaaagcctgttctgggttaatgttaaagctatccctgctatggaaaaagaccagaagaatgagaatacattacagctggcaattattagccgcataaaaatgttttatcgccccacgcatctggcaatggcacctgaagaagcgcctgcaatgcttcggtttcgtcgcagcggtagcaaactcactcttattaatccaacgccctacttcattaccgtaacaaatatgaaagcaggaaatagcaatctcccaaacaccatggtgccgccaaaaggtgaagtatcggtggatatcccgcatgctgtaaccggggatatcagttttcagacaatcaatgattacggtgcattaactccgcgtattaaggcaaccatgcagtaa

SEQ ID NO: 3224 - protein, 236 aa, Escherichia coli
MQTTRTPYSVSFMATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTHLAMAPEEAPAMLRFRRSGSKLTLINPTPYFITVTNMKAGNSNLPNTMVPPKGEVSVDIPHAVTGDISFQTINDYGALTPRIKATMQ

SEQ ID NO: 3225 - DNA, 2652 bp, Escherichia coli
atgacagcctttcgtgccgcatttaaggcatatcgtatgcatcaggtgttaatactgcctcgctttgcacggcttacctttgcccttggcttagcaactgcggtttttcccgttgacgcagagtattattttaatccacggtttttaagcaatgaccttgctgaatctgtcgatttatctgcctttactaagggacgcgaggccccacctggtacatatcgggtcgacatttatttgaacgacgaatttatggctagtcgggatattacttttattgcagatgataataacgcagatctcatcccatgcctgagtacagaccttcttgtcagtcttggcataaaaaaatcagcattattagacaacaaggaacattcggcagataaacatgtgccggacaacagcgcatgcacaccacttcaggatcgtttggctgatgcatcatctgagtttgatgttggtcagcaacatctgtcactctccgttccgcaaatatatgtcggcagaatggctcacggctatgtttctcctgatctgtgggaagaaggaataaatgcagggctactaaactatagttttaatggtaattctattaataaccgtagtaaccataatgcaggaaaatccaactatgcatatttgaatttacagagtggcatcaacattggtagttggcgactgcgcgataactcaacgtggagttataacagtgggagtagcaattcatctgacagcaataaatggcagcatatcaatacgtcggctgaacgtgacattattccgttacgctcacggttaacagtgggtgatagttataccgatggcgatatttttgacagtgtgaactttcgtggccttaaaataaattcaacagaagcgatgttgcccgatagccaacatggtttcgctccggtgattcatggtattgctcgtggcaccgcacaagtgagtgtaaaacagaatggatacgatgtttatcagactactgtcccacccggcccttttactattgatgatatcaactctgcggccaatggtggtaatctgcaagtaaccataaaagaggcagacggcagtattcagacattatatgttccttattcgtctgttccggttctccaacgtgctggatatacgcgttatgcacttgccatgggggaatatcgtagtggaaataacctgcaaagcacccccaagttcgtacaagcaagcttgatgcatggtctgaaaggaaactggacaccttatggcggaatgcaaattgcagaagattatcaggccttcaaccttggtattggtaaagatttaggactttttggtgccttttctttcgatattacgcaggccaatacgacacttgcagatgacacccgtcacagcggacaatcggttaaatccgtctacagcaaatccttctaccagacgggaaccaatatccaggtcgcaggatatcgctattctacgcaaggtttttataacttatccgacagtgcatacagtcgaatgagtggttacaccgtcaagcctcctaccggagacaccagtgagcagacactatttattgattattttaatctgttctacagtaagcgtggtcaggaacaaataagcatctctcagcagcttggaaattatggtacgacatttttcagtgccagtcgccaaagttactggaacacgtcacgcagcgaccagcaaatatcatttggattaaatgtgccgtttggtgatattacgacttcgctgaattacagctattccaataatatatggcaaaacgatcgggatcatttactcgcttttacgcttaatgttccctttagtcattggatgcgtacagacagtcagtcggcatttcataattcaaacgccagttacagtatgtcaaacgatttgaaaggcggcatgaccaacctatcaggggtttatggcactctgctaccggataataacctgaattatagtgttcaggtcggtaacacccaagggggtaatacatcgtctggcaccagtggttacagttctcttaattatcgtggtgcttacggtaatacgaatgtcggttacagtcggagtggtgacagcagccagatttattacggaatgagtggtgggattattgctcatgctgatggcatcacctttggacagccgctgggcgacacaatggttctggttaaggctcctggcgctgataatgtcaaaatagagaaccagaccggaattcataccgactggcgtggctatgccatattaccatttgcgacagaatatagagaaaatcgtgtcgctcttaacgcgaattcccttgcagataatgttgaactggatgaaaccgtagtcactgtcatcccaactcacggtgctattgccagagcaacatttaatgcacaaatcggcgggaaagtattaatgacgttgaagtacggtaataaaagcgttccattcggtgcaattgtcactcacggagagaataaaaatggcagcattgtcgcggaaaatggtcaggtttatctgactggacttccacagtcagggaaattacaggtttcatggggcaaagataaaaactcaaactgtattgtcgattacaagcttcctgtagtctctcctggaaccttgctgaaccagcagacagcaatctgtcgctaa

SEQ ID NO: 3226 - protein, 883 aa, Escherichia coli
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMAHGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGNLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTQGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVDYKLPVVSPGTLLNQQTAICR

SEQ ID NO: 3227 - DNA, 504 bp, Escherichia coli
atgaaaagacttcacaagaggttcctgttagctacgttttgcacattattcacagcaactctccaggccgccgatgtcactatcactgttaatggtcgggtagtcgctaaaccatgcactattcaaaccaaagaagctaacgttaatctcggggatctttatacacgcaatctgcaacaacctggttctgcatctggctggcacaatattactttgtcattaaccgattgtccgattgaaacaagtgcagtgacggcaatcgtgacaggttcaactgacaatacgggttattacaaaaatgaaggtactgccgaaaatattcagatagagctaagggatgaccaggatgcgacgttaaaaaatggcgatagcaaaacggttattgttgatgtgatcactcgtaatgcacagtttccacttaaggcaagagctatcacggtgaatggaaacgcaagccagggtacgatcgaggcgctaatcaatgtgatctatacctggcaataa

SEQ ID NO: 3228 - protein, 167 aa, Escherichia coli
MKRLHKRFLLATFCTLFTATLQAADVTITVNGRVVAKPCTIQTKEANVNLGDLYTRNLQQPGSASGWHNITLSLTDCPIETSAVTAIVTGSTDNTGYYKNEGTAENIQIELRDDQDATLKNGDSKTVIVDVITRNAQFPLKARAITVNGNASQGTIEALINVIYTWQ

SEQ ID NO: 3229 - DNA, 849 bp, Escherichia coli
ttgccttcagttgtaatgtcgatggcgggtcaagtattgggagcaggtacaacctctgtttatgttaatctcgatcctgtaatacaaccgggccagaatctggttgtagacttgtctcagcatataagttgttggaatgattacggcggctggtacgacactgatcatataaacctggtacaaggttcagctttcgcaggctccctacagtcatataaaggatcactgtactggaataatgtgacctaccctttcccgttgacgacaaataccaacgtattggatattggtgataagacaccgatgccattaccgttaaaactctatattaccccagtcggagcggccggtggagttgtcataaaagcaggggaagttattgcccgtattcatatgtataaaattgccacgttaggaagcggaaatccgcgtaattttacgtggaatattatttcaaataacagtgttgttatgccaacaggcggttgcaccgttgatagtcgtaatgtcaccgtgaatctcccggactttcctggaagcgcagaaataccccttggtgtatattgctctagcgaacaaaagctctcattttatctttcgggtgccaccactgacagtgcccgacaagtgtttgctaacgcagcaccagatgcaacaaaagcatcgggcgtgggtgtctctctgatacgtaatggaaaaatactggcaaccggagaaaatgtctccctggggacagtaaataaaagcaaagtacctctgggtttaagcgcaacctatggacaaacaggaaacaaggttgcagccggagccgtccagtcagtcattggtgtcacttttatctatgaataa

SEQ ID NO: 3230 - protein, 282 aa, Escherichia coli
MPSVVMSMAGQVLGAGTTSVYVNLDPVIQPGQNLVVDLSQHISCWNDYGGWYDTDHINLVQGSAFAGSLQSYKGSLYWNNVTYPFPLTTNTNVLDIGDKTPMPLPLKLYITPVGAAGGVVIKAGEVIARIHMYKIATLGSGNPRNFTWNIISNNSVVMPTGGCTVDSRNVTVNLPDFPGSAEIPLGVYCSSEQKLSFYLSGATTDSARQVFANAAPDATKASGVGVSLIRNGKILATGENVSLGTVNKSKVPLGLSATYGQTGNKVAAGAVQSVIGVTFIYE

SEQ ID NO: 3231 - DNA, 2280 bp, Escherichia coli
atgaagaaaaaaattgaatcctaccagggagctgccggtggttggggtgctgttaaatccgtagcgaatgcagtacgtaagcagatggatatacgccaggatgttattgccatgtttgacatgaataagccagagggctttgactgtccgggatgtgcatggccagatcctaagcacagtgcgtcattcgacatttgtgaaaacggcgcaaaagcaatcgcctgggaagtcacggataagcaggtaaatgcctctttctttgctgagaatacggttcaatcattacttacctggggagatcacgagcttgaggctgcgggacgtctcactcagcctttgaaatatgatgacgtcagcgactgttacaagccattaagctggcaacaagctttcgacgaaattggcgctcgccttcaaagctatagtgatcccaatcaggttgaattctatacttcggggcgcacttccaatgaagctgcctttctttatcagctttttgcccgtgaatacgggagcaataactttcccgactgctccaacatgtgccatgaaccgaccagtgtgggattggcagcgagtatcggtgtgggtaaagggaccgtgttgctggaagactttgagaaatgcgatttagtcatttgcattgggcataaccctggtacaaaccaccctcgcatgctgacttcgttgcgcgctttagtgaaacggggagcgaaaatgatcgccatcaatcctctacaggaacgtggcctggagcgatttaccgcaccgcaaaacccgtttgaaatgctgacgaactctgagactcagttggccagtgcctactataacgtgcgcattggtggcgatatggcattgctcaaggggatgatgcgcctgttaattgagcgcgatgatgctgcaagcgccgcaggtcggccctcattgctggatgacgaatttattcaaacgcataccgtcggctttgacgagctacgccgtgacgtgctcaattccgagtggaaagatatcgaacgtatttctggactaagtcagacacaaatcgccgaacttgctgatgcatatgccgctgccgaacgaaccattatctgttacggaatggggatcactcagcacgaacatggtacccagaacgtacagcaactggtcaatctgctgttgatgaaaggtaacattggcaagcctggtgcgggtatctgcccactacgaggtcactctaatgtacagggcgaccgaaccgtcggtatcaccgagaaaccgtctgcagagtttctggatcgcctgtgtgagcgctatggcttcaccccacctcatgcacctggacatgctgcaatcgccagcatgcaagctatatgtacggggcaagctcgagcattgatctgcatggggggcaactttgcactggcaatgccagatcgggaagcgagcgctgtaccgttaacgcaattagatctggcggtacacgtagccactaagcttaaccgctctcatctgctgaccgcacggcatagctatattctgccggttctgggacgtagcgagattgacatgcaaaaaagcggtgcgcaggcggtaaccgttgaagattcaatgtcgatgattcatgcctcgcgtggtgtgttaaaacccgccggtgtaatgctgaaatcagagtgtgcagtggtcgcgggaatcgcgcaagcagcactaccccagagcgtggtagcctgggagtatctggtggaagattatgatcgcattcgcaatgacattgaagctgtgctgccagagtttgccgactataaccagcgcatccgtcatcctggtggttttcacctgataaacgcagcagctgaaaggcgctggatgacgtcgtcaggtaaggctaatttcattaccagtaaagggctgttagaagatccctcttcagcgtttaacagtaagctggtcatggcgacagtacgcagtcacgatcagtacaacacgacgatttatggtatggatgatcgctatcgaggggtattcggtcaacgagatgtggtctttatgagtgctaaacaagctaaaatttgccgtgtaaaaaacggcgaaagagttaatcttattgcactcacgccagacggtaaacgtagctcacgccgcatggatagattaaaagtggtcatttaccctatggctgaccgctcactggtgacctattttccagaatcgaatcacatgctaacacttgataaccacgatccattaagtggcattcctggctataaaagtattccggttgaattagaaccatcaaattaa

SEQ ID NO: 3232 - protein, 759 aa, Escherichia coli
MKKKIESYQGAAGGWGAVKSVANAVRKQMDIRQDVIAMFDMNKPEGFDCPGCAWPDPKHSASFDICENGAKAIAWEVTDKQVNASFFAENTVQSLLTWGDHELEAAGRLTQPLKYDDVSDCYKPLSWQQAFDEIGARLQSYSDPNQVEFYTSGRTSNEAAFLYQLFAREYGSNNFPDCSNMCHEPTSVGLAASIGVGKGTVLLEDFEKCDLVICIGHNPGTNHPRMLTSLRALVKRGAKMIAINPLQERGLERFTAPQNPFEMLTNSETQLASAYYNVRIGGDMALLKGMMRLLIERDDAASAAGRPSLLDDEFIQTHTVGFDELRRDVLNSEWKDIERISGLSQTQIAELADAYAAAERTIICYGMGITQHEHGTQNVQQLVNLLLMKGNIGKPGAGICPLRGHSNVQGDRTVGITEKPSAEFLDRLCERYGFTPPHAPGHAAIASMQAICTGQARALICMGGNFALAMPDREASAVPLTQLDLAVHVATKLNRSHLLTARHSYILPVLGRSEIDMQKSGAQAVTVEDSMSMIHASRGVLKPAGVMLKSECAVVAGIAQAALPQSVVAWEYLVEDYDRIRNDIEAVLPEFADYNQRIRHPGGFHLINAAAERRWMTSSGKANFITSKGLLEDPSSAFNSKLVMATVRSHDQYNTTIYGMDDRYRGVFGQRDVVFMSAKQAKICRVKNGERVNLIALTPDGKRSSRRMDRLKVVIYPMADRSLVTYFPESNHMLTLDNHDPLSGIPGYKSIPVELEPSN

SEQ ID NO: 3233 - DNA, 762 bp, Escherichia coli
atgtcgctcgtttgttctattatatttattcatcatgccttcaacgctaacattttagataaagattacgccttctctgacggcgagatcctaatggtagataacgctgttcgtacgcattttgaaccttatgagcggcatttcaaagaaatcggatttaatgaaaataccattaaaaaatatctacaatgcactaacatccagacagtgacgatgcctgttcctgcgaagtttttacgtgcttcaaatgtaccgactggattgcttaatgaaatgattgcttatctcaactcggaagaacgcaatcatcataatttttcagagcttttgcttttttcttgcctgtctatttttgccgcatgcaaaggtttcattacactattaactaacggtgtgctatccgtttccgggaaagtgagaaatattgtcaacatgaagctggcgcacccatggaagctgaaagatatttgtgactgcctgtacatcagtgaaagcctgttgaagaaaaaactaaagcaagagcaaacgacattctcacagattcttttagatgccagaatgcagcacgcaaaaaatttgatacgcgtagaaggttcagtcaataaaattgccgaacaatgtggttatgcgagtacatcttattttatttatgcgttccgcaaacatttcggcaacagtccaaagagagtttctaaggagtaccgttgtcaaaggcacacgggtatgaacacggacaacacgatgaatgctttagctatttga

SEQ ID NO: 3234 - protein, 253 aa, Escherichia coli
MSLVCSIIFIHHAFNANILDKDYAFSDGEILMVDNAVRTHFEPYERHFKEIGFNENTIKKYLQCTNIQTVTMPVPAKFLRASNVPTGLLNEMIAYLNSEERNHHNFSELLLFSCLSIFAACKGFITLLTNGVLSVSGKVRNIVNMKLAHPWKLKDICDCLYISESLLKKKLKQEQTTFSQILLDARMQHAKNLIRVEGSVNKIAEQCGYASTSYFIYAFRKHFGNSPKRVSKEYRCQRHTGMNTDNTMNALAI

SEQ ID NO: 3235 - DNA, 1683 bp, Escherichia coli
atgaagtctgcattaaagaaaagtgtcgtaagtacctcgatatctttgatactggcatctggtatggctgcatttgctgctcatgcggcagatgatgtaaagctgaaagcaaccaaaacaaacgttgctttctcagactttacgccgactgaatacagtaccaaaggaaagccaaatattatcgtactgaccatggatgatcttggttatggacaacttccttttgataagggatcttttgacccaaaaacaatggaaaatcgtgaagttgtcgatacctacaaaatagggatagataaagccattgaagctgcgcaaaaatcaacgccgacgctcctttcattaatggatgaaggcgtacgttttactaacggctatgtggcgcacggtgtttccggcccgtcccgcgccgcaataatgaccggtcgagcgcccgcccgctttggtgtctattccaatactgatgctcaggatggtattccgctaacagaaactttcttgcctgaattattccagaatcatggttattacactgcagcagtaggtaaatggcacttgtcaaaaatcagtaatgtgccagtgccggaagataaacaaacgcgtgactatcatgacaacttcactaccttttctgcggaagaatggcaaccgcaaaaccgtggctttgattactttatgggattccatgctgcgggaacggcatattacaactccccttcactgttcaaaaaccgtgaacgcgtccccgcaaaaggttatatcagcgatcagttaaccgatgaggcaattggcgttgttgatcgtgccaaaacacttgaccagccttttatgctttacctggcttataatgctccgcatctgccaaatgataatcctgctccggagcaatatcagaagcaatttaataccggcagtcaaacagcagataattactacgcttccgtttattctgttgatcagggtgtaaaacgcattctcgaacaactgaagaaaaacggacagtatgacaatacaattattctctttacctccgataatggtgcagttatcgatggtcctctgccgctgaacggggcgcaaaaaggctataagagtcagacctatcctggcggtactcacaccccaatgtttatgtggtggaaaggaaaacttcaacccggtaattatgacaagctgatttccgcaatggatttctacccgacagctcttgatgcagccgatatcagcattccaaaagaccttaagctggatggcgtttccttgctgccctggttgcaaaataagaaacagggcgagccacataaaaatctgacctggataacatcttattctcactggtttgatgaggaaaacattccattctgggataattaccacaaatttgtccgccatcagtcagacgattacccgcataaccccaacaccgaggacttaagccaattctcttatacggtgagaaataacgattattcgctcgtctatacagtagaaaataatcagttaggtctatacaaactgacggatctacagcaaaaagataaccttgccgccgccaatccgcaggtcgttaaagagatgcaaggcgtggtaagagagtttatcgataacagccagccaccgcttagcgaggtaaatcaggagaagtttaacaatatcaagaaagcattaagcgaagcgaaataa

SEQ ID NO: 3236 - protein, 560 aa, Escherichia coli
MKSALKKSVVSTSISLILASGMAAFAAHAADDVKLKATKTNVAFSDFTPTEYSTKGKPNIIVLTMDDLGYGQLPFDKGSFDPKTMENREVVDTYKIGIDKAIEAAQKSTPTLLSLMDEGVRFTNGYVAHGVSGPSRAAIMTGRAPARFGVYSNTDAQDGIPLTETFLPELFQNHGYYTAAVGKWHLSKISNVPVPEDKQTRDYHDNFTTFSAEEWQPQNRGFDYFMGFHAAGTAYYNSPSLFKNRERVPAKGYISDQLTDEAIGVVDRAKTLDQPFMLYLAYNAPHLPNDNPAPEQYQKQFNTGSQTADNYYASVYSVDQGVKRILEQLKKNGQYDNTIILFTSDNGAVIDGPLPLNGAQKGYKSQTYPGGTHTPMFMWWKGKLQPGNYDKLISAMDFYPTALDAADISIPKDLKLDGVSLLPWLQNKKQGEPHKNLTWITSYSHWFDEENIPFWDNYHKFVRHQSDDYPHNPNTEDLSQFSYTVRNNDYSLVYTVENNQLGLYKLTDLQQKDNLAAANPQVVKEMQGVVREFIDNSQPPLSEVNQEKFNNIKKALSEAK

SEQ ID NO: 3237 - DNA, 1158 bp, Escherichia coli
atgcacgttacagccaagccctccagttttcaatgtaatctcaaatgtgattactgtttttaccttgaaaaagagtcgcagtttactcatgaaaaatggatggatgacagcactctgaaagagttcatcaaacaatatatcgcagcgtctggcaatcaggtctattttacttggcaaggcggtgaacccactctggctggcctggattttttccgtaaagttattcactatcaacaacgctatgcaggccaaaaacgaatttttaatgcattacaaacgaatggcattttattgaataatgaatggtgtgcctttctcaaagaacatgagtttctggttggtatctcgatcgatggaccccaagaactacatgactgctacagacgcagtaattcaggtaacggtacttttgcaaaagtgatagcagccatcgagcgtctgaaatcatatcaaatagagtttaatacgttaaccgtcattaataacattaatgtccattaccctcttgaggtttatcattttttaaaatctatcggcagtaaacatatgcaatttatcgaattgctcgaaaccgggacgccgaatattgatttcagtggtcatagtgagaacacattccgtatcattgatttttctgtgcctcccacggcttatggcaagtttatgtcaaccatttttatgcaatgggttaaaaacgatgtgggtgaaattttcatccgtcagtttgaaagctttgtcagccgttttttggggaatgggcataccagttgtattttccaggagtcctgcaaggataatctggttgttgaaagcaatggagacatttacgaatgcgaccattttgtctatccacagtacaaaattggaaacattaataaatcggaactcaaaacgatgaacagtgtacaactgacagcgcaaaaaaaacggatttcagcgaaatgtcagcaatgtgtatataaacctatctgcaatggtggttgccctaagcatcgtattactaaagtaaacaatgagactgtttcctatttttgcgaaggttataaaatccttttttcaaccatggtaccttatatgaacgccatggtagagttagctaagaacagagtaccgctttaccacattatggatgttgcaaaacaaatggagaataattaa

SEQ ID NO: 3238 - protein, 385 aa, Escherichia coli
MHVTAKPSSFQCNLKCDYCFYLEKESQFTHEKWMDDSTLKEFIKQYIAASGNQVYFTWQGGEPTLAGLDFFRKVIHYQQRYAGQKRIFNALQTNGILLNNEWCAFLKEHEFLVGISIDGPQELHDCYRRSNSGNGTFAKVIAAIERLKSYQIEFNTLTVINNINVHYPLEVYHFLKSIGSKHMQFIELLETGTPNIDFSGHSENTFRIIDFSVPPTAYGKFMSTIFMQWVKNDVGEIFIRQFESFVSRFLGNGHTSCIFQESCKDNLVVESNGDIYECDHFVYPQYKIGNINKSELKTMNSVQLTAQKKRISAKCQQCVYKPICNGGCPKHRITKVNNETVSYFCEGYKILFSTMVPYMNAMVELAKNRVPLYHIMDVAKQMENN

SEQ ID NO: 3239 - DNA, 1686 bp, Escherichia coli
atgataaccattcccattacgttttgtatgttgatagcaaagtatctctgtctgctgaagcccttttggctgcgtaagaataataaaacttcagtgttgttaatcattattatcctcgccatgatccttggcgtggttaaaattcaggtctggttaaacgactggaataatgattttttcaatgcgctaagccagaaagaaactgataagctttggcagcttgtcctttggttccctgccctgctggggatctttgtattaatatccgtaaacaaaacatggttaattaaactactgactattcgctggcgcgaatggttaacagattactaccttaatcgctggtttgcagataaaaactactacttcacgcagatctacggcgagcataaaaatacagataaccctgaccaacgtatcgctgaagacattctcttactgatcagcaaaacgctcagcctttcatttggcttcatccagtcacttagcatgctgatcacctttaccgttattctttggcaaagcgcgggtacgctctcattcactgttggtggaactgaatggagtatccaggggtatatggtctataccgtcgtgctcattgtgatcggtggaactttatttacccataaggttggtaaacgtattcgtccacttaatgtggaaaaacaacgtagcgaagcgacatttcgaactaatcttgtgcagcataataagcaggcagaactgattgcgctaagcaatgctgagtctctacaacgccaggagttgagcgaaaattttcataccattaaagagaactggcatcgtttaatgaatcgtcagcggtggcttgattactggcagaatatttattcgcgctcgcttagcgttcttccctactttctgttattgccgcagtttattagcgggcagatcaatctgggcggactgatgaaatcgcgccaggcatttatgctggtatcgaacaatttaagctggtttatttataaatatgatgaacttgctgaactggctgcggttatcgatcgcttgtatgagttccatcaactcaccgaacagcgccctacgaataagcctaaaaattgtcaacatgcggtacaagtggctgacgcgagtattcgtactcctgataataagatcatattagagaacctgaactttcatgtttcgccaggcaaatggctattgctgaaaggttactctggtgcgggaaaaaccacactgcttaaaacattatcccactgctggccgtggtttaaaggtgatatttcttctcctgctgacagttggtatgtgtcacaaacaccgttaatcaaaaccggcttactgaaagagattatttgtaaagcacttcccctgtccgtagacgataaatcgttgagcgaagtactgcatcaggttggtctggggaaattggctgcgcgtattcatgatcacgatcgctggggagatattctttccagcggcgaaaaacaacgtatcgccctggctcgattaattttacgacgtccgaaatggatatttcttgacgaaactacctctcatcttgaggaacaagaggcaatccgcttactgcgtttagtgcgagaaaaactccccacaagcggcgtcattatggttacacatcaacccggtgtctggaacctggtcgatgatatttgtgacattagcgcggttatataa

SEQ ID NO: 3240 - protein, 561 aa, Escherichia coli
MITIPITFCMLIAKYLCLLKPFWLRKNNKTSVLLIIIILAMILGVVKIQVWLNDWNNDFFNALSQKETDKLWQLVLWFPALLGIFVLISVNKTWLIKLLTIRWREWLTDYYLNRWFADKNYYFTQIYGEHKNTDNPDQRIAEDILLLISKTLSLSFGFIQSLSMLITFTVILWQSAGTLSFTVGGTEWSIQGYMVYTVVLIVIGGTLFTHKVGKRIRPLNVEKQRSEATFRTNLVQHNKQAELIALSNAESLQRQELSENFHTIKENWHRLMNRQRWLDYWQNIYSRSLSVLPYFLLLPQFISGQINLGGLMKSRQAFMLVSNNLSWFIYKYDELAELAAVIDRLYEFHQLTEQRPTNKPKNCQHAVQVADASIRTPDNKIILENLNFHVSPGKWLLLKGYSGAGKTTLLKTLSHCWPWFKGDISSPADSWYVSQTPLIKTGLLKEIICKALPLSVDDKSLSEVLHQVGLGKLAARIHDHDRWGDILSSGEKQRIALARLILRRPKWIFLDETTSHLEEQEAIRLLRLVREKLPTSGVIMVTHQPGVWNLVDDICDISAVI

SEQ ID NO: 3241 - DNA, 660 bp, Escherichia coli
atgaagcgagttcttattcctggcgtcattttatgtggcgctgatgtggcgcaggccgtcgatgacaaaaatatgtacatgcatgtttttgaagagatgacggtctatgctcctgtccctgtacccgtaaacggcaacacgcattacaccagtgaaagcatcgagcgtttaccgaccgggaatggcaatatcagcgatctgctgagaaccaaccctgcggtacgcatggattcaacgcaaagtacctcattgaaccagggagatattcgcccggagaaaatctctattcacggtgcgtcgccctaccagaatgcctatttgattgacggtattagtgcaacgaataacctgaacccagcgaatgagtccgatgccagtagtgcaaccaatattagcgggatgtcacaggggtattatcttgatgtcagcttactggacaatgtgacgctttatgacagttttgtgccagttgaattcggtcgcttcaatggcggggtaattgatgcaaagatcaaacgcttcaacgctgatgatagcagcgtgaaactgggttatcgcactacgcgttcggactggttaacatcgcatatcgatgagaataacaagagcgcatttaatcaaggttcttcaggaagtacttattactctcccagattttaa

SEQ ID NO: 3242 - protein, 219 aa, Escherichia coli
MKRVLIPGVILCGADVAQAVDDKNMYMHVFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSSVKLGYRTTRSDWLTSHIDENNKSAFNQGSSGSTYYSPRF

SEQ ID NO: 3243 - DNA, 1698 bp, Escherichia coli
ttgtcgtttaatcaggaactcgctgataactttggcgttaccgctggtttatcgcgccgccagtctgatatcacccgcgcggattatgtttcgaatgacggcattgtcgccggcagggcacagtataaaaacgttatcgatactgcattgagcaaatttacctggtttgccagcgaccgctttacccacgatttaaccttaaaatataccggctccagccgtgattataataccagcaccttcccggagtctgatcgcgaaatgggtaataaatcctatggtctggcatgggatatggatacccagctcgcatgggccaaactgcgtaccaccgttggttgggatcatattagtgattatacccgtcacgatcatgacatctggtacaccgaactttcatgtacatatggtgatatttcagggcgttgcacccgtggcggattaggacacatttcccaggctgtagataattacaccttcaaaacacgcctggactggcaaaaattcgccgtgggtaatgtttcgcatcaaccctacttcggcgcggaatacatctattccgatgcatggactgaacgccataaccagtctgaatcctatgtgattaatgctgccggaaagaaaactaaccatacaatttaccataaaggtaaaggtagtctgggaattgacaattacacgctgtatatggcggatcgcattagctggcgtaatgtgtcgttaatgcccggcgtgcggtatgactatgataactatctgtcaaaccacaatatctccccgcgctttatgacggaatgggatatttttgctgatcaaacctcaatgattactgcaggttataaccgttactatggcgggaatattcttgatatgggattacgtgatatccgcaatagctggacggaatcggtatcaggcaataaaaccctgacgcgttatcaggatttgaaaacgccttataacgatgaactggcaatgggattgcagcagaaaatcggtaagaacgttattgcgcgtgcaaactatgtttaccgtgaagcgcatgatcaaatcagcaaaagcagtcgtaccgacagcgcgactaaaaccaccattactgaatataacaacgatggcaaaaccaaaacacattcgtttaacctcagttttgaactggccgaacccctgcatatcagccaggtagatattaacccgcaaattgtctttagctatatcaagagcaagggcaacttgtcgttaaacaatggttatgaggagagcaataccggtgataaccgggtggtttataacggtaatctggtctcttacgatagcgttccagtggcggattttaataatccattaaagatctccttaaacatggatttcacgcatcaaccgagcgggttggtgtgggcgaatacgctgacctggcaagaagcgcgtaaagctcgcattatcctgggtaagacgaatgcgcaatacatcagcgaatattcagattacaagcagtatgttgacgagaaactggatagcagcctgacctgggacacccgcttgtcctggacgccacaatttctgaaacaacaaaacctgacgatcagtgccgatattctcaatgtactggatagcaaaaccgctgttgatacaacgaatactggcgtggcgacctacgccagtggccgtactttctggcttgatgtcagcatgaaattttaa

SEQ ID NO: 3244 - protein, 565 aa, Escherichia coli
MSFNQELADNFGVTAGLSRRQSDITRADYVSNDGIVAGRAQYKNVIDTALSKFTWFASDRFTHDLTLKYTGSSRDYNTSTFPESDREMGNKSYGLAWDMDTQLAWAKLRTTVGWDHISDYTRHDHDIWYTELSCTYGDISGRCTRGGLGHISQAVDNYTFKTRLDWQKFAVGNVSHQPYFGAEYIYSDAWTERHNQSESYVINAAGKKTNHTIYHKGKGSLGIDNYTLYMADRISWRNVSLMPGVRYDYDNYLSNHNISPRFMTEWDIFADQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSFNLSFELAEPLHISQVDINPQIVFSYIKSKGNLSLNNGYEESNTGDNRVVYNGNLVSYDSVPVADFNNPLKISLNMDFTHQPSGLVWANTLTWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 3245 - DNA, 2784 bp, Escherichia coli
atgagaaacctctgtttcttactgacgttagtggcaactctgttgctccccgggcgactgattgccgccgccttaccgcaggatgaaaagttaattaccgggcaactggacaatggcttgcgatatatgatttatccgcatgctcaaccaaaggatcaggtaaatttatggctgcaaattcataccggttcattgcaggaagaagacaatgagcgcggcgtggctcattttgtagaacatatgatgtttaacggcacaaaaacatggccgggtaataaagtcatcgaaacatttgagtcaatgggcctgcgttttggtcgcgatgttaatgcctataccagctatgacgaaacagtgtatcaggtgagtttgccgactacgcagaaacaaaatctgcaacaagtgatggcaatcttcagtgaatggagtaatgccgcaacctttgaaaaactcgaagtagacgctgaacgcggcgtaattactgaggaatggcgtgcccatcaggatgcgaaatggcgcacctctcaggcgcgccgccctttcctgctggcaaatacccgtaatttagaccgtgaacctatcggcctgatggataccgtcgccacggtcacaccggcacaattgcgccaattttatcaacgctggtatcaaccaaataatatgacctttattgtggtcggcgatatcgacagtaaagaagcgctggcgctgataaaggataatttaagtaagcttccggctaacaaagcagctgaaaatcgcgtctggccgacaaaagccgaaaaccacctgcgctttaatatcatcaatgataaagaaaaccgggtgaacggcatcgcactctattatcgcctgccaatggtacaagtgaacgatgagcaaagctttatcgaacaagctgaatggagcatgttggttcagctgttcaaccaacgtctgcaggaacgcatacagtcgggcgagttgaagactatttctggcggcactgcgcgcagcgtcaaaattgcacccgattatcagtcgctatttttccgtgtaaatgcacgagacgataatatgcaggatgctgcgaatgcattaatggcagagttggcaaccattgatcagcatggtttttctgctgaagaactcgatgatgttaaatctacccgccttacctggctgaaaaatgcggttgatcagcaagctgagcgtgatttacgtatgctgaccagtcgcctagcatccagctcattaaataatacgccgttcttgtcgccggaagagacatatcaactttcgaaacgtctgtggcagcaaattaccgtgcaaagtctggcggaaaaatggcagcagttaagaaagaaccaggacgcattttgggagcaaatggtaaacaatgaagttgccgccaaaaaagcattgtctcctgcggctatcctggcgctggaaaaagagtacgccaataaaaagctggcagcttacatcttcccaggcagaaatttatcgttaacagtagacgctgacccacaggcggaaattagcagcaaagaaacgctggctgagaatctgacatcattaacactttccaatggtgccagggttattctggcaaaatccgcgggtgaagagcaaaagctacaaattactgccgtatctaataaaggcgatttaagtttccctgcgcagcaaaaatcacttatcgcgctggcaaataaagcagtaagcggaagcggcgttggtgaactctcctcttccagcctgaaacgctggagtgcggaaaactcggtaaccatgagcagtaaagtcagtggcatgaatacattgctctccgttagcgcgcggactaataaccctgaacctggtttccagttgattaaccagcgaatcaaccacagcacgattaacgacaatatttgggcatcgctacaaaatgctcaaattcaggcgttgaaaacgctcgaccagcgtccagcggagaaattcgcccagcagatgtatgagacgcgctatgccgatggccgcacgaaattaccgcaagaaaatcagattgcacagtttactgccgcagatgcgctggctgccgatcgccagttgttttcatctccagcggatatcacgtttgtcattgtcggtaatgtcgcagaagacaaactcgtggcgttaattacgcgttacttaggatcaatcaaacactctgattcgccattagccgcaggtaaaccattaactcgcgcgacggacaacgcatcggttactgtaaaagaacaaaatgaaccagtggcacaggtttcacagtggaagcgttataattcccggactcctgttaatctggcgacgcgtatggcgctcgatgcttttaacgtcgcactggcaaaagatctacgcattaatattcgtgaacaggcatctggagcatacagcgtttcttctcgcctctcggttgatcctcaggccaaagatatcagtcatttgctggcttttacttgtcaaccagaacgacatgatgaactgttaacgttagcgaatgaagtgatggttaagcgtctggccaaagggattagtgagcaagaactgaacgaataccagcaaaacgttcagcgcagcctcgatatccaacagcgtagcgttcaacaattagcgaataccattgtaaatagtcttattcaatatgacgatcctgcagcatggactgagcaggagcaattgttgaaacaaatgacggtagagaatgttaacactgctgttaaacaatatctttctcatccggtgaatacctataccggagtattattgccaaaataa

SEQ ID NO: 3246 - protein, 927 aa, Escherichia coli
MRNLCFLLTLVATLLLPGRLIAAALPQDEKLITGQLDNGLRYMIYPHAQPKDQVNLWLQIHTGSLQEEDNERGVAHFVEHMMFNGTKTWPGNKVIETFESMGLRFGRDVNAYTSYDETVYQVSLPTTQKQNLQQVMAIFSEWSNAATFEKLEVDAERGVITEEWRAHQDAKWRTSQARRPFLLANTRNLDREPIGLMDTVATVTPAQLRQFYQRWYQPNNMTFIVVGDIDSKEALALIKDNLSKLPANKAAENRVWPTKAENHLRFNIINDKENRVNGIALYYRLPMVQVNDEQSFIEQAEWSMLVQLFNQRLQERIQSGELKTISGGTARSVKIAPDYQSLFFRVNARDDNMQDAANALMAELATIDQHGFSAEELDDVKSTRLTWLKNAVDQQAERDLRMLTSRLASSSLNNTPFLSPEETYQLSKRLWQQITVQSLAEKWQQLRKNQDAFWEQMVNNEVAAKKALSPAAILALEKEYANKKLAAYIFPGRNLSLTVDADPQAEISSKETLAENLTSLTLSNGARVILAKSAGEEQKLQITAVSNKGDLSFPAQQKSLIALANKAVSGSGVGELSSSSLKRWSAENSVTMSSKVSGMNTLLSVSARTNNPEPGFQLINQRINHSTINDNIWASLQNAQIQALKTLDQRPAEKFAQQMYETRYADGRTKLPQENQIAQFTAADALAADRQLFSSPADITFVIVGNVAEDKLVALITRYLGSIKHSDSPLAAGKPLTRATDNASVTVKEQNEPVAQVSQWKRYNSRTPVNLATRMALDAFNVALAKDLRINIREQASGAYSVSSRLSVDPQAKDISHLLAFTCQPERHDELLTLANEVMVKRLAKGISEQELNEYQQNVQRSLDIQQRSVQQLANTIVNSLIQYDDPAAWTEQEQLLKQMTVENVNTAVKQYLSHPVNTYTGVLLPK

SEQ ID NO: 3247 - DNA, 1401 bp, Escherichia coli
atggataagaagcaagtaacggatttaaggtcggaactactcgattcacgttttggtgcgaagtctatttccactatcgcagaatcaaaacgttttccgctgcacgaaatgcgtgatgatgtcgcattccagattatcaatgatgaattatatcttgatggcaacgctcgtcagaacctggccactttctgccagacctgggacgacgataatgtccataagttgatggatttatccattaacaaaaactggatcgacaaagaagaatatccgcaatctgcagcaatcgatctgcgttgcgtaaacatggttgccgatctgtggcatgcgcctgcaccgaaaaatggtcaggccgttggcaccaacaccattggttcttccgaggcctgtatgctcggcgggatggcgatgaaatggcgttggcgcaagcgtatggaagctgcaggtaagccgactaacaaaccgaacctggtgtgcggtccggtacaaatctgctggcataaattcgcccgctactgggatgtggagttgcgtgagatccctatgcgccccggtcagttgtttatggacccgaaacgcatgattgaagcctgcgacgaaaacaccatcggcgtggtgccgactttcggcgtgacctacaccggtaactatgagttcccgcagccgctgcacgatgcgctggataaataccaggccgacaccggtatcgacatcgacatgcacatcgacgccgccagcggtggcttcctggcaccgttcgtcgccccggatatcgtctgggacttccgcctgccgcgtgtgaaatcgatcagtgcttcaggccataaattcggtctggctccgctgggctgcggctgggttatctggcgtgatgaagaagcgctgccgcaggaactggtgttcaacgttgactacctcggcggtcagattggtactttcgccatcaacttctcccgcccggcgggtcaggtgattgcacagtactatgaattcctgcgcctcggtcgtgaaggctataccaaagtacagaacgcttcctaccaggttgctgcttatctggcggatgaaatcgccaaactggggccgtatgagttcatctgtaccggtcgcccggacgaaggcatcccggcggtttgcttcaaactgaaagatggtgaagatccgggatacaccctgtatgacctctctgaacgtctgcgtctgcgcggctggcaggttccggccttcactctcggcggtgaagccaccgacatcgtggtgatgcgcattatgtgtcgtcgcggcttcgaaatggactttgctgaactgttgctggaagactacaaagcctccctgaaatatctcagcgaccacccgaaactgcagggtattgcccagcagaacagctttaaacacacctga

SEQ ID NO: 3248 - protein, 466 aa, Escherichia coli
MDKKQVTDLRSELLDSRFGAKSISTIAESKRFPLHEMRDDVAFQIINDELYLDGNARQNLATFCQTWDDDNVHKLMDLSINKNWIDKEEYPQSAAIDLRCVNMVADLWHAPAPKNGQAVGTNTIGSSEACMLGGMAMKWRWRKRMEAAGKPTNKPNLVCGPVQICWHKFARYWDVELREIPMRPGQLFMDPKRMIEACDENTIGVVPTFGVTYTGNYEFPQPLHDALDKYQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 3249 - DNA, 1536 bp, Escherichia coli
atggctacatcagtacagacaggtaaagctaagcagctcacattactcggattttttgccataacggcatcgatggtaatggctgtttatgaataccctaccttcgcaacatcgggcttttcattagtcttcttcctgctattaggcgggattttatggtttattcccgtgggactttgtgctgcggaaatggctaccgtcgacggctgggaagaaggtggcgtcttcgcctgggtatcaaatactctggggccgagatggggatttgcagcgatctcatttggctatctgcaaatcgccattggttttattccgatgctctatttcgtgttaggggcactctcctacatcctgaaatggccagcgctgaatgaagaccccattaccaaaactattgcagcactcatcattctttgggcgctggcattaacgcagtttggtggcacgaaatacacggcgcgaattgctaaagttggcttcttcgccggtatcctgttacctgcatttattttgatcgcattagcggctatttatctgcactccggtgcccccgttgctatcgaaatggatgcgaagaccttcttccctgacttctctaaagtgggcaccctggttgtatttgttgccttcattttgagttatatgggcgttgaagcttccgcaacccacgtcaatgaaatgagcaaccccgggcgcgactatccactggctatgttactgctgatggtggcggcaatctgcttaagctctgttggcggtttgtctattgcgatggtcattccgggtaatgaaatcaacctctccgcaggggtaatgcaaacctttaccgttctgatgtcacatgtggcaccggaaattgagtggacggttcgcgtgatctccgcactgctgttgctgggtgttctggcggaaatcgcttcctggattgttggtccttctcgcgggatgtatgtcacagcgcagaaaaacctgctgccagcggcattcgctaaaatgaacaaaaatggcgtaccggtaacgctggtcatttcgcagttggtgattacttctatcgcgttgatcatcctcaccaataccggtggcggtaacaacatgtccttcctgatcgcactggcgctgacggtggtgatttatctgtgtgcttatttcatgctgtttattggctacattgtgttggttcttaaacatcctgacttaaaacgcacatttaatatccctggtggtaaaggggtgaaactggtcgtggctattgtcggtctgctgacttcaattatggcgtttattgtttccttcctgccgccggataacatccagggtgactctaccgatatgtatgttgaattactggtcgttagtttcctggtggtacttgccctgccctttattctctatgctgttcatgatcgtaaaagcaaagcgaataccggcgtcactctggagccaatcaacagtcagaacgcaccaaaaggtcacttcttcctgcacccgcgtgcacgttcaccacactatattgtgatgaatgacaagaaacactaa

SEQ ID NO: 3250 - protein, 511 aa, Escherichia coli
MATSVQTGKAKQLTLLGFFAITASMVMAVYEYPTFATSGFSLVFFLLLGGILWFIPVGLCAAEMATVDGWEEGGVFAWVSNTLGPRWGFAAISFGYLQIAIGFIPMLYFVLGALSYILKWPALNEDPITKTIAALIILWALALTQFGGTKYTARIAKVGFFAGILLPAFILIALAAIYLHSGAPVAIEMDAKTFFPDFSKVGTLVVFVAFILSYMGVEASATHVNEMSNPGRDYPLAMLLLMVAAICLSSVGGLSIAMVIPGNEINLSAGVMQTFTVLMSHVAPEIEWTVRVISALLLLGVLAEIASWIVGPSRGMYVTAQKNLLPAAFAKMNKNGVPVTLVISQLVITSIALIILTNTGGGNNMSFLIALALTVVIYLCAYFMLFIGYIVLVLKHPDLKRTFNIPGGKGVKLVVAIVGLLTSIMAFIVSFLPPDNIQGDSTDMYVELLVVSFLVVLALPFILYAVHDRKSKANTGVTLEPINSQNAPKGHFFLHPRARSPHYIVMNDKKH

SEQ ID NO: 3251 - DNA, 1320 bp, Escherichia coli
atggatatctgctcccgaaacgagaaattagcgattagaagaccagcgatactggttgcactggcacttttactgtgtagttgtaaaagcacgcctccagagtccatggtgacaccaccagcgggctcaaagccaccagccacgacgcaacaatcgtcacaaccgatgcgtggcatctggctggccacggtgtctcgcctcgactggccaccggtttcctcggttaacattagtaaccccaccagccgggcacgtgtacaacaacaggcgatgatcgacaaactggatcatctgcaacgtctcggcataaacacggtctttttccaggtcaagccggatggtactgccctgtggccatcgaaaattttgccgtggtccgatcttatgaccggtaagattggtgaaaatccgggttacgatccgctgcaatttatgctcgacgaagcccacaagcgtgggatgaaagtacacgcctggtttaacccctatcgcgtatcggttaatacgaagcccggtactatcagggaactgaatagcactctgtctcaacaaccggcgagcgtctatgtgcaacaccgcgactggatcagaacgtccggcgatcgctttgtcctcgacccgggcatccctgaggttcaggactggatcacatcaatagtcgcggaagtggtttcccgctatccagtagatggcgtgcagtttgatgactatttctatactgagtcaccaggttcacggctaaatgataacgaaacgtaccgcaaatacggcggcgcatttgcgtcaaaagcagactggcggcgcaacaatactcagcagttaattgcgaaggtatcgcacaccattaaaagcattaagccggaagtcgaatttggcgttagcccggcaggcgtgtggcgtaaccgatcacacgatccgctcggttccgatacccgaggtgcggcagcctatgacgaatcctacgctgatacccgtcgatgggtggaacaagggttgctggattacattgctccccaaatttactggccattctcacggagtgccgcgcgttatgacgtgttggcaaaatggtgggcggatgtcgttaaaccgaccaggacccgcctgtatatcggtatcgccttctataaagtgggtgaaccttcaaagatagagccagactggatgattaacggcggcgtaccggaactgaaaaagcagctcgatcttaacgatgctgtgccggaaattagcggcacaatcttgttccgtgaggactatctgaataaaccgcagacgcaacaagcggtcagctatctgcaaagtcgttggggcagttaa

SEQ ID NO: 3252 - protein, 439 aa, Escherichia coli
MDICSRNEKLAIRRPAILVALALLLCSCKSTPPESMVTPPAGSKPPATTQQSSQPMRGIWLATVSRLDWPPVSSVNISNPTSRARVQQQAMIDKLDHLQRLGINTVFFQVKPDGTALWPSKILPWSDLMTGKIGENPGYDPLQFMLDEAHKRGMKVHAWFNPYRVSVNTKPGTIRELNSTLSQQPASVYVQHRDWIRTSGDRFVLDPGIPEVQDWITSIVAEVVSRYPVDGVQFDDYFYTESPGSRLNDNETYRKYGGAFASKADWRRNNTQQLIAKVSHTIKSIKPEVEFGVSPAGVWRNRSHDPLGSDTRGAAAYDESYADTRRWVEQGLLDYIAPQIYWPFSRSAARYDVLAKWWADVVKPTRTRLYIGIAFYKVGEPSKIEPDWMINGGVPELKKQLDLNDAVPEISGTILFREDYLNKPQTQQAVSYLQSRWGS

SEQ ID NO: 3253 - DNA, 219 bp, Escherichia coli
ttgtgtttggttgattttggcctgcggtttaaccataaaggtcgacattattttaaagccgcaaacggcgaggatattgccctctcactttccatcggtgccgccatgtttaatggtcatcctgactatgagcgcctcattcaaatagccgatgaagctctgtatatcgccaaaagacgaggtagaaaccgtgttgaactctgtaaagccagtctttag

SEQ ID NO: 3254 - protein, 72 aa, Escherichia coli
MCLVDFGLRFNHKGRHYFKAANGEDIALSLSIGAAMFNGHPDYERLIQIADEALYIAKRRGRNRVELCKASL

SEQ ID NO: 3255 - DNA, 2424 bp, Escherichia coli
atgcgccaggatgcagaggtaatcatgaagctaaccgatgcggatactgccgccgatggcatttttttccccgcccttgagcaaaatatgatgggcgcggtgttaattaacgaaaatgatgaagtgatgtttttcaaccccgccgcagagaagctctgggggtacaaacgtgaagaagtcattggcaataacattgatatgctgattccgcgggatttgcgtcctgcgcatcctgaatacattcgtcacaaccgtgaaggtggtaaagcgcgcgtcgaggggatgagtcgagagctgcagctggagaaaaaagacggcagtaaagtctggacccgttttgcgctatcgaaagtgagcgccgaggggaaagtttattacctggcgctggtacgggatgccagcgtagaaatggcgcaaaaagaacagacccgacaattgattattgccgttgaccatctcgaccgaccggtgattgtcctcgatccggaacgccatattgtgcagtgcaatcgcgcatttaccgaaatgtttggttactgcattaacgaagccagcggtatgcagcccgatacactcctgaacattccagaattccctgctgataaccgtattcgtttacagcagttgctatggaaaaccgcccgcgatcaggacgaatttctgctgttgacgcgcaccggtgaaaaaatctggattaaagcctctatcagcccggtttatgacgtgctcgcgcatctgcagaacctggtaatgacattctcggatatcaccgaagaaaggcaaatccgccagcttgaaggcaatattctcgccgccatgtgcagcagcccaccatttcatgaaatgggggaaatcatttgtcgtaacatcgaatctgttctcaacgaatcgcatgtttcgctgttcgcgctgcgcaacgggatgccgatacactgggcgtcatcttcgcacggtgcagaagttcaaaatgcgcaaagctggtcagcgaccattcgtcagcgcgatggcgcgcctgcggggatcctgcaaattaaaacctcgtcaggagcagaaaccagcgcctttatcgaacgcgtggcagatatcagccagcatatggccgcgctggcgctggaacaggaaaaaagccgtcagcatattgaacaactcatccaatttgatccgatgaccggtctgccaaatcgcaataacctgcacaattacctcgatgacctggtcgacaaagccgtctctccggtggtgtatctcatcggtgttgaccatattcaggatgtgattgatagccttggctatgcgtgggccgatcaggcattgctggaagtggtcaatcgctttcgtgaaaaactcaaaccggatcagtatctctgtcgtattgaaggtgcgtcttttgtcctcgtgagcctggaaaacgatgtcagtaacattacccagatcgccgatgagctacggaatgtggtcagcaagccgataatgattgacgataaaccattcccgctcaccttgagcattggcatcagctacgacgagggtaaaaaccgcgattacctgctctccactgctcacaatgcaatggattttattcgcaaaaatggcggtaacggctggcagttcttcagcccggcgatgaacgaaatggtaaaagagcgtttggttttaggcgcagcgctaaaagaagcgattagcaataaccaacttaaactggtttatcagccgcaaatcttcgcagaaacgggtgaactgtacggcatcgaagcccttgctcgctggtacgatcctctgcatggtcatgtgcccccttcacggtttattcctctcgcagaagagattggtgaaatcgaaaatattgggcgctgggtcatcgcggaagcttgccgtcagttagcagaatggcgtagccagaatattcatatcccggcgttatccgttaacttgtctgcgctgcactttcgcagtaatcagctgcctaatcaggtatctgatgcaatgcacgcctggggtattgacggccaccagctgacggtggaaatcacggaaagcatgatgatggaacacgataccgaaatctttaagcgcattcagatcctgcgcgatatgggcatcggtttatcggtagatgattttggtacaggcttttccggattatcccgcttagtcagtcttccggtaacggaaatcaaaattgataaaagttttgtcgatcgttgtctgaccgaaaaacgcatccttgccttactcgaagccattaccagcattgggcaaagcctcaatttaaccgtcgtggcggaaggcatcgaaaccaaagagcaatttgagatgctacgcaagatccactgtcgcgttattcagggatatttcttttcccgccccctgcccgccgaagaaattccaggctggatgagcagcgtgttaccgctgaaaatctga

SEQ ID NO: 3256 - protein, 807 aa, Escherichia coli
MRQDAEVIMKLTDADTAADGIFFPALEQNMMGAVLINENDEVMFFNPAAEKLWGYKREEVIGNNIDMLIPRDLRPAHPEYIRHNREGGKARVEGMSRELQLEKKDGSKVWTRFALSKVSAEGKVYYLALVRDASVEMAQKEQTRQLIIAVDHLDRPVIVLDPERHIVQCNRAFTEMFGYCINEASGMQPDTLLNIPEFPADNRIRLQQLLWKTARDQDEFLLLTRTGEKIWIKASISPVYDVLAHLQNLVMTFSDITEERQIRQLEGNILAAMCSSPPFHEMGEIICRNIESVLNESHVSLFALRNGMPIHWASSSHGAEVQNAQSWSATIRQRDGAPAGILQIKTSSGAETSAFIERVADISQHMAALALEQEKSRQHIEQLIQFDPMTGLPNRNNLHNYLDDLVDKAVSPVVYLIGVDHIQDVIDSLGYAWADQALLEVVNRFREKLKPDQYLCRIEGASFVLVSLENDVSNITQIADELRNVVSKPIMIDDKPFPLTLSIGISYDEGKNRDYLLSTAHNAMDFIRKNGGNGWQFFSPAMNEMVKERLVLGAALKEAISNNQLKLVYQPQIFAETGELYGIEALARWYDPLHGHVPPSRFIPLAEEIGEIENIGRWVIAEACRQLAEWRSQNIHIPALSVNLSALHFRSNQLPNQVSDAMHAWGIDGHQLTVEITESMMMEHDTEIFKRIQILRDMGIGLSVDDFGTGFSGLSRLVSLPVTEIKIDKSFVDRCLTEKRILALLEAITSIGQSLNLTVVAEGIETKEQFEMLRKIHCRVIQGYFFSRPLPAEEIPGWMSSVLPLKI

SEQ ID NO: 3257 - DNA, 432 bp, Escherichia coli
atgacaatccataagaaaggtcaggcacactgggaaggcgatatcaaacgcgggaagggaacagtatctactgagagcggcgtgctgaaccaacagccgtatggatttaacacgcgttttgaaggcgaaaaaggaaccaaccctgaagaactgattggcgcagcgcatgccgcatgtttctcaatggcgctttcattaatgctgggggaagcgggattcacgccaacatcgattgataccaccgccgatgtctcgctggatagagtggatgccggttttgcgattactaaaatcgcactgaagagcgaagttgcggtgccgggtattgatgcctccacctttgacggcattatccagaaagcaaaagcaggatgcccggtttctcaggtactgaaagcggaaattacgctggattaccagttgaaatcgtaa

SEQ ID NO: 3258 - protein, 143 aa, Escherichia coli
MTIHKKGQAHWEGDIKRGKGTVSTESGVLNQQPYGFNTRFEGEKGTNPEELIGAAHAACFSMALSLMLGEAGFTPTSIDTTADVSLDRVDAGFAITKIALKSEVAVPGIDASTFDGIIQKAKAGCPVSQVLKAEITLDYQLKS

SEQ ID NO: 3259 - DNA, 147 bp, Escherichia coli
gtgatttccgctacgtttagttggacaacgacaacgcatagccatgtcacaacaatcccttctcagcctgatgtgattgtgctgacgcatcaggcattcacgcgcctgacgcgtcatccggcaacgctttacgatttcaactggtaa

SEQ ID NO: 3260 - protein, 48 aa, Escherichia coli
MISATFSWTTTTHSHVTTIPSQPDVIVLTHQAFTRLTRHPATLYDFNW

SEQ ID NO: 3261 - DNA, 141 bp, Escherichia coli
ttgattgatattgatgcaatatctcttgagttatatatttccggttatctattgtggaaatttaatttaagtgcaggaattatattttcgccggattttattcggattatcctgcttatcctcgtgctgtttctcacgtag

SEQ ID NO: 3262 - protein, 46 aa, Escherichia coli
MIDIDAISLELYISGYLLWKFNLSAGIIFSPDFIRIILLILVLFLT

SEQ ID NO: 3263 - DNA, 279 bp, Escherichia coli
atgtgctttataaatctgcgatccgtagcagacaccataaatacacagacacggagaatcactatgtttacttattatcaggcagaaaattcaacagcagaacccgctctggttaatgccattgagcaaggccttcgggcagagcacggtgttgtcactgaagatgacattctcatggagctgaccaaatgggtggaagcttctgataacgacatcctcagtgatatctaccagcaaacgatcaattatgtggtcagtggtcagcaccctacgctttaa

SEQ ID NO: 3264 - protein, 92 aa, Escherichia coli
MCFINLRSVADTINTQTRRITMFTYYQAENSTAEPALVNAIEQGLRAEHGVVTEDDILMELTKWVEASDNDILSDIYQQTINYVVSGQHPTL

SEQ ID NO: 3265 - DNA, 138 bp, Escherichia coli
atgaaatcgaaccgtcaggcacgtcatattcttggactggaccataaaatttctaaccagcgcaaaatagttaccgaaggtgacaaatccagcgtggtaaataatcccaccggcagaaaacgccccgctgaaaagtaa

SEQ ID NO: 3266 - protein, 45 aa, Escherichia coli
MKSNRQARHILGLDHKISNQRKIVTEGDKSSVVNNPTGRKRPAEK

SEQ ID NO: 3267 - DNA, 123 bp, Escherichia coli
ttgaatatccatccctgggggcttttatcgtctttgcattaccgccagggcgtcggcaccaagtataaagcagataaaaacaaaaacaccattgcgcaggcaatggtgtttaatcgtcattga

SEQ ID NO: 3268 - protein, 40 aa, Escherichia coli
MNIHPWGLLSSLHYRQGVGTKYKADKNKNTIAQAMVFNRH

SEQ ID NO: 3269 - DNA, 1698 bp, Escherichia coli
atggaaccaaaaacaaaaaaacagcgttcgctttatatcccttacgctggccctgtattgctggaatttccgttgttgaataaaggcagcgccttcagcatggaagaacgccgtaacttcaacctgctggggttactgccggaagtggtcgaaaccatcgaagaacaagcggaacgagcatggatccagtatcagggattcaaaaccgaaatcgacaaacacatctacctgcgtaacattcaggacactaacgaaaccctcttctaccgtctggtaaacaatcatcttgatgaaatgatgccagtcatttacaccccaaccgtcggcgcagcctgtgagcgtttttctgagatctaccgccgttcacgcggtgtgtttatctcttaccagaaccgccacaatatggacgatattctgcaaaacgtaccaaaccataatatcaaagtgattgtggtgactgacggcgaacgtattctggggcttggtgaccagggcatcggcgggatgggcattccgatcggtaaactgtcgctctataccgcctgtggcggcatcagtccggcctatacccttccggtggtgctggatgtcggcactaacaaccaacagctacttaacgatccgctgtatatgggctggcgtaatccgcgtatcactgacgacgaatactatgaattcgttgatgaatttatccaggctgtgaaacaacgctggccggacgtactgttgcagtttgaagacttcgcacaaaaaaatgcgatgccgttacttaaccgctatcgcaatgaaatttgttcttttaacgatgacattcagggcaccgcggcggtaacagtcggcacactgatcgcagccagccgcgcggcaggtggtcagttaagcgagaaaaaaatcgtcttccttggcgcaggttcagcgggatgcggcattgccgaaatgatcatcgcccagacccagcgcgaaggattaagcgaggaagcggcgcggcagaaagtctttatggtcgatcgctttggcctgctgaccgacaagatgccgaacctgctgcctttccagaccaaactggtgcagaagcgcgaaaatctcagtgactgggataccgacagcgatgtgctgtcactgctggatgtggtgcgtaatgtaaaaccagatattctgattggcgtctcaggacagaccgggctgtttacggaagagatcatccgtgagatgcataaacactgtccgcgtccgatcgtgatgccgctgtctaacccgacgtcacgcgtggaagccacaccgcaggacattatcgcctggactgaaggtaacgcgctggtcgccactggcagtccgtttaatccagtggtatggaaagataaaatctaccctatagcccagtgcaacaacgcctttattttcccgggcatcgggctgggtgttattgcttccggcgcgtcacgtatcaccgatgagatgctgatgtcggcaagtgaaacgcttgctcagtattcgccgctggtcctgaacggcgaaggtctggtactaccggaactgaaagatattcagaaagtctcccgcgcaattgcctttgcggttggcaaaatggcgcagcagcaaggcgtggcggtgaaaacgtctgccgaagctctgcaacaggccattgatgataatttctggcacgccgaataccgcgactaccgccgtacctccatctaa

SEQ ID NO: 3270 - protein, 565 aa, Escherichia coli
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGLVLPELKDIQKVSRAIAFAVGKMAQQQGVAVKTSAEALQQAIDDNFWHAEYRDYRRTSI

SEQ ID NO: 3271 - DNA, 1011 bp, Escherichia coli
atgaaggctgcagttgttacgaaggatcatcatgttgacgttacggataaaacactgcgctcactgaaacatggcgaagccctgctgaaaatggagtgttgtggtgtatgtcataccgatcttcatgttaagaatggcgattttggtgacaaaaccggcgtgattctgggacacgaaggtattggtgtggtggcagaagttggccctggtgttacttcattaaaaccaggcgatcgtgccagcgtggcgtggttctatgaaggatgcggtcattgcgaatactgtaacagtggtaacgaaacgctctgccgttcagttaaaaatgccggatacagcgttgatggcgggatggcggaagagtgcatcgtggtcgccgattacgcggtaaaagtgccagatggtctggactcggcggcggccagcagcattacctgtgcgggggtcactacctacaaagccgttaagctgtcaaaaattcgtccaggacagtggattgctatctacggtcttggcggtctgggtaacctcgccctgcaatacgcgaagaatgtctttaacgccaaagtgatcgccattgatgtcaatgatgaacagttaaaactggcaaccgaaatgggtgcagatttagcgattaactcacgcaccgaagacgccgccagaattgtgcaggagaaagccggtggcgctcacgcagcggtggtgacagcggtagctaaagctgcgtttaactcggcggtggatgctgtccgtgcaggtggtcgtgtcgtggctgtcggtctgccgccggagtctatgagcctggacatcccacggctggtgctggatggtattgaagtggtcggttcgctggtcggcacgcgtcaggatctaaccgaagccttccagtttgccgccgaaggcaaagtggtgccgaaagtcgccctgcgtccgttagcggacatcaacaccatatttaccgagatggaagaaggcaaaatccgtggccgtatggtgattgatttccgtcgctaa

SEQ ID NO: 3272 - protein, 336 aa, Escherichia coli
MKAAVVTKDHHVDVTDKTLRSLKHGEALLKMECCGVCHTDLHVKNGDFGDKTGVILGHEGIGVVAEVGPGVTSLKPGDRASVAWFYEGCGHCEYCNSGNETLCRSVKNAGYSVDGGMAEECIVVADYAVKVPDGLDSAAASSITCAGVTTYKAVKLSKIRPGQWIAIYGLGGLGNLALQYAKNVFNAKVIAIDVNDEQLKLATEMGADLAINSRTEDAARIVQEKAGGAHAAVVTAVAKAAFNSAVDAVRAGGRVVAVGLPPESMSLDIPRLVLDGIEVVGSLVGTRQDLTEAFQFAAEGKVVPKVALRPLADINTIFTEMEEGKIRGRMVIDFRR

SEQ ID NO: 3273 - DNA, 279 bp, Escherichia coli
atgataatgaatttcagacacaagggattgcgtgacttgtttcttctcggcaaaacctccggcgttataccgacgcaagtcaaacgattacgccaccgactcgctgtgattgatgcagcatgctgtcttgctgatatcgatatgcccggttaccgactacatccgttaagcggcgatcgcgatggaatttgggcgatatctgtctcgggcaactggcgaatcacatttgaattcgtcaatggcgatgcatacatactggattacgaggactatcactga

SEQ ID NO: 3274 - protein, 92 aa, Escherichia coli
MIMNFRHKGLRDLFLLGKTSGVIPTQVKRLRHRLAVIDAACCLADIDMPGYRLHPLSGDRDGIWAISVSGNWRITFEFVNGDAYILDYEDYH

SEQ ID NO: 3275 - DNA, 273 bp, Escherichia coli
atggcgctttataaggtgccatttttttattgcgtaaccagacggcgcagtcgcgacacatccaccgttttttccgcctctgccagactccaggcattttgcagattcagccacatttgcggcgaactgccgatcaccacggaaagttttattgccatttctggcgtcaaagctgcttttccggtcagcaatcggcttgccgttgagggcgcaatttccattgctctggcaaactcgcgcaggctgacattaagttcgtccagtgattcctga

SEQ ID NO: 3276 - protein, 90 aa, Escherichia coli
MALYKVPFFYCVTRRRSRDTSTVFSASARLQAFCRFSHICGELPITTESFIAISGVKAAFPVSNRLAVEGAISIALANSRRLTLSSSSDS

SEQ ID NO: 3277 - DNA, 285 bp, Escherichia coli
atgaaaatggccaatcatccccgcccgggggacattattcaggaatcactggacgaacttaatgtcagcctgcgcgagtttgccagagcaatggaaattgcgccctcaacggcaagccgattgctgaccggaaaagcagctttgacgccagaaatggcaataaaactttccgtggtgatcggcagttcgccgcaaatgtggctgaatctgcaaaatgcctggagtctggcagaggcggaaaaaacggtggatgtgtcgcgactgcgccgtctggttacgcaataa

SEQ ID NO: 3278 - protein, 94 aa, Escherichia coli
MKMANHPRPGDIIQESLDELNVSLREFARAMEIAPSTASRLLTGKAALTPEMAIKLSVVIGSSPQMWLNLQNAWSLAEAEKTVDVSRLRRLVTQ

SEQ ID NO: 3279 - DNA, 654 bp, Escherichia coli
atgagtaagtcgaaaatgattgtgcgcaccaaatttattgatcgcgcctgtcactggaccgtggtgatttgcttcttcctggtggcgctgtccgggatttcgttcttcttcccgacgctgcaatggctgacgcaaaccttcggtacgccgcagatgggacgcattttgcacccgttcttcggcattgcgattttcgtcgcgctgatgtttatgtttgtgcgttttgtgcatcacaacatcccggataagaaagatattccgtggctgttgaacattgtcgaagtattaaaaggcaatgagcacaaagtggcggatgtcggtaagtacaacgccgggcaaaagatgatgttctggtcaatcatgagcatgattttcgtgctgctggtgaccggagtgattatctggcgtccgtactttgcacagtacttcccgatacaggttgtccgttatagcctgctgatccatgcggctgcgggtatcatcctgatccacgccatcctgatccatatgtatatggcattctgggtgaaaggatcgattaaagggatgatcgaagggaaggtgagccgtcgctgggcgaagaaacaccatccgcgctggtatcgagaaatcgagaaggcagaagcgaaaaaagagagtgaagaagggttataa

SEQ ID NO: 3280 - protein, 217 aa, Escherichia coli
MSKSKMIVRTKFIDRACHWTVVICFFLVALSGISFFFPTLQWLTQTFGTPQMGRILHPFFGIAIFVALMFMFVRFVHHNIPDKKDIPWLLNIVEVLKGNEHKVADVGKYNAGQKMMFWSIMSMIFVLLVTGVIIWRPYFAQYFPIQVVRYSLLIHAAAGIILIHAILIHMYMAFWVKGSIKGMIEGKVSRRWAKKHHPRWYREIEKAEAKKESEEGL

SEQ ID NO: 3281 - DNA, 885 bp, Escherichia coli
atggctatggaaacgcaggacattatcaaaaggtccgcaactaactccatcacgccgccttctcaggtgcgtgattacaaagcagaagtcgcgaaacttatcgacgtttccacctgtatcggctgtaaagcctgtcaggtggcgtgttcggagtggaacgacatccgtgatgaagtggggcactgcgtcggggtttacgataaccccgccgatctgagcgccaagtcctggacggtgatgcgctttagcgaaaccgaacagaacggcaagctggagtggctgatccgtaaagacggctgtatgcactgtgaagatccgggctgcctgaaggcgtgcccgtctgctggtgcaatcattcagtacgctaacgggattgtcgatttccagtcggaaaactgcatcggctgtggttactgcattgccgggtgtccgtttaatattccgcgcctcaacaaagaggataaccgggtatataaatgcacgctctgcgtcgatcgcgtcagcgtcggccaggaaccggcttgtgtgaaaacctgtccgaccggggctatccacttcggcaccaagaaggagatgctggagctggcggaacagcgcgtagcgaaactgaaagcgcgtggttacgaacatgctggcgtctacaacccggaaggggtcggtggtacgcacgttatgtacgtgctgcatcatgccgatcagccggagctgtatcatggtctgccgaaagatccgaagatcgatacctcggtaagcctgtggaaaggcgcgttgaaaccgctggcagcggctggctttattgccacttttgccgggttgattttccactacatcggtattggcccgaataaggaagtggacgatgacgaggagggaaatcatgagtaa

SEQ ID NO: 3282 - protein, 294 aa, Escherichia coli
MAMETQDIIKRSATNSITPPSQVRDYKAEVAKLIDVSTCIGCKACQVACSEWNDIRDEVGHCVGVYDNPADLSAKSWTVMRFSETEQNGKLEWLIRKDGCMHCEDPGCLKACPSAGAIIQYANGIVDFQSENCIGCGYCIAGCPFNIPRLNKEDNRVYKCTLCVDRVSVGQEPACVKTCPTGAIHFGTKKEMLELAEQRVAKLKARGYEHAGVYNPEGVGGTHVMYVLHHADQPELYHGLPKDPKIDTSVSLWKGALKPLAAAGFIATFAGLIFHYIGIGPNKEVDDDEEGNHE

SEQ ID NO: 3283 - DNA, 1713 bp, Escherichia coli
gtggtcactccaacattcaggggcctgactgacttaggcctgctctctaccagcctgccaggttacctgacgctgccgtcagaaaaacaggttgatttgcagtcgtatctggaagcgaacacgccgaaagcgacgctggctgatcaggtgaactactggagcaactatccgaagtttttcgttagcctgatgaaatctttctacggcgatgccgcgcagaaagagaacaactggggctacgactggctgccgaagtgggaccagacctacgacgtcatcaagtatttcaacatgatggatgaaggtaaagtcaccggttatttctgccagggctttaacccggttgcgtccttcccggacaaaaacaaagtggtgagctgcctgagcaagctgaagtacatggtggttatcgatccgctggtgactgaaacctctaccttctggcagaaccacggcgagtcgaacgatgtcgatccggcatctattcagactgaagtattccgtctgccttcgacctgctttgctgaagaagatggttctatcgctaactccggtcgctggttgcagtggcactggaaaggtcaggacgcgccgggcgaagcgcgtaacgacggcgaaattctggcgggtatctaccatcatctgcgcgagctgtaccaggccgaaggtggtaaaggcgtagaaccgctgatgaagatgagctggaactacaagcagccgcacgaaccgcaatctgacgaagtagctaaagagaacaacggctatgcgctggaagatctctatgatgccaatggcgtgctgattgcgaagaaaggtcagttgctgagtagctttgcgcatctgcgtgatgacggtacaaccgcatcgtcttgctggatctacaccggtagctggacagagcagggcaaccagatggctaaccgcgataactccgacccgtccggtctggggaatacgctgggatgggcctgggcgtggccgctcaaccgtcgcgtactctacaaccgtgcttcggcggatatcaacggtaaaccgtgggatccgaaacggatgctgatccagtggaacggtagcaagtggacgggtaacgatattccggacttcggcaatgccgcaccgggtacgccaaccgggccgtttatcatgcagccggaagggatgggacgcctgtttgccatcaacaaaatggcggaaggtccgttcccggaacactacgagccaattgaaacgccgctgggcactaacccgttgcatccgaacgtggtgtctaacccggttgttcgtctgtatgaacaagacgcgctgcggatgggtaaaaaagagcagttcccgtatgtgggtacgacctatcgtctgacggagcacttccacacctggaccaagcacgcattgctcaacgcaattgctcagccggaacagtttgtggaaatcagcgaaacgctggcggcggcgaaaggcattgccaatggcgatcgtgtcactgtctccagcaagcgtggctttatccgcgcggtggctgtggtaacgcgccgtctgaaaccgctgaatgtaaacggtcagcaggttgaaacggtgggtattccaatccactggggctttgagggtgtcgcgcgtaaaggttatatcgctaacactctgacgccgaatgtcggtgatgcaaactcgcaaacgccggaatataaagcgttcttagtcaacatcgagaaggcgtaa

SEQ ID NO: 3284 - protein, 570 aa, Escherichia coli
MVTPTFRGLTDLGLLSTSLPGYLTLPSEKQVDLQSYLEANTPKATLADQVNYWSNYPKFFVSLMKSFYGDAAQKENNWGYDWLPKWDQTYDVIKYFNMMDEGKVTGYFCQGFNPVASFPDKNKVVSCLSKLKYMVVIDPLVTETSTFWQNHGESNDVDPASIQTEVFRLPSTCFAEEDGSIANSGRWLQWHWKGQDAPGEARNDGEILAGIYHHLRELYQAEGGKGVEPLMKMSWNYKQPHEPQSDEVAKENNGYALEDLYDANGVLIAKKGQLLSSFAHLRDDGTTASSCWIYTGSWTEQGNQMANRDNSDPSGLGNTLGWAWAWPLNRRVLYNRASADINGKPWDPKRMLIQWNGSKWTGNDIPDFGNAAPGTPTGPFIMQPEGMGRLFAINKMAEGPFPEHYEPIETPLGTNPLHPNVVSNPVVRLYEQDALRMGKKEQFPYVGTTYRLTEHFHTWTKHALLNAIAQPEQFVEISETLAAAKGIANGDRVTVSSKRGFIRAVAVVTRRLKPLNVNGQQVETVGIPIHWGFEGVARKGYIANTLTPNVGDANSQTPEYKAFLVNIEKA

SEQ ID NO: 3285 - DNA, 732 bp, Escherichia coli
atgaccaaccactgggtggatatcaaaaacgctaacgtcgtaatggtgatgggcggtaacgctgctgaagcgcatcccgtcggtttccgctgggcgatggaagcgaaaaacaacaacgatgcaaccttgatcgttgtcgatccccgttttacgcgtaccgcttctgtggcggatatttacgcacctattcgttccggtacggacattacgttcctgtctggcgttttgcgctacctgatcgaaaacaacaaaatcaacgccgaatacgttaagcattacaccaacgccagcctgctggtgcgtgatgattttgctttcgaagacggtctgttcagcggctacgacgctgaaaaacgtcaatacgataagtcgtcctggaactatcagttcgatgaaaacggctatgcgaaacgcgatgacacgctgactcatccgcgctgtgtatggaacctgctgaaagcgcacgtttcccgctacacgccggacgtagtagaaaacatttgcggtacgccaaaagccgacttcctgaaagtgtgtgaagtgctggcctccaccagcgcaccggatcgcacaaccaccttcctgtacgcgctgggctggacgcagcacaccgtgggtgcgcagaacatccgtacgatggcgatgatccagttactgctcggtaacatgggtatggccggtggcggcgtgaacgcattgcgtggtcactccaacattcaggggcctgactga

SEQ ID NO: 3286 - protein, 243 aa, Escherichia coli
MTNHWVDIKNANVVMVMGGNAAEAHPVGFRWAMEAKNNNDATLIVVDPRFTRTASVADIYAPIRSGTDITFLSGVLRYLIENNKINAEYVKHYTNASLLVRDDFAFEDGLFSGYDAEKRQYDKSSWNYQFDENGYAKRDDTLTHPRCVWNLLKAHVSRYTPDVVENICGTPKADFLKVCEVLASTSAPDRTTTFLYALGWTQHTVGAQNIRTMAMIQLLLGNMGMAGGGVNALRGHSNIQGPD

SEQ ID NO: 3287 - DNA, 588 bp, Escherichia coli
atggacgtcagtcgcagacaattttttaaaatctgcgcgggcggtatggcgggaacaacagtagcagcattgggctttgccccgaagcaagcactggctcaggcgcgaaactacaaattattacgcgcgaaagagatccgtaacacctgcacatactgttccgtaggttgcgggctattgatgtatagcctgggtgatggcgcgaaaaacgccagagaagcgatttatcacattgaaggtgacccggatcatccggtaagccgtggtgcgctgtgcccgaaaggggccggtttgctggattacgtcaacagcgaaaaccgtctgcgctacccggaatatcgtgcgccaggttctgacaaatggcagcgcattagctgggaagaagcattctcccgtattgcgaagctgatgaaagccgaccgtgacgctaactttattgaaaagaacgagcagggcgtaacggtaaaccgttggctttctaccggtatgctgtgtgcttccggtgccagcaacgaaaccgggatgctgactcaaaaatttgcccgctccctcgggatgctggcggtagacaaccaggcgcgcgtctga

SEQ ID NO: 3288 - protein, 195 aa, Escherichia coli
MDVSRRQFFKICAGGMAGTTVAALGFAPKQALAQARNYKLLRAKEIRNTCTYCSVGCGLLMYSLGDGAKNAREAIYHIEGDPDHPVSRGALCPKGAGLLDYVNSENRLRYPEYRAPGSDKWQRISWEEAFSRIAKLMKADRDANFIEKNEQGVTVNRWLSTGMLCASGASNETGMLTQKFARSLGMLAVDNQARV

SEQ ID NO: 3289 - DNA, 1071 bp, Escherichia coli
gtgctgcgtccagcccagcgcgtacaggaaggtggttgtgcgatccggtgcgctggtggaggccagcacttcacacactttcaggaagtcggcttttggcgtaccgcaaatgttttctactacgtccggcgtgtagcgggaaacgtgcgctttcagcaggttccatacacagcgcggatgagtcagcgtgtcatcgcgtttcgcatagccgttttcatcgaactgatagttccaggacgacttatcgtattgacgtttttcagcgtcgtagccgctgaacagaccgtcttcgaaagcaaaatcatcacgcaccagcaggctggcgttggtgtaatgcttaacgtattcggcgttgattttgttgttttcgatcaggtagcgcaaaacgccagacaggaacgtaatgtccgtaccggaacgaataggtgcgtaaatatccgccacagaagcggtacgcgtaaaacggggatcgacaacgatcaaggttgcatcgttgttgtttttcgcttccatcgcccagcggaaaccgacgggatgcgcttcagcagcgttaccgcccatcaccattacgacgttagcgtttttgatatccacccagtggttggtcatcgcaccgcgaccaaatgttggagcaagacttgctaccgttggtccgtgtcagacgcgcgcctggttgtctaccgccagcatcccgagggagcgggcaaatttttgagtcagcatcccggtttcgttgctggcaccggaagcacacagcataccggtagaaagccaacggtttaccgttacgccctgctcgttcttttcaataaagttagcgtcacggtcggctttcatcagcttcgcaatacgggagaatgcttcttcccagctaatgcgctgccatttgtcagaacctggcgcacgatattccgggtagcgcagacggttttcgctgttgacgtaatccagcaaaccggcccctttcgggcacagcgcaccacggcttaccggatgatccgggtcaccttcaatgtgataaatcgcttctctggcgtttttcgcgccatcacccaggctatacatcaatag

SEQ ID NO: 3290 - protein, 356 aa, Escherichia coli
MLRPAQRVQEGGCAIRCAGGGQHFTHFQEVGFWRTANVFYYVRRVAGNVRFQQVPYTARMSQRVIAFRIAVFIELIVPGRLIVLTFFSVVAAEQTVFESKIITHQQAGVGVMLNVFGVDFVVFDQVAQNARQERNVRTGTNRCVNIRHRSGTRKTGIDNDQGCIVVVFRFHRPAETDGMRFSSVTAHHHYDVSVFDIHPVVGHRTATKCWSKTCYRWSVSDARLVVYRQHPEGAGKFLSQHPGFVAGTGSTQHTGRKPTVYRYALLVLFNKVSVTVGFHQLRNTGECFFPANALPFVRTWRTIFRVAQTVFAVDVIQQTGPFRAQRTTAYRMIRVTFNVINRFSGVFRAITQAIHQ

SEQ ID NO: 3291 - DNA, 882 bp, Escherichia coli
atgacacgacaaaaagcaacgctcatagggctaatagcgatcgtcctgtggagcacgatggtaggattgattcgcggtgtcagtgagggactcggcccggtcggcggcgcagctgctatctattcattaagcgggctgctgttaatcttcacggttggatttccgcgtattcgacagatcccgaaaggctatttactcgccgggagtctgttattcgtcagctatgaaatctgtctggcgctttccttagggtatgcggcgacccgtcatcaggcgattgaagtgggtatggtgaactatctgtggcccagcctgacaattctctttgccattctgtttaatggtcagaaaaccaactggctgattgtaccaggattattattagccctggtcggcgtctgctgggtgttaggcggtgacaatgggttacattatgatcaaattattaataatatcaccaccagcccattgagttatttcctggcgttcattggggcgtttatctgggcagcctactgcacagtaacgaataaatacgcacgcggatttaacggaattaccgtttttgtcctgctaacgggagcaagtctgtgggtttactattttcttacgccacaaccagaaatggtatttagcacgcccgtcatgattaaactcatctctgcggcatttaccttaggatttgcttatgctgcatggaatgtcggtatattacatggcaacgtcaccataatggcggtaggttcgtattttacgcccgtcctttcctcagcgcttgcagccgtgctgctcagcgccccgctgtcgttctcgttctggcaaggcgcgctaatggtctgcggcggttccctgctctgctggctggcgacacgtcgtggctaa

SEQ ID NO: 3292 - protein, 293 aa, Escherichia coli
MTRQKATLIGLIAIVLWSTMVGLIRGVSEGLGPVGGAAAIYSLSGLLLIFTVGFPRIRQIPKGYLLAGSLLFVSYEICLALSLGYAATRHQAIEVGMVNYLWPSLTILFAILFNGQKTNWLIVPGLLLALVGVCWVLGGDNGLHYDQIINNITTSPLSYFLAFIGAFIWAAYCTVTNKYARGFNGITVFVLLTGASLWVYYFLTPQPEMVFSTPVMIKLISAAFTLGFAYAAWNVGILHGNVTIMAVGSYFTPVLSSALAAVLLSAPLSFSFWQGALMVCGGSLLCWLATRRG

SEQ ID NO: 3293 - DNA, 1389 bp, Escherichia coli
atggcactgcaaaatgagaaaaatagtcgttatcttttacgcgactggaaaccagaaaatccggccttctgggaaaataaaggaaagcatattgcacgaagaaacctctggatatcagtcagttgcctacttcttgccttctgtgtctggatgctatttagcgcagttactgttaatctcaataaaatcggttttaatttcactaccgatcaactctttttattaaccgcattaccctccgtttctggcgcattattgcgtgtcccctactcctttatggtgcctatattcggtggacgccgatggacggtttttagtactgcaatcctgattattccttgcgtctggctcggaattgccgtgcaaaatccgaataccccttttgggatatttatcgttatcgctttgctatgcggttttgcaggtgcgaactttgcttcgagcatgggcaatatcagtttcttctttccaaaagccaaacaagggagcgctcttgggattaatggcggattaggaaacttaggtgtaagtgtgatgcagctggttgcaccgctggtcatttttgtacccgtatttgcctttctcggcgtcaatggcgtaccgcaggccgacggttcggtgatgtcgctggcgaatgccgcatggatttgggtgccattactggcgattgccacgatcgccgcctggtcagggatgaatgatatcgccagttcacgcgcctcaattgccgaccagctccctgtcttacaacgcctgcatctctggctgctgagcctgctttatcttgccaccttcggttcgtttatcggtttttctgcgggttttgccatgctggcaaaaacccagttcccggatgtgaatattctgcgcctggcgttctttggcccatttatcggtgccatcgcgcgatcggttggtggtgctatttccgataaattcggcggcgtgcgggtgacgttgatcaacttcatttttatggcgattttcagcgccctgctgttccttaccttaccgggcacaggctccggtaatttcatcgcattttacgccgtatttatggggctgtttctgaccgcgggtctgggaagtggttctactttccagatgatcgccgtcatctttcgccagataacaatttatcgggtgaagatgaaaggcggtagtgatgagcaagctcaaagagaagccgtcaccgaaacggcagccgctctgggctttatctcagccattggcgcagtgggcggcttttttattccgcaggcgtttggcatgtcgctcaatatgaccggctctccggtgggcgcgatgaaagtgtttttaatcttctacatcgtttgtgtgctactgacctggctggtttatggtcggcggaagttcagccaaaaataa

SEQ ID NO: 3294 - protein, 462 aa, Escherichia coli
MALQNEKNSRYLLRDWKPENPAFWENKGKHIARRNLWISVSCLLLAFCVWMLFSAVTVNLNKIGFNFTTDQLFLLTALPSVSGALLRVPYSFMVPIFGGRRWTVFSTAILIIPCVWLGIAVQNPNTPFGIFIVIALLCGFAGANFASSMGNISFFFPKAKQGSALGINGGLGNLGVSVMQLVAPLVIFVPVFAFLGVNGVPQADGSVMSLANAAWIWVPLLAIATIAAWSGMNDIASSRASIADQLPVLQRLHLWLLSLLYLATFGSFIGFSAGFAMLAKTQFPDVNILRLAFFGPFIGAIARSVGGAISDKFGGVRVTLINFIFMAIFSALLFLTLPGTGSGNFIAFYAVFMGLFLTAGLGSGSTFQMIAVIFRQITIYRVKMKGGSDEQAQREAVTETAAALGFISAIGAVGGFFIPQAFGMSLNMTGSPVGAMKVFLIFYIVCVLLTWLVYGRRKFSQK

SEQ ID NO: 3295 - DNA, 3741 bp, Escherichia coli
atgagtaaacttttggatcgctttcgctacttcaaacaaaagggcgaaacctttgccgatggtcacggacaggtgatgcatagcaaccgcgactgggaggacagctatcgccagcgttggcagttcgacaaaatcgtgcgttccacccacggtgttaactgtacaggctcctgcagctggaaaatctacgttaaaaatggtctggtgacctgggaaatccaacagaccgactacccgcgcactcgccctgacctgccaaatcatgaacctcgcggctgcccgcgtggcgcaagttactcctggtatctctacagcgctaaccgcctgaaatacccgctcattcgtaaacgactgattgaactgtggcgcgaagccctcaaacaacacagcgatccggtactggcgtgggcatcgattatgaacgatccgcaaaagagcctgagctacaaacaagtgcgtggacgcggtggctttatccgctccaactggcaggagctaaatcagctgattgccgccgctaacgtctggaccatcaaaacttacggcccggatcgcgttgccggtttctcgccgattccggcgatgtcgatggtttcttacgccgccggaacacgctatctgtcgttgttaggtggcacctgtttaagcttctacgactggtattgcgacctgccgcccgcctcgccgatgacctggggcgagcaaaccgacgtaccggaatctgccgactggtataactccagttacatcatcgcctgggggtctaacgtaccgcagacacgtacgccggacgcccatttctttaccgaagtacgctacaaaggcactaaaaccatcgccattacccctgactactctgaagtggccaaattgtgcgaccagtggctggcaccgaaacaaggcactgatagtgccctggcaatggcaatgggccatgtcattttaaaagagtttcatctcgataatcccagcgattattttatcaactactgccgccgctacagcgacatgccgatgctggtaatgctggaacctcgcgacgacggcagctacgttcccgggcgcatggtccgcgcatctgacctggtggatggactgggcgaaagcaataatccgcagtggaaaaccgtggcagttaataccgcaggtgaattggtagtgccgaacggttcgattggttttcgctggggagaaaaaggcaaatggaacctggaatccattgccgccggtacggaaaccgaattgtcgttaaccctgctcggtcaacatgacgccgttgcaggcgtggccttcccctactttggcggcattgaaaatccacattttcgcagcgtaaaacacaatcctgtcctggtgcgccaattgcccgttaaaaacctgacattagccgatggtagcacctgtccggtggtcagcgtttatgatttggtactggcgaattacggcctcgatcgcgggctggaagatgaaaacagcgcgaaagattacgctgaaatcaaaccttatacccctgcctggggcgagcaaattaccggcgttccgcgccagtatattgaaaccatcgcccgtgaatttgccgataccgcccataaaacgcatgggcgctcgatgattattctcggcgcaggtgttaaccactggtatcacatggacatgaactaccgcgggatgatcaatatgctgatcttctgcggttgtgtcgggcaaagcggtggcggctgggcacactatgtcggtcaggaaaaactgcgcccgcaaaccggctggctgcctctggcctttgcgctcgactggaaccgaccaccgcgccagatgaacagcacctcgtttttctacaatcactccagccagtggcgctatgaaaaagtcaccgcgcaggaattgctctcaccgctcgccgatgccagtaaatacagcggtcacctgattgatttcaacgttcgcgccgaacgtatgggctggctaccttctgcgccgcagctggggcgtaacccgctctccctgaaagccgaagccgacaaggccggattgtcacccgccgaatttaccgtccaggcactgaagtcaggcgaattacgcatggcctgcgaacagccggacaacggcagcaaccatccgcgtaacctgtttgtctggcgttcaaacctgcttggctcttccggcaagggccacgagtatatgcagaagtatctgctgggtacgaaaagtggcattcagggggaagaacttggaccgacggagggaatccaaccagaagaagtcgagtggcaaactgcggcgattgaaggcaagctcgacctgctggtgacgctcgacttccgcatgtccagtacctgcctgttctccgatatcgttctgcccaccgccacctggtacgaaaaagacgatatgaatacctcggatatgcatccatttattcatccgctttctgcggcggtcgatccggcgtgggaatcacgcagcgactgggaaatctacaaaggtatcgctaaagccttttcgcaagtgtgcatagggcatctcggcaaagaaaccgacgtggtattacaaccactgctgcatgactccccggcagagctttcacagccgtgtgaagtgctcgactggcgcaaaggcgagtgcgatctgattccaggcaaaaccgcgccgaatattgtggcggtggagcgcgactaccctgctacctatgaacgctttacctcactcgggccattgatggacaaacttggcaacggcggtaaagggatttcgtggaatacccaggatgaaattgatttcctcggtaaactcaattacaccaagcgtgatggcccggcaaaggggcgtccgctgattgacaccgccattgacgcatcagaagtgattctggcactggcaccggaaaccaacggccatgttgcagtcaaagcgtggcaagcgctgggcgagatcaccggacgcgaacatacccatctggcgctgcacaaagaggacgagaagattcgctttcgcgatattcaggcgcagccgcgtaaaattatctccagccccacatggtctggtctggaaagcgatcacgtttcctataacgcgggatacaccaacgttcatgagttaattccgtggcgcacgctgtcaggacgccagcaactctatcaggatcatccgtggatgcgtgcttttggtgaaagtctggtggcttatcgcccgcctatcgacacccgtagcgtcagtgaaatgcgccagataccgccaaacggcttcccggagaaagcccttaacttcctgacgccgcaccagaaatggggcattcactcaacctacagtgaaaacctgctaatgctgacgctctctcgcggtggaccgattgtctggctcagcgaaaccgatgcccgtgaactgaccattgtcgataacgactgggtggaagtgtttaacgccaatggcgcgctgactgcccgcgcggtggtcagccagcgtgtaccgccgggcatgaccatgatgtatcacgctcaggaacgcattatgaatattcctggttcggaagtaactggcatgcgcggcggcattcataactcggtcacccgcgtttgtccgaaaccaacgcatatgattggcggttacgcgcagctggcctggggctttaactactacggcaccgtcggctcaaaccgcgacgaattcatcatgatccgcaagatgaagaacgttaactggctggatgatgaaggtcgcgatcaggtacaggaggcgaaaaaatga

SEQ ID NO: 3296 - protein, 1246 aa, Escherichia coli
MSKLLDRFRYFKQKGETFADGHGQVMHSNRDWEDSYRQRWQFDKIVRSTHGVNCTGSCSWKIYVKNGLVTWEIQQTDYPRTRPDLPNHEPRGCPRGASYSWYLYSANRLKYPLIRKRLIELWREALKQHSDPVLAWASIMNDPQKSLSYKQVRGRGGFIRSNWQELNQLIAAANVWTIKTYGPDRVAGFSPIPAMSMVSYAAGTRYLSLLGGTCLSFYDWYCDLPPASPMTWGEQTDVPESADWYNSSYIIAWGSNVPQTRTPDAHFFTEVRYKGTKTIAITPDYSEVAKLCDQWLAPKQGTDSALAMAMGHVILKEFHLDNPSDYFINYCRRYSDMPMLVMLEPRDDGSYVPGRMVRASDLVDGLGESNNPQWKTVAVNTAGELVVPNGSIGFRWGEKGKWNLESIAAGTETELSLTLLGQHDAVAGVAFPYFGGIENPHFRSVKHNPVLVRQLPVKNLTLADGSTCPVVSVYDLVLANYGLDRGLEDENSAKDYAEIKPYTPAWGEQITGVPRQYIETIAREFADTAHKTHGRSMIILGAGVNHWYHMDMNYRGMINMLIFCGCVGQSGGGWAHYVGQEKLRPQTGWLPLAFALDWNRPPRQMNSTSFFYNHSSQWRYEKVTAQELLSPLADASKYSGHLIDFNVRAERMGWLPSAPQLGRNPLSLKAEADKAGLSPAEFTVQALKSGELRMACEQPDNGSNHPRNLFVWRSNLLGSSGKGHEYMQKYLLGTKSGIQGEELGPTEGIQPEEVEWQTAAIEGKLDLLVTLDFRMSSTCLFSDIVLPTATWYEKDDMNTSDMHPFIHPLSAAVDPAWESRSDWEIYKGIAKAFSQVCIGHLGKETDVVLQPLLHDSPAELSQPCEVLDWRKGECDLIPGKTAPNIVAVERDYPATYERFTSLGPLMDKLGNGGKGISWNTQDEIDFLGKLNYTKRDGPAKGRPLIDTAIDASEVILALAPETNGHVAVKAWQALGEITGREHTHLALHKEDEKIRFRDIQAQPRKIISSPTWSGLESDHVSYNAGYTNVHELIPWRTLSGRQQLYQDHPWMRAFGESLVAYRPPIDTRSVSEMRQIPPNGFPEKALNFLTPHQKWGIHSTYSENLLMLTLSRGGPIVWLSETDARELTIVDNDWVEVFNANGALTARAVVSQRVPPGMTMMYHAQERIMNIPGSEVTGMRGGIHNSVTRVCPKPTHMIGGYAQLAWGFNYYGTVGSNRDEFIMIRKMKNVNWLDDEGRDQVQEAKK

SEQ ID NO: 3297 - DNA, 1545 bp, Escherichia coli
atgaaaatacgttcgcaagtcggcatggtgcttaacctcgataaatgtatcggctgccatacctgttcggtgacctgtaaaaacgtctggaccggacgcgaaggcatggagtacgcatggtttaacaacgtcgaaaccaaaccgggcattggttatccgaaaaactgggaagatcaggaagaatggcaaggcggctgggtgcgtgatgtgaatggcaagatacgcccgcgtctgggcagcaaaatgggcgtgattaccaaaattttcgccaacccggtagtgccgcagattgacgattactacgaacctttcaccttcgactacgaacatttgcatagcgcgccggaaggcaaacatattcccaccgcccgtccgcgttcactgattgacggcaaacggatggacaaagtgatctggggcccaaactgggaagaactgctgggcggcgaatttgaaaaacgagcccgcgaccgcaacttcgaggccatgcaaaaggagatgtacgggcagtttgaaaacaccttcatgatgtacctgccgcgcttgtgcgaacactgccttaaccccagttgtgtagcgacctgccccagcggcgctatctacaaacgcgaagaagacggcattgtgctgatcgatcaggataaatgccgtggctggcgtttgtgcattagcggttgcccatacaaaaaaatctacttcaactggaaaagcggtaagtcagaaaaatgtattttctgttatccgcgaattgagtccggtcagccaacagtctgctccgaaacctgcgtgggtcgcatccggtatctgggcgtgctgctctacgacgccgaccgcatcgaagaagcagcgagtaccgaacgagaggtcgatctctatgaacgccagtgcgaagtgttcctcgatccgcacgatccctcggtgatcgaagaagccctgaaacaaggtattccacaaaacgtgattgacgctgcccagcgttcgcctgtctacaaaatggcgatggactggaaactggcgctaccgctgcaccctgaataccgcaccctgccgatggtctggtacgttcctccgctgtcaccgattcagtcctacgctgatgcgggcggcttgccgaaaagcgaaggcgtgctgcccgccatcgaaagcctgcgtattccggtgcaatatctcgccaatatgttgagtgccggtgataccggtccggtactgcgggcgctgaaacggatgatggcgatgcgccactatatgcgttcacaaaccgtggaaggcgttactgatactcgtgccatcgacgaagtaggcctgagcgtcgcccaggtcgaagagatgtatcgttacctcgccattgccaactatgaagatcgtttcgtcatcccgacaagccatcgggaaatggcgggcgatgccttcgcagaacgcaacggctgcggttttacctttggcgacggttgccacggttcggacagcaaattcaacctgttcaacagtagccgtatcgatgccatcaacatcaccgaagtgcgcgacaaagcggagggcgaataa

SEQ ID NO: 3298 - protein, 514 aa, Escherichia coli
MKIRSQVGMVLNLDKCIGCHTCSVTCKNVWTGREGMEYAWFNNVETKPGIGYPKNWEDQEEWQGGWVRDVNGKIRPRLGSKMGVITKIFANPVVPQIDDYYEPFTFDYEHLHSAPEGKHIPTARPRSLIDGKRMDKVIWGPNWEELLGGEFEKRARDRNFEAMQKEMYGQFENTFMMYLPRLCEHCLNPSCVATCPSGAIYKREEDGIVLIDQDKCRGWRLCISGCPYKKIYFNWKSGKSEKCIFCYPRIESGQPTVCSETCVGRIRYLGVLLYDADRIEEAASTEREVDLYERQCEVFLDPHDPSVIEEALKQGIPQNVIDAAQRSPVYKMAMDWKLALPLHPEYRTLPMVWYVPPLSPIQSYADAGGLPKSEGVLPAIESLRIPVQYLANMLSAGDTGPVLRALKRMMAMRHYMRSQTVEGVTDTRAIDEVGLSVAQVEEMYRYLAIANYEDRFVIPTSHREMAGDAFAERNGCGFTFGDGCHGSDSKFNLFNSSRIDAINITEVRDKAEGE

SEQ ID NO: 3299 - DNA, 696 bp, Escherichia coli
atgcagatcctcaaagtgatcggcctgttgatggagtacccagacgagttgttgtgggagtgtaaggacgacgcgctggcgcttatccgccgcgacgcgccgatgctcaccgattttgcactcgacctgctcaacgccccgctgctggataaacaggccgaatggtgtgaagtgtttgaccgcgggcgcaccacgtcgctgctgctgtttgaacatgttcatgccgagtcccgcgatcgcggccaggcaatggtggacctgctggcggagtatgaaaaggtcggtctgcaactgaattgtagggaactgcccgattatctaccgctgtatctggagtatttaagcgtacttccggacgatcaggcgaaagaaggattactcaacgttgcgccgatcctcgccctgcttggcggacgcttaaaacaacgcgaggcaccgtggtacgcgttatttgacgccctgttgcaactggcaggaagccctctgtcaagtgacagtgtcataaaacagattcgcagtgaagagcgtgacgacacccaccaggcgctggatgcggtgtgggaagaagaacaggtgaagtttattgaagataacgccacggcgtgtgacagctcgccgcttaatcaatatcagcgacgctttagccaggatgtcgcgccgcagtatgtcgacatcagtgcgggaggtgggaaatga

SEQ ID NO: 3300 - protein, 231 aa, Escherichia coli
MQILKVIGLLMEYPDELLWECKDDALALIRRDAPMLTDFALDLLNAPLLDKQAEWCEVFDRGRTTSLLLFEHVHAESRDRGQAMVDLLAEYEKVGLQLNCRELPDYLPLYLEYLSVLPDDQAKEGLLNVAPILALLGGRLKQREAPWYALFDALLQLAGSPLSSDSVIKQIRSEERDDTHQALDAVWEEEQVKFIEDNATACDSSPLNQYQRRFSQDVAPQYVDISAGGGK

SEQ ID NO: 3301 - DNA, 681 bp, Escherichia coli
atgattcagtatctgaacgtctttttttacgatatctacccgtacttgtgcggcacggtttttatccttggaagctggctgcgctacgaccacgggcagtacacctggcgcgccgcctccagccagatgctggataaacgcgggatggtgctgtggtcgaacttgttccatatcggcattttggggattttcttcgggcacctgttcggcatgttaacgccacactggatgtacgcgtggtttctgccggtggcggtaaaacagcagatggcgatgatcctcggcggaatatgcggggtattgacgctgattggcggtgcggggctactggtgcgtcgtttaacaaatccgcgtatcagggcgacgtcttctggtgcggatatcctgatcctcgccattttgttaattcagtgcattcttgggttaaccaccattcctttttcagcacaacatccggacggcagtgaaatgatgaagttggtgggctgggcgcaaagcatcgtcactttccagggcggtgcatctacgcatcttgatggtgtcgcctttatattccgcgttcatctggtgcttggaatgaccatcttcctgctcttcccgttcacccgactggtgcatgtctggagcgcgccgtttgagtactttactcgtcggtatcagattgtgcgttcgcggcgttaa

SEQ ID NO: 3302 - protein, 226 aa, Escherichia coli
MIQYLNVFFYDIYPYLCGTVFILGSWLRYDHGQYTWRAASSQMLDKRGMVLWSNLFHIGILGIFFGHLFGMLTPHWMYAWFLPVAVKQQMAMILGGICGVLTLIGGAGLLVRRLTNPRIRATSSGADILILAILLIQCILGLTTIPFSAQHPDGSEMMKLVGWAQSIVTFQGGASTHLDGVAFIFRVHLVLGMTIFLLFPFTRLVHVWSAPFEYFTRRYQIVRSRR

SEQ ID NO: 3303 - DNA, 894 bp, Escherichia coli
atgaaaccgcaggtttaccacgtcgatgcttttacctctcaaccatttcgcggcaattctgccggtgttgttttccccgccgataatctcagtgaagcgcaaatgcagcttatcgcccgcgagttaggtcattcggaaactgcttttctgctgcacagcgacgacagcgatgtgcgcatccgctactttacgccaacggttgaagttccgatttgtggtcacgcgacagtagctgcgcactatgtacgtgcaaaggtgttaggtttaggaaattgcacggtctggcaaacatcgctggcaggaaaacatcgtgtgactatcgaaaagcaaaatgatgattatcgtatttcgctggaacaaggtactccaggctttgagccaccactgacaggtgaaacacgagcggcaattatcaacgcgcttcatctcactgaagacgatattttgcaaggcttgccaatccaggtggctaccaccggacactcaaaagtgatgattccactgaagccggaagtggatatcgacgccctttcgcctgaccttgctgcgctgaccgcaatcagcaagcagattggctgcaatggtttcttcccgttccagatccgcccaggcaaaagcgaaaccgacggtcgcatgttctcgcctgcgattggtattgtggaagatccggtgaccgggaatgccaatggtccgatgggcgcatggttagtacatcacaacgtattatcccacgatggcaacgtgttgcgtgttaaaggccatcaggggcgcgcattggggcgtgatggtgtaattgatgtgacggtgacaattcgagataaccaaccggagaaagtcaccatttctggcgcggcggtgattttgtttcatgccgaatgggcaattgaactctga

SEQ ID NO: 3304 - protein, 297 aa, Escherichia coli
MKPQVYHVDAFTSQPFRGNSAGVVFPADNLSEAQMQLIARELGHSETAFLLHSDDSDVRIRYFTPTVEVPICGHATVAAHYVRAKVLGLGNCTVWQTSLAGKHRVTIEKQNDDYRISLEQGTPGFEPPLTGETRAAIINALHLTEDDILQGLPIQVATTGHSKVMIPLKPEVDIDALSPDLAALTAISKQIGCNGFFPFQIRPGKSETDGRMFSPAIGIVEDPVTGNANGPMGAWLVHHNVLSHDGNVLRVKGHQGRALGRDGVIDVTVTIRDNQPEKVTISGAAVILFHAEWAIEL

SEQ ID NO: 3305 - DNA, 846 bp, Escherichia coli
atgacgcccattctgaatcattattttgcccgtattaactggttgggagctgctgcggccaatattgatacgctgcgtgcattgcacctgaaacacaattgcaccattccgtttgaaaatctcgacgttttgctgccgagggaaatacagcttgatgatcaatcgctggaagataaactggtgatagcccgtcgtggcggttactgttttgagcagaatggcgtgtttgagcgggtgttacgcgagctggggtttaacgttcgcagcttgttaggtcgcgtagtgttatcaaatccgccagcattaccgccgcgcacccatcgtttgctgttggtggaactggaaggggaaaaatggattgctgatgtcggtttcggtgggcagacgctaaccgcgccgattcgtttaatgccggatatcatgcaaaccacgccacacggagagtatcggttgttgcaagagggtgatgattgggtattgcagtttaatcatcatcagcactggcagtcgatgtaccgttttgatctctgcgagcagcaacaaagcgattatgtgatgggcaatttctggtcggcgcactggccgcagtcgcattttcgccatcatttgctgatgtgtcgccatttgccggacggtggcaagctaacgctgaccaattttcattttacccattatgaaaatgggcacgcagttgagcagcgaaatctaccagatgtggcgtcgttatatgccgtgatgcaggaacagtttggtctgggcgtagatgatgcgaaacatggctttactgtggatgagttagcgctggtgatggcggcgtttgatacgcacccggaggcgggaaaataa

SEQ ID NO: 3306 - protein, 281 aa, Escherichia coli
MTPILNHYFARINWLGAAAANIDTLRALHLKHNCTIPFENLDVLLPREIQLDDQSLEDKLVIARRGGYCFEQNGVFERVLRELGFNVRSLLGRVVLSNPPALPPRTHRLLLVELEGEKWIADVGFGGQTLTAPIRLMPDIMQTTPHGEYRLLQEGDDWVLQFNHHQHWQSMYRFDLCEQQQSDYVMGNFWSAHWPQSHFRHHLLMCRHLPDGGKLTLTNFHFTHYENGHAVEQRNLPDVASLYAVMQEQFGLGVDDAKHGFTVDELALVMAAFDTHPEAGK

SEQ ID NO: 3307 - DNA, 570 bp, Escherichia coli
gtgagccaattcattcccgtcgaattacaccatgccagccgtctgttaaatcatggcccaactgtcatgatcaccagtttcgatgagcaatcccagcggcgtaacattatggcagcagcctggtcgatgcccgtagagtttgaaccgccacgcgtggcgattgtggtagataaatcgacatggaccagggagttgattgaacgtaacggtaagtttggcatcgttatcccgggcgttgcggcgactaactggacgtgggcggtgggaagtgtgtcgggtcgtgaagaagataaatttaattgctacggcattccggtagtgagaggcccggtgcttggtttgccgctggtcgaggaaaaatgtctggcgtggatggagtgtcgcctgctacctgcaacttccgcgcaagaaaaatacgatacgctatttggcgaagtggtatcagcagcggcagacgcacgggtatttgtcgaaggccgctggcagtttgatgatgataagctcaatacgttgcatcatttaggtgctggcacgtttgttaccagtggtaagcgagttacggcgggctaa

SEQ ID NO: 3308 - protein, 189 aa, Escherichia coli
MSQFIPVELHHASRLLNHGPTVMITSFDEQSQRRNIMAAAWSMPVEFEPPRVAIVVDKSTWTRELIERNGKFGIVIPGVAATNWTWAVGSVSGREEDKFNCYGIPVVRGPVLGLPLVEEKCLAWMECRLLPATSAQEKYDTLFGEVVSAAADARVFVEGRWQFDDDKLNTLHHLGAGTFVTSGKRVTAG

SEQ ID NO: 3309 - DNA, 144 bp, Escherichia coli
atgttggatattaaaggtgaaattatcacaactgatgcgatgggttgccagaaagatattgcagagaagatacaaaaacagggaggtaattatttatttgctgtaaaaggacataaggagcggattaataaagcctttgagtga

SEQ ID NO: 3310 - protein, 47 aa, Escherichia coli
MLDIKGEIITTDAMGCQKDIAEKIQKQGGNYLFAVKGHKERINKAFE

SEQ ID NO: 3311 - DNA, 786 bp, Escherichia coli
atgctgcaagctataaaaaaaatcataataatgacaatcgtaaatattatatttttctattcctttcaatcgactgcggatgaaatggttttaataaaaaaatacgggtttgggcttgagagagatatcaaaggaaggccattaatttatcctatcgaaaattatgatgagtgtaagaaaaaatgcaatcatatgaattatatagcggatgtcaatgctcaattagctatgagtaaaaaaaataacaggatttttgctaacataacctttactaacaatagctctaccacgtattttttttctaaatattatctacctatgaaagtaaaagatggaaaaggagatgaatatgatgcgatatgcaaaaaaccattcagaatcaactctgggaatatcacgttggactacttaggtggttcatgtccttttgaaattaatacgaatcctgaacggtggaatactattaaaccaggtcgtagttttttgttgagtataaccttaaatgatatgtatgcctttataccaggagataattattattttataaaatcatctggctataaatttgttaatgacaagtggtttacactcaaatcaatcaataatatttttctttattttttaaatttaaaaattaattgtgctgatgatttttttgatattaataattttactacatgtaataatttgttattggatgaaaaaaacacttttttattaatcagttatgggcaattgaggatgaaaaaaattctatttacgtcacccctgatgaaatttctataa

SEQ ID NO: 3312 - protein, 261 aa, Escherichia coli
MLQAIKKIIIMTIVNIIFFYSFQSTADEMVLIKKYGFGLERDIKGRPLIYPIENYDECKKKCNHMNYIADVNAQLAMSKKNNRIFANITFTNNSSTTYFFSKYYLPMKVKDGKGDEYDAICKKPFRINSGNITLDYLGGSCPFEINTNPERWNTIKPGRSFLLSITLNDMYAFIPGDNYYFIKSSGYKFVNDKWFTLKSINNIFLYFLNLKINCADDFFDINNFTTCNNLLLDEKNTFLLISYGQLRMKKILFTSPLMKFL

SEQ ID NO: 3313 - DNA, 798 bp, Escherichia coli
ttgcgaatgatgattttctctcaatggaaggacactatggacgataataatcaaacttctggacaaccaaagccagagccagaagaatgtgtgaaagagcaaaaaataacagatcattttaaaataatgattgataaggctcgtaaggcacaaaagttggttttgataaaaagagcagatgatcttttgagatggggagcacaggaggaatatgatttcagtaagatctttggtgttaaaggaaataaggaggttaatataagaaaatatggacataatacaggtaggcgcatgaatgctagatttcttatgatggatggtgtgagaagattaatgattatagctaatgatttaacaatgagcagttttataaattatacaggttgtaatgaatttgcagcattcgtcagcccaagtaaggatatgccctatataattaacataggcgcaaaatttgagtatagagatggcaaaaaaaatccagtaacgggaaaggattctcatgttgctactttatgtcatgaaatgtctcatattcagtggtattatggggataataaaaaaggtggtatgtggtcacaggattatacaactactgataaatattcaacgtgcaaagaggatgaagtttcatatgacgaacatatccgtattgcaactaaactgatctctaaacaaaaagatcaaatatttgagaatgcatataacatagaaagatattttgaaataagattaattgaaagtgagatagactcgattgatgatgaaatattaagcaattcagttaagaaaaaatag

SEQ ID NO: 3314 - protein, 265 aa, Escherichia coli
MRMMIFSQWKDTMDDNNQTSGQPKPEPEECVKEQKITDHFKIMIDKARKAQKLVLIKRADDLLRWGAQEEYDFSKIFGVKGNKEVNIRKYGHNTGRRMNARFLMMDGVRRLMIIANDLTMSSFINYTGCNEFAAFVSPSKDMPYIINIGAKFEYRDGKKNPVTGKDSHVATLCHEMSHIQWYYGDNKKGGMWSQDYTTTDKYSTCKEDEVSYDEHIRIATKLISKQKDQIFENAYNIERYFEIRLIESEIDSIDDEILSNSVKKK

SEQ ID NO: 3315 - DNA, 2406 bp, Escherichia coli
atgtccttaaaaggtcttcgctttacgctggaggttgacggccaggagccggacacctttgcagtggtgagcttccggttaatccagaaccagtcttatccgtttgtgatgagtgtggatgtcgccagcgattcttttatgcagacggcggagatgctgctggagaagaacgcaacgctgactatctggcagggtgtcatcccgctgcgttatgtcacaggcgtggtggcagggtttggtatgcaggagaacaacggctggcagatgcgttatcacctgcgtattgagccgccgttatggcggtgcgggctgcggcggaacttccgtatcttccagcagcaggatatccggacgatatcggccacattactgaacgagaacggcgtcacggagtggacgccgctgttttatgaggaccatccggcgcgggaattctgtgtccagtacggggaaagcgacctggcgtttctggcgcggctgtgggcggaggaggggattttcttctttgagcggtttgcggcggacagtccggagcagaagctgacgctgtgcgacgatgtggcggggctgtcacaggcgggggagcttccgtttaacccggacacatcggcaggagcggagacggagtgtgtcagtatgttccgttatgaggcgcatgtccgcccgtcatcggtgcagagccaggattacacgtttaaggtgccggactggccggggatgtatgagcagcagggtgagagcctgaacggacagcttgaacagtatgaaatatttgattatccgggaaggtacaaggatgaacagcacggcaaggatttcacgctgtaccggatggagagcctgcgcagtgatgcggaaaaggccacagggcagagtaattcgccgaagctgtggccggggacgtggtttacgctgacggggcatccgcagaagatgctgaaccgtgaatggcaggtggtacagagcattctgtcaggagaccagccgcaggcgcttcacggcagccaggggagaggaaccacgctgggaaatcagttagaggtgataccggcggaccggacgtggcgtccacggctgcaaagcaaaccgaaggtggacgggccacagagcgccattgtcaccgggcctgcgggagaggaaatcttctgtgatgaacatggccgggtacgggtgaagtttcactgggaccgttatcacgggatgacggaggagagttcgtgctgggtgcgtgtgtcgcaggcgtgggcggggccgggatttggtaatctggcgataccgcgggtgggccaggaggtgattgttgattttctgaacggggacccggaccagccgctggtcatgggccggacgtaccatgaggacaaccgttcgccgggggacctgccgggaacgaagacgcagatgacgatacggtcgaagacctataaaggaagcggttttaatgagttgcgctttgaggatgcgacggataaggaacaggtctatatccacgcgcagaagaacatggacacggaggtacttaacgaccggacgacggatgtgaaacatgaccatacggagaccatcgggaacgaccagaagataacggtggtgaaggggcagacggttcaggtcgggaccagaaaagaagggggccacgaccagagtatcacggtggcgaacgaccggtgcatcacggtacgtaatgaccagacgctgcaggtgacgaatgaccggacggtgagcgtgagtaatgatgacggcctgtacgtcagaaatgaccgtaaagtgacggtggaagggaagcaggagcataagacgacggggaaccatgtcagcctggtggagggaaagcacagcctggtggtgaagggggacctggcgaggaaggtgagtggcgcgctggggataaaggtcgacggggatatcgtgctggagagcagcagccggataagcctgaaggtgggtggctcgtttgtggtcatccattcagggggcgtggacatcgtcgggccgaaaatcagtctcaatagcggcggtagtccggggacgccggtgccggcgctgcaaccgacggtgctgaagacactgggggatgagaagagtggtgatggcagtgattccggagaagaaaatgaagactctggagggaactgcgtgaccggaagtggtggtgatgatcgaggtgacgatgaggatgaacctgaaaaatatactctccagttccattttacagacgatgacgggataccgtattcagaaacccgctacattgccttctttgaggatggcacgcagacccacggagaaacggatgaagaggggtatacagagcgtttttttgtatctagcaaacatgaaattaaagtgaagttgctatttgcgaatgatgattttctctcaatggaaggacactatggacgataa

SEQ ID NO: 3316 - protein, 801 aa, Escherichia coli
MSLKGLRFTLEVDGQEPDTFAVVSFRLIQNQSYPFVMSVDVASDSFMQTAEMLLEKNATLTIWQGVIPLRYVTGVVAGFGMQENNGWQMRYHLRIEPPLWRCGLRRNFRIFQQQDIRTISATLLNENGVTEWTPLFYEDHPAREFCVQYGESDLAFLARLWAEEGIFFFERFAADSPEQKLTLCDDVAGLSQAGELPFNPDTSAGAETECVSMFRYEAHVRPSSVQSQDYTFKVPDWPGMYEQQGESLNGQLEQYEIFDYPGRYKDEQHGKDFTLYRMESLRSDAEKATGQSNSPKLWPGTWFTLTGHPQKMLNREWQVVQSILSGDQPQALHGSQGRGTTLGNQLEVIPADRTWRPRLQSKPKVDGPQSAIVTGPAGEEIFCDEHGRVRVKFHWDRYHGMTEESSCWVRVSQAWAGPGFGNLAIPRVGQEVIVDFLNGDPDQPLVMGRTYHEDNRSPGDLPGTKTQMTIRSKTYKGSGFNELRFEDATDKEQVYIHAQKNMDTEVLNDRTTDVKHDHTETIGNDQKITVVKGQTVQVGTRKEGGHDQSITVANDRCITVRNDQTLQVTNDRTVSVSNDDGLYVRNDRKVTVEGKQEHKTTGNHVSLVEGKHSLVVKGDLARKVSGALGIKVDGDIVLESSSRISLKVGGSFVVIHSGGVDIVGPKISLNSGGSPGTPVPALQPTVLKTLGDEKSGDGSDSGEENEDSGGNCVTGSGGDDRGDDEDEPEKYTLQFHFTDDDGIPYSETRYIAFFEDGTQTHGETDEEGYTERFFVSSKHEIKVKLLFANDDFLSMEGHYGR

SEQ ID NO: 3317 - DNA, 285 bp, Escherichia coli
atgcctttagcagccaaacttaccgacaaaggcacccagcacgacggttattacgagaccgtcatcaccgccgggtcatccaccgtttttatcgatggtctccccgcagcccgtcagggagatccgctgacgccgcatgctaaaccgaagcatccacctcatccccgaaaaatcgccagaggctcgtcaaccgtctttattgacggcctgcccgccgccagaaccggtgatgctattgactgcggcggcgtggttattggtggcggcacggtaaatataggctga

SEQ ID NO: 3318 - protein, 94 aa, Escherichia coli
MPLAAKLTDKGTQHDGYYETVITAGSSTVFIDGLPAARQGDPLTPHAKPKHPPHPRKIARGSSTVFIDGLPAARTGDAIDCGGVVIGGGTVNIG

SEQ ID NO: 3319 - DNA, 411 bp, Escherichia coli
atgacggagacagcggcgattgcattgatggttctcgatcgtcgcccggaccttgcgccacctcttgggcgcgccgaacgtcaacagtttcaacggctattggtctggctggttgctaatgtctatccaacgttcactttcgccgattaccctaagcgttgggcatctgacgcacctgtaattgaatatcgcaaatcgctttatatctggctgaattcgcaattgactgctgaaccgtatgtgtttggagagcaactaacgctggtggactgttatctctgcaccatgcgcacatggggaccgggacacgaatggtttcaggataatgccccgaatattaatgcgattgctgatgctgtatgtcagataccgaaattacaagaagtattaaaaaggaatgtcattatttaa

SEQ ID NO: 3320 - protein, 136 aa, Escherichia coli
MTETAAIALMVLDRRPDLAPPLGRAERQQFQRLLVWLVANVYPTFTFADYPKRWASDAPVIEYRKSLYIWLNSQLTAEPYVFGEQLTLVDCYLCTMRTWGPGHEWFQDNAPNINAIADAVCQIPKLQEVLKRNVII

SEQ ID NO: 3321 - DNA, 177 bp, Escherichia coli
atgattaaggtgtatggcgtacccggctggggctctacaatcagtgagctgatgctaacactggctgatattccttatcagttcgttgatgtcagtggttttgaccacgagggaacttcacgcgatttattaaaaaccctgaatccgttgtgtcaggttccgacactggcgctgtaa

SEQ ID NO: 3322 - protein, 58 aa, Escherichia coli
MIKVYGVPGWGSTISELMLTLADIPYQFVDVSGFDHEGTSRDLLKTLNPLCQVPTLAL

SEQ ID NO: 3323 - DNA, 1500 bp, Escherichia coli
atgagtaaacacaacaccgacacttcagatcaacacgccgcgaaacgccgctggcttaatgcccacgaagaggggtatcacaaagcgatgggcaatcgccaggtacagatgatcgccattggcggcgcgattggtacgggtttgtttttaggcgcgggagcgcgactgcaaatggcggggcccgcactggcactggtctatttgatctgcggcctgttttcgttttttattctgcgtgcattgggtgagctggtgttacaccgcccttccagtggcagttttgtctcttatgcccgtgagtttttgggtgagaaggccgcttatgttgctggctggatgtacttcatcaactgggcgatgacggggattgttgatattaccgccgtcgctctgtatatgcattactggggcgcgtttggcggcgtgccgcagtgggtctttgcgctcgctgcactgaccatcgttggcaccatgaatatgatcggtgtgaaatggtttgcggagatggagttctggtttgcgcttattaaagtgctcgccattgtaacctttttggtcgtgggtacagtgttcctcggtagtggtcagccgctggatggcaacaccactggctttcatttaatcaccgataatggcggcttcttcccccacggtttgctgcctgcgctggtgttgattcagggcgtagtgtttgcttttgcctccattgaaatggtgggtacagcggccggagaatgtaaagatccgcagaccatggtgcctaaagcgattaacagtgtgatttggcgtattggtctgttttacgtcggctccgtggtgttgctggttatgttattgccgtggagcgcgtatcaggcggggcaaagtccgttcgtgacgtttttctctaaactgggtgtgccgtacatcggcagcattatgaacattgtggtgctgaccgctgccctctccagcctgaattcaggtctgtactgcaccgggcgtattctgcgctcgatggcgatgggcggttccgcaccgagttttatggcgaaaatgagtcgtcagcatgtgccgtatgccgggattctggcgacactggttgtgtatgtcgtcggcgtattcctcaactatctggtgccgtcacgcgtatttgagattgtgttgaacttcgcgtcgctgggaatcatcgcttcatgggcgtttatcatcgtttgccagatgcgcctgcgtaaagcgattaaagaaggcaaagcagcggatgtcagttttaaactgcctggcgcgcccttcacttcctggctgacattactgtttttactgagtgtcctggtgctgatggcgttcgattacccgaacgggacttataccatcgcggcgctgccgattatcggtattctgctggttataggttggtttggtgtgcgcaaacgcgttgctgaaattcacagcactgcgccagtcgtcgaggaagatgaagaaaaacaggaaattgtgtttaagcctgaaacatcgagttaa

SEQ ID NO: 3324 - protein, 499 aa, Escherichia coli
MSKHNTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETSS

SEQ ID NO: 3325 - DNA, 1062 bp, Escherichia coli
atgcatttacgtcatctgttttcatcgcgcctgcgtggttcattactgttaggttcattgcttgttgcttcatcattcagtacgcaggccgcagaagaaatgctgcgtaaagcggtaggtaaaggtgcctacgaaatggcttatagccagcaagaaaacgcgctgtggcttgccacttcgcaaagccgcaaactggataaaggcggcgtggtttatcgtcttgatccggttactctggaagtgacgcaggcgatccataacgatctcaagccgtttggtgccaccatcaataacacgactcagacgttgtggtttggtaacaccgtaaatagtgcggtcacggcgatagatgccaaaacgggcgaagtgaaaggtcgtctggtgctggatgatcgtaagcgcacggaagaggtacgcccgttgcaaccacgtgagctggtagctgatgatgccacgaacaccgtttacatcagtggtattggtaaagagagcgtgatttgggtcgttgatggcgagaatatcaaactgaaaaccgccatccagaacaccggtaaaatgagtaccggtctggcgctggatagcaaaggcaaacgtctttacaccactaacgctgacggcgaattgattaccatcgacaccgccgacaataaaatcctcagccgtaaaaagctgctggatgacggcaaagagcacttctttattaacatcagccttgataccgccaatgagcgtgcatttatcaccgattctaaagcggcagaagtgttagtggtcgatacccgtaatggcaatattctggcgaaggttgcggcaccggaatcactggctgtgctgtttaacccagcgcgtaatgaagcctacgtgacgcatcgtcaggcaggtaaagtcagtgtgattgacgcgaaaagctataaagtggtgaaaacgttcgatacgccgactcatccgaacagcctggcgctgtctgccgatggcaaaacgctgtatgtcagtgtgaaacaaaaatccactaaacagcaggaagctacccagccggacgatgtgattcgtattgcgctgtaa

SEQ ID NO: 3326 - protein, 353 aa, Escherichia coli
MHLRHLFSSRLRGSLLLGSLLVASSFSTQAAEEMLRKAVGKGAYEMAYSQQENALWLATSQSRKLDKGGVVYRLDPVTLEVTQAIHNDLKPFGATINNTTQTLWFGNTVNSAVTAIDAKTGEVKGRLVLDDRKRTEEVRPLQPRELVADDATNTVYISGIGKESVIWVVDGENIKLKTAIQNTGKMSTGLALDSKGKRLYTTNADGELITIDTADNKILSRKKLLDDGKEHFFINISLDTANERAFITDSKAAEVLVVDTRNGNILAKVAAPESLAVLFNPARNEAYVTHRQAGKVSVIDAKSYKVVKTFDTPTHPNSLALSADGKTLYVSVKQKSTKQQEATQPDDVIRIAL

SEQ ID NO: 3327 - DNA, 2103 bp, Escherichia coli
atgaagattttttccgtccgacagaccgttttgcccgcactgcttgtcctttcccccgttgtttttgccgctgatgaacagaccatgattgtcagtgccgcaccgcaggtggtttcagaactggataccccagcagccgtgagcgtggtggatggcgaggagatgcgcctggcaacaccgcgcattaacttgtctgaatcactgaccggagtgcctggtttacaggtacaaaaccggcagaactatgcgcaagatttacagctgtcgattcgcggatttggctcccgctccacttacggaattcgcggtattcgcctgtatgtggacggtattcccgctaccatgcccgacggacaagggcaaacatctaacatcgatttaagcagtgtgcaaaatgtggaagtgctgcgtggccccttctctgctctgtatggcaacgcgtctggcggtgtaatgaatgtcaccacccagaccggacaacagccaccaaccattgaagccagtagttactacggcagttttggcagctggcgctatgggctgaaagctacgggcgcaacgggcgacggcacacaacccggcgatgtcgattacaccgtctcaaccacacgttttacgacccatggctatcgtgaccatagcggcgcacagaaaaatttagccaatgccaaactgggcgtacgcattgatgacgccagcaaattaagcctgattttcaatagtgtggatatcaaagcagatgacccaggtgggctaaccgaagcagaatggaaggcgaatccacaacaagcgcctcgtgcagaacagtacgacacgcgaaaaaccatcaagcaaactcaggctgggttgcgctatgaacgtagcctgagcgcgcaagatgatatgagtgtaatgatgtatgccggagagcgagaaacgacccagtaccagtcaatccccatggccccgcaacttaacccgtcacatgcgggcggcgtgattaccctgcaacgccattaccaggggatagacagccgctggacacaccgtggtgaattgggcgttccagtcacgttcacaaccggcctgaactacgaaaacatgagtgaaaaccgcaagggttacaataacttccgcctgaatcgcggcgtgccggaatacgggcaaaaaggtgagttgcgccgcgacgaacgcaatttgatgtggaacgtcgatccctatttacaaacccagtggcaactgaccgacaaactttcgctggatgctggcgtgcgctacagctccgtgtggtttgattccaatgatcattacgttactccgggtaacggcgacgacagcggtgatgccagttatcacaaatggctaccagccggatcgttaaaatatgcaatgaccgatgcctggaatgtctatctggcagcagggcgcggttttgaaacgccgacgattaatgaactgtcttatcgcgctgatggacaaagcggtatgaactttgggttaaaaccctccaccaacgatacaattgagatcggcagtaaaacgcgtattggtgatggactgcttagtctcgcattgttccagaccgacaccgatgatgaaattgttgtcgatagcagtagcggtgggcgtacgacttacaaaaatgccggaaagacccgtcgtcaaggggctgaactggcatgggatcaacgtttcgcgggagattttcgcgtaaaagcgtcctggacctggcttgatgcgacctatcgcagcaatgtttgcaatgaacaggattgtaacggtaaccggatgccagggatcgcccgtaatatggcctttgcgtcgataggttatataccggaagatggttggtatgcaggcacggaagctcgttatatgggcgatattatggcagatgatgaaaatacggccaaagcgccttcttatacactcgtcggcttattcaccgggtataaatacaattaccacaatttaaccgtggatttatttggtcgtgtcgataatttattcgataaagaatacgttggttctgtcattgtcaatgagtcaaacgggcgatattacgaacctgcgcccggacgaaattatggtgtcggcataaatattgcgtggcgatttgagtaa

SEQ ID NO: 3328 - protein, 700 aa, Escherichia coli
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMAFASIGYIPEDGWYAGTEARYMGDIMADDENTAKAPSYTLVGLFTGYKYNYHNLTVDLFGRVDNLFDKEYVGSVIVNESNGRYYEPAPGRNYGVGINIAWRFE

SEQ ID NO: 3329 - DNA, 237 bp, Escherichia coli
atgttgggttctgtccttgcgtccgcatggcgcgccggttccttacgtctggtttcggtaaatgtgctctttgtcgcaccagcgcaagcatttacagttccggaagtgggaaaacgtcaattaaatgaaatcaatcggatccgctacgaactggaattaatggcagttgctctggctgtcgaaaacctcactatgcaaaaaaacgttgctatgttgtgccagcaatacagccgataa

SEQ ID NO: 3330 - protein, 78 aa, Escherichia coli
MLGSVLASAWRAGSLRLVSVNVLFVAPAQAFTVPEVGKRQLNEINRIRYELELMAVALAVENLTMQKNVAMLCQQYSR

SEQ ID NO: 3331 - DNA, 582 bp, Escherichia coli
ttgcttcgggctgttttcgatagtattgataacatcatcatcattattttatcgaggccagacatgtccatccgttttgcccgcaaagccgactgtgctgcaattgcggaaatttataatcacgccgtgttgtatacggcggctatctggaatgaccaaacggtggatgcggataaccgcattgcctggtttgaagcgcggaccatagcaggttatccggtgctggtgagtgaagaagatggcgtagtgacgggatatgcctcgtttggcgactggcgtagttttgatggttttcgccataccgtggaacattcggtttatgtccatcccgatcatcaggggaaaggtctggggcgtaaattgttaagccgattgattgatgaagcgcgggattgcgggaagcatgtcatggtcgccgggatcgaatcgcaaaatcaggcctcgctgcatctgcaccagtcgctgggatttgtcgtcaccgcgcaaatgccgcaggtaggtactaaatttgggcgctggctggatctgacatttatgcagttgcaactcgacgagcgcactgaaccggacgcgatcggatga

SEQ ID NO: 3332 - protein, 193 aa, Escherichia coli
MLRAVFDSIDNIIIIILSRPDMSIRFARKADCAAIAEIYNHAVLYTAAIWNDQTVDADNRIAWFEARTIAGYPVLVSEEDGVVTGYASFGDWRSFDGFRHTVEHSVYVHPDHQGKGLGRKLLSRLIDEARDCGKHVMVAGIESQNQASLHLHQSLGFVVTAQMPQVGTKFGRWLDLTFMQLQLDERTEPDAIG

SEQ ID NO: 3333 - DNA, 450 bp, Escherichia coli
atgaatcagtcacttacccttgcctttttgattgcagccgggattggtctggtagtccagaacacgctgatggtgcgcatcacccagacctcctctaccattctcatcgccatgttgctgaactcactggtggggattgtgctctttgtttctattttatggtttaaacaaggcatggcggggtttggcgaactggtgtccagcgtgcgctggtggacacttatacctggcttgctgggatcgttttttgtcttcgccagtatcagcggatatcagaatgtgggagcggcgacaactattgcagtactggtcgccagccagctgattggcggtctggtgctggatatcttccgcagccatggcgtaccacttcgggcgttgatcggcccaatttgtggcgcaattttacttgtggttggcgcctggctggtggccagacgctcattttaa

SEQ ID NO: 3334 - protein, 149 aa, Escherichia coli
MNQSLTLAFLIAAGIGLVVQNTLMVRITQTSSTILIAMLLNSLVGIVLFVSILWFKQGMAGFGELVSSVRWWTLIPGLLGSFFVFASISGYQNVGAATTIAVLVASQLIGGLVLDIFRSHGVPLRALIGPICGAILLVVGAWLVARRSF

SEQ ID NO: 3335 - DNA, 234 bp, Escherichia coli
atgtcgcatctggatgaagtcatcgcgcgcgtggatgccgcgattgaagagagcgtcattgcccatatgaacgaattattaatcgccctgagcgatgacgcggagttaagtcgggaagatcgctacacccagcagcagcgtttgcgcaccgctattgctcatcacggtcgcaaacataaagaagatatggaagcgcgccacgaacagttaaccaaaggcggtaccatcctctga

SEQ ID NO: 3336 - protein, 77 aa, Escherichia coli
MSHLDEVIARVDAAIEESVIAHMNELLIALSDDAELSREDRYTQQQRLRTAIAHHGRKHKEDMEARHEQLTKGGTIL

SEQ ID NO: 3337 - DNA, 249 bp, Escherichia coli
gtgaaaaaacttgatgcacgtcaaaaaatgacgcatatttgcgcgcgttttattcatctggctggacgcccgtacatgtctctctatcaacatatgcttgttttttatgcggttatggcagcaatcgcatttcttatcacctggtttctttctcacgataagaaacgcatccgtttcttaagcgcctttctggtgggggcaacatggccgatgagtttcccggtggcgctgttgttttctctgttttaa

SEQ ID NO: 3338 - protein, 82 aa, Escherichia coli
MKKLDARQKMTHICARFIHLAGRPYMSLYQHMLVFYAVMAAIAFLITWFLSHDKKRIRFLSAFLVGATWPMSFPVALLFSLF

SEQ ID NO: 3339 - DNA, 117 bp, Escherichia coli
ttggctggtttatttgatgtagtgattttgcacgcagcacgtactgtcagagaaatcagtgctctgacagtacgcaagatcatctcatactcttacgatctgcaatattatccttaa

SEQ ID NO: 3340 - protein, 38 aa, Escherichia coli
MAGLFDVVILHAARTVREISALTVRKIISYSYDLQYYP

SEQ ID NO: 3341 - DNA, 1425 bp, Escherichia coli
atgcaacataagttactgattaacggagaactggttagcggcgaaggggaaaaacagcctgtctataatccggcaacgggggacgttttactggagattgccgaggcatccgcagagcaggtcaatgctgctgttcgcgcggcagatgcagcatttgccgaatgggggcaaaccacgccaaaagcgcgtgcggaatgcctgctgaaactggctgatgttatcgaagaaaatggtcaggtttttgccgaactggagtcccgtaattgtggcaaaccgctgcatagcgcgttcaatgatgaaattccggcgattgtcgatgtctttcgctttttcgccggtgcggcgcgctgcctgaatggtctggcggcaggtgaatatcttgaaggtcatacttcgatgatccgtcgcgatccgttgggggtcgtggcttctatcgcaccgtggaattatccgctgatgatggctgcgtggaaactggctccggcgctggcggcagggaactgcgtagtgcttaaaccatcagaaattaccccgctgaccgcgttgaagttggcagagctggcgaaagatatcttcccggctggcgtgattaacgtgctgtttggcagaggcaagacggtgggagatccgctgaccggacatcccaaagtgcggatggtgtcgctgacgggttctatcgccactggggaacacatcatcagccataccgcgccgtccattaagcgtactcatatggaacttggtggcaaagcgccagtgattgtttttgatgatgcggatattgaagcagtggtcgaaggtgtacgtacttttggctattacaatgccggacaggattgtactgcggcttgtcggatctacgcgcaaaaaggcatttacgatacgctggtggaaaaactcggtgctgcggtggcaacgttaaaatcgggttcgccggatgacgagtctacggagcttggacctttaagctcgctggcgcatctcgaacgcgtcagcaaggcggtagaagaggcgaaagcgacagggcacatcaaagtgatcactggcggtgaaaagcgcaagggtaatggctattactatgcgccgacgctgctggctggcgcattacaggacgatgccatcgtgcaaaaagaggtatttggtccggtagtgagtgttacgctcttcgacaacgaagaacaggtggtgaactgggcgaatgacagtcagtacggacttgcatcttcggtatggacgaaagatgtgggcagggcgcatcgcgtcagcgcgcggctgcaatatggttgtacctgggtcaatacccatttcatgctggtaagtgaaatgccgcacggtgggcagaaactttctggttacggcaaggatatgtcactttatgggctggaggattacactgtcgtccgccacgtcatggttaaacattaa

SEQ ID NO: 3342 - protein, 474 aa, Escherichia coli
MQHKLLINGELVSGEGEKQPVYNPATGDVLLEIAEASAEQVNAAVRAADAAFAEWGQTTPKARAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINVLFGRGKTVGDPLTGHPKVRMVSLTGSIATGEHIISHTAPSIKRTHMELGGKAPVIVFDDADIEAVVEGVRTFGYYNAGQDCTAACRIYAQKGIYDTLVEKLGAAVATLKSGSPDDESTELGPLSSLAHLERVSKAVEEAKATGHIKVITGGEKRKGNGYYYAPTLLAGALQDDAIVQKEVFGPVVSVTLFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 3343 - DNA, 795 bp, Escherichia coli
atgcactctgaacgcgcaccgtttttcctcaaactggcggcctggggcggcgtggttttcctacattttcccatcctgattatcgctgcctatgcgtttaacactgaagatgcggcgtttagttttccaccgcaaggcctgacgctgcgctggtttagcgtggcagcacagcgtagtgatatccttgattccgtgacactgtcacttaaagtggcggcgctggcgacattaatcgcgctggtgttagggacgctggcagctgccgcgctgtggcgacgagactttttcggcaaaaacgccatttcgctgttactgttgctgcccattgcgctgccgggcattgtcactggtctggcgctattaaccgcctttaaaaccatcaatctggagccaggatttttcaccatcgtggtcggtcatgcgactttttgcgtagtggtggtgtttaacaatgtcatcgcccgttttcgccgcacctcgtggagtctggttgaggcgtcaatggatcttggggccaatggctggcaaaccttccgctacgtagtgttgccgaatctcagttcggcgttactggctggaggaatgctggcgtttgccttgtcgttcgatgaaatcatcgtgacgacttttacggcaggtcatgaacgaacgttaccgttgtggttgctcaatcagcttgggcgaccgcgtgatgtcccggtaaccaacgtggtggcactgctggttatgttggtaacaaccttgccgatcctgggggcctggtggctaacccgcgaaggcgacaatggtcaataa

SEQ ID NO: 3344 - protein, 264 aa, Escherichia coli
MHSERAPFFLKLAAWGGVVFLHFPILIIAAYAFNTEDAAFSFPPQGLTLRWFSVAAQRSDILDSVTLSLKVAALATLIALVLGTLAAAALWRRDFFGKNAISLLLLLPIALPGIVTGLALLTAFKTINLEPGFFTIVVGHATFCVVVVFNNVIARFRRTSWSLVEASMDLGANGWQTFRYVVLPNLSSALLAGGMLAFALSFDEIIVTTFTAGHERTLPLWLLNQLGRPRDVPVTNVVALLVMLVTTLPILGAWWLTREGDNGQ

SEQ ID NO: 3345 - DNA, 942 bp, Escherichia coli
atggcgatgaacgtattgcaatcaccttcacgtccaggtctgggtaaggtgcccggtttcttctggcgtaatccggggctggggctgtttttgctgctgcttggcccgctaatgtggtttggcattgtctatttcggctcgctgctgacgctgttatggcagggcttttatacctttgacgatttcaccatgtcggtaacgccggaactgacgctggcgaatatccgtgcgctgtttaatccggcgaattacgacatcattgtccgcacgctgaccatggctgtggcggtgactatcgccagcgccattctggcttttccaatggcgtggtatatggcgcgctataccagcggaaaaatgaaagcgtttttttatattgcggtaatgttgccgatgtgggcgagctacattgttaaagcctatgcctggacgttattgctggcaaaagatggcgtggcgcagtggtttttacaacatctggggctggaaccactgctgactgcgttcctcacgctaccggcggtgggcggcaatacgctgtcaacttccgggctggggcgctttctggtgtttctctatatctggttgccgttcatgatcctcccggtgcaggcggcgcttgagcgtttgccgccgtcattgttgcaggcgtcggctgatcttggcgcacgtccacgacaaacctttcgctatgtggtgctgccgctggcaatcccgggtattgccgctggctctatctttaccttctcactcacgctgggcgattttattgtcccgcagctggttggccctccaggatattttatcggcaatatggtttattcccagcagggggcgattggcaatatgccgatggcggcggcattcaccctggtgccgattgttctcatcgcactctatctggcgtttgtgaaacgtctgggagcgttcgatgcactctga

SEQ ID NO: 3346 - protein, 313 aa, Escherichia coli
MAMNVLQSPSRPGLGKVPGFFWRNPGLGLFLLLLGPLMWFGIVYFGSLLTLLWQGFYTFDDFTMSVTPELTLANIRALFNPANYDIIVRTLTMAVAVTIASAILAFPMAWYMARYTSGKMKAFFYIAVMLPMWASYIVKAYAWTLLLAKDGVAQWFLQHLGLEPLLTAFLTLPAVGGNTLSTSGLGRFLVFLYIWLPFMILPVQAALERLPPSLLQASADLGARPRQTFRYVVLPLAIPGIAAGSIFTFSLTLGDFIVPQLVGPPGYFIGNMVYSQQGAIGNMPMAAAFTLVPIVLIALYLAFVKRLGAFDAL

SEQ ID NO: 3347 - DNA, 1014 bp, Escherichia coli
atgacgtacgcagtggagtttgacaacgtctcacggttgtacggtgacgtgcgcgcagtaaatggcgtcagtattgcgataaaagatggtgagttcttctctatgctggggccgtccggctccggcaaaaccacttgcctgcgcctgattgctggattcgaacagctttccggcggggctatctctatttttggtacgcccgccagcaatctgccaccgtgggagcgggacgtgaatactgtcttccaggactacgcgctatttccgcatatgtcgattcttgacaacgtagcctacgggctgatggtcaaaggcgtgaataaaaagcagcggcacgcaatggcgcaagaggcgcttgagaaagtggcgttggggtttgtacagcaacgtaaaccgtcacaactttctggtggtcagcgccagcgagtcgccatcgccagagcactggtgaacgaaccgcgtgtgttgttgctggatgaaccgctcggcgcgctggatctcaaattgcgcgagcaaatgcagcttgagctgaaaaagctgcaacagtctctcggtatcacttttatcttcgttacccacgatcagggcgaagcgttatcgatgtccgatcgggtggcggttttcaataatggacgcattgaacaggtcgattctccgcgcgatctctatatgcgcccgcgcacgccgtttgttgcgggattcgttgggacatcgaatgtttttgatggactgatggcagagaaactttgtggcatgacgggaagcttcgcactacgaccggaacatatccgcctcaacacccctggagaaatgcaggctaatggcacgatccaggcggtgcagtatcagggcgcggcaactcgttttgaactgacactgagcggcggtgaaaaactgctggtgagtcaggccaatatgacaggcgaagaactgcctgccacgctcacgcccggacaacaggtgatggtttcctggtcgcgtgatgtgatggtggcgctggttgaggagaggtga

SEQ ID NO: 3348 - protein, 337 aa, Escherichia coli
MTYAVEFDNVSRLYGDVRAVNGVSIAIKDGEFFSMLGPSGSGKTTCLRLIAGFEQLSGGAISIFGTPASNLPPWERDVNTVFQDYALFPHMSILDNVAYGLMVKGVNKKQRHAMAQEALEKVALGFVQQRKPSQLSGGQRQRVAIARALVNEPRVLLLDEPLGALDLKLREQMQLELKKLQQSLGITFIFVTHDQGEALSMSDRVAVFNNGRIEQVDSPRDLYMRPRTPFVAGFVGTSNVFDGLMAEKLCGMTGSFALRPEHIRLNTPGEMQANGTIQAVQYQGAATRFELTLSGGEKLLVSQANMTGEELPATLTPGQQVMVSWSRDVMVALVEER

SEQ ID NO: 3349 - DNA, 1146 bp, Escherichia coli
atgagcaagacatttgcccgcagcagcctgtgtgcgctcagcatgacaataatgaccgctcacgccgccgaaccgcctaccaatttagagaatccggaagggcgactggatattatcgcctggccgggatacatcgaacgcggacaaactgataaacagtacgactgggtaacgcaattcgaaaaagagacaggctgcgcggtgaatgttaaaaccgccgcgacttccgatgaaatggtcagtctgatggtcaaagggggttacgatctggttacggcatccggcgatgcctcgctgcgtttgattatgggcaaacgcgtgcagccaattaataccgccttgattcccaactggaaagcgctcgatccgcgcgtggttaaaggcgactggtttaacgttggcggcaaagtttacggcacaccttaccaatgggggccgaacctgctgatgtacatcactaaaaccttcccgacgccgccggatagctggcaagtggtttttgttgagcagaatctgccggacggcaagagcaataaaggccgggtacaggcttatgatggccctatctacattgcggatgccgcgttgttcgtcaaagccacgcagccacagttgggcatcagcgatccgtatcaactcaccgaagaacagtatcaggcggtgctgaaagtgctgcgcgatcaacatagtttgatccatcgctactggcatgacactaccgtgcaaatgagcgatttcaaaaacgagggtgtggttgcttccagtgcatggccctatcaggccaacgccctgaaagccgaaggccagcctgtcgctaccgttttcccgaaggagggcgttaccggttgggctgacaccaccatgctacatagcgaagcgaaacatccggtttgcgcctacaaatggatgaactggtcattaaccccaaaagtgcagggcgatgtggcggcctggtttggctcgttaccagtagtgccgcaagggtgtaaagccagtccgttattaggcgagaaaggttgtgaaacaaacggttttaactatttcgataaaatcgccttctggaaaacgcctatagcagaagggggcaagtttgttccctacagtcgctggacgcaggattacattgccattatgggcggtcgctaa

SEQ ID NO: 3350 - protein, 381 aa, Escherichia coli
MSKTFARSSLCALSMTIMTAHAAEPPTNLENPEGRLDIIAWPGYIERGQTDKQYDWVTQFEKETGCAVNVKTAATSDEMVSLMVKGGYDLVTASGDASLRLIMGKRVQPINTALIPNWKALDPRVVKGDWFNVGGKVYGTPYQWGPNLLMYITKTFPTPPDSWQVVFVEQNLPDGKSNKGRVQAYDGPIYIADAALFVKATQPQLGISDPYQLTEEQYQAVLKVLRDQHSLIHRYWHDTTVQMSDFKNEGVVASSAWPYQANALKAEGQPVATVFPKEGVTGWADTTMLHSEAKHPVCAYKWMNWSLTPKVQGDVAAWFGSLPVVPQGCKASPLLGEKGCETNGFNYFDKIAFWKTPIAEGGKFVPYSRWTQDYIAIMGGR

SEQ ID NO: 3351 - DNA, 1407 bp, Escherichia coli
atgaaaaaataccagcagcttgcagaacaattacgcgagcagattgcgtcgggtatctggcaacccggcgatcgtttgccttcgttgcgtgaccaggtggcgctttctggcatgagctttatgactgtcagccatgcctatcagttgctcgaaagtcagggatatattatcgcgcgaccgcaatcgggttattacgttgcgccacaggcaataaaaatgccgaaagcgacagtcattccagtcacacgagatgaagcagtcgatatcaacacctatatttttgatatgttgcaggccagtcgcgatccgtcggtagttccgtttgcctcggcctttcccgacccgcgacttttccccctccaacaactaaaccgctcgctggcgcaggtaagcaaaaccgccacggcgatgagcgtgattgaaaacttaccgccaggaaacgtagaactgcgtcaggctattgctcgtcgctatgccttacagggcatcaccatttcacctgatgaaattgtcattaccgccggggcgttagaggcattaaacctcagtttgcaagcggtaactgaaccgggcgattgggtgatagtagagaatccttgtttctacggcgcgttgcaggcgctggagcggttacggctgaaggcgttatcggtagcgacggatattaaagaagggatcgatcttcaggcgctggaactggcgttgcaggagtatccggtgaaagcgtgctggctgatgactaatagccagaacccacttggatttaccttaacgccgcagaaaaaagtgcggctggtagcgttgctcaatcagtacaacgtaacgctgattgaagatgacgtttatagcgaactttattttggacgggaaaaaccgctgcctgcgaaagcgtgggatcgccacgatggtgttttgcattgctcttcgttttcgaaatgtctggtgcctggttttcgtattggttgggtcgccgccggaaaacatgcacgtaaaattcaacgcttgcagttgatgagtacgctttccaccagctcaccgatgcagcttgcgctggtggattacctttctactcgccgatacgatgctcatcttcgtcgcctgcgtcgccagcttgcggaacgtaaacaacgcgcctggcaggctttgctgcgttatctgcctgcggaagtcaaaattcatcacaatgacagcggttattttctctggctggagctccccgagccgttagatgcaggagaattaagcctggtggcactgacgcatcatatcagtattgcgccgggtaatatgttttctaccggtgaaaactggtcacgtttttttcgttttaataccgcgtggcagtggggagaacgtgaagaacaggcggtaaaacaattaggcaaacttattcaagaacggctgtaa

SEQ ID NO: 3352 - protein, 468 aa, Escherichia coli
MKKYQQLAEQLREQIASGIWQPGDRLPSLRDQVALSGMSFMTVSHAYQLLESQGYIIARPQSGYYVAPQAIKMPKATVIPVTRDEAVDINTYIFDMLQASRDPSVVPFASAFPDPRLFPLQQLNRSLAQVSKTATAMSVIENLPPGNVELRQAIARRYALQGITISPDEIVITAGALEALNLSLQAVTEPGDWVIVENPCFYGALQALERLRLKALSVATDIKEGIDLQALELALQEYPVKACWLMTNSQNPLGFTLTPQKKVRLVALLNQYNVTLIEDDVYSELYFGREKPLPAKAWDRHDGVLHCSSFSKCLVPGFRIGWVAAGKHARKIQRLQLMSTLSTSSPMQLALVDYLSTRRYDAHLRRLRRQLAERKQRAWQALLRYLPAEVKIHHNDSGYFLWLELPEPLDAGELSLVALTHHISIAPGNMFSTGENWSRFFRFNTAWQWGEREEQAVKQLGKLIQERL

SEQ ID NO: 3353 - DNA, 204 bp, Escherichia coli
gtgcctttgagcgtcgcctctaaggtattgctgttaaatgcttttttacagtcagaaatcactcagcaagagttagcccggcgaattggcaaacataaacaggagattactcgcctatttaatttgcaccatgcgacaaaaatcgacgccgtccagctcgcggctaatgcgcttggcaaagagttatcgctggtgatggtttga

SEQ ID NO: 3354 - protein, 67 aa, Escherichia coli
MPLSVASKVLLLNAFLQSEITQQELARRIGKHKQEITRLFNLHHATKIDAVQLAANALGKELSLVMV

SEQ ID NO: 3355 - DNA, 231 bp, Escherichia coli
atgttttcgaaggcgttatcggttgtcttattaacgtgtgcactgttctcaggacaactcatggcagggcacaaaggacatgaatttatgtgggtaaagaatgtggatcatcagttgcgtcatgaagcggacagcgatgaattgcgtgctgtggcggaagagtcggcggaaggtttgcgcgagcatttttactggcaaaaatcgcgcaaaccagaagcgggacagcgttga

SEQ ID NO: 3356 - protein, 76 aa, Escherichia coli
MFSKALSVVLLTCALFSGQLMAGHKGHEFMWVKNVDHQLRHEADSDELRAVAEESAEGLREHFYWQKSRKPEAGQR

SEQ ID NO: 3357 - DNA, 2004 bp, Escherichia coli
gtggctaaaatagccgccatttttcagctactggataagaaagtgaccgtatcttctcatcgtcttgaactgttaagcccggcacgcgatgccgccattgcccgcgaagctattttgcacggtgccgatgctgtttatatcggcggccctggttttggtgcccgtcataatgccagtaatagcctgaaagatattgccgagttggtgccgtttgcccatcgttatggtgcaaaaattttcgtcacgcttaacaccattttgcatgatgatgagctggaacccgcgcaacggctgattactgacctctaccagaccggtgtcgatgcgctgattgttcaggatatggggattctggaacttgatattccgccgattgaactgcacgccagtacgcagtgcgatattcgtacagtagaaaaagcgaagttcctctctgatgttggcttcacgcagattgtgctggcgcgagagctgaatcttgagcagatccgcgcgattcaccaggccacggacgcgaccattgaattctttattcatggcgcattgtgcgtggcctattcgggtcagtgctacatttctcatgcgcaaacagggcgtagcgccaaccgtggcgattgctcgcaggcgtgccgtttgccatacacattgaaagacgatcaggggcgggtggtttcctatgaaaaacatctgctgtcgatgaaagataacgatcagactgccaacctcggcgcgctgattgatgctggcgtacgctccttcaagattgaagggcgttacaaagatatgagctacgtgaagaatatcaccgcccattatcgtcagatgctggatgccattattgaagaacgtggcgatctggcgcgcgcttcatcaggtcgtactgaacatttctttgttccatcgacggaaaagactttccaccgtggtagcacagattattttgtgaatgcccgtaaaggcgatattggcgcgttcgattcgccgaaatttatcggcctgccggtgggcgaagtattgaaagtagcgaaagatcatattgatgttgccgttaccgagccactggcaaatggcgatggcctgaacgtgatgattaaacgtgaagtcgtcggttttcgtgccaatacggtagagaaaaccggagaaaatcagtaccgcgtctggcccaatgaaatgccagcagatttgcacaaaattcgcccgcatcacccactaaaccgtaatcttgatcataactggcagcaggcactgacaaaaacctccagcgaacgtcgggtggcggtagacattgaactgggcggctggcaggaacaactgattctgaccctcaccagtgaagagggtgtcagcatcacacatacgctggacgggcagttcgacgaagccaataacgccgaaaaagcaatgaacaatctgaaggatggtctggcaaaactggggcaaaccatctattacgcccgcaatgtgcaaattaatttgccgggggcgctgtttgtaccaaacagtctgttaaaccagttccgccgtgaagccgccgatatgcttgatgctgcgcgtcttgccagttaccagcgcggcagccgtaaaccggttgctgatcctgcgccagtttatccgcaaacgcatctgagtttcctcgcgaacgtatacaaccagaaagcgcgtgaattttatcatcgctatggtgtgcaactgattgacgcggcgtatgaggcacatgaagagaagggcgaagtcccggtgatgatcaccaagcattgtctgcgctttgccttcaatctgtgcccgaaacaggcgaaaggcaatatcaaaagctggaaggcgacgccaatgcaactggttaacggcgatgaagtattaacgctaaagtttgattgccgcccatgcgagatgcacgtcattggcaaaatcaaaaatcacatactgaaaatgccgttaccgggaagcgtagtggcatccgtaagtccggatgatctgctgaaaacattgccgaagcgaaaagggtaa

SEQ ID NO: 3358 - protein, 667 aa, Escherichia coli
MAKIAAIFQLLDKKVTVSSHRLELLSPARDAAIAREAILHGADAVYIGGPGFGARHNASNSLKDIAELVPFAHRYGAKIFVTLNTILHDDELEPAQRLITDLYQTGVDALIVQDMGILELDIPPIELHASTQCDIRTVEKAKFLSDVGFTQIVLARELNLEQIRAIHQATDATIEFFIHGALCVAYSGQCYISHAQTGRSANRGDCSQACRLPYTLKDDQGRVVSYEKHLLSMKDNDQTANLGALIDAGVRSFKIEGRYKDMSYVKNITAHYRQMLDAIIEERGDLARASSGRTEHFFVPSTEKTFHRGSTDYFVNARKGDIGAFDSPKFIGLPVGEVLKVAKDHIDVAVTEPLANGDGLNVMIKREVVGFRANTVEKTGENQYRVWPNEMPADLHKIRPHHPLNRNLDHNWQQALTKTSSERRVAVDIELGGWQEQLILTLTSEEGVSITHTLDGQFDEANNAEKAMNNLKDGLAKLGQTIYYARNVQINLPGALFVPNSLLNQFRREAADMLDAARLASYQRGSRKPVADPAPVYPQTHLSFLANVYNQKAREFYHRYGVQLIDAAYEAHEEKGEVPVMITKHCLRFAFNLCPKQAKGNIKSWKATPMQLVNGDEVLTLKFDCRPCEMHVIGKIKNHILKMPLPGSVVASVSPDDLLKTLPKRKG

SEQ ID NO: 3359 - DNA, 537 bp, Escherichia coli
atggaaaatctcgctcgctttttatccaccacacttaaacaactacgtcagcagcgcggctggagtctttcgcgactggcagaagcgacgggcgtttctaaagcgatgttagggcagattgagcgtaatgaatccagcccgacggtcgcgacattatggaaaattgccaccgggttgaacgtgccattttcaacatttatttccccgccgcagtccgctacaccttcagtttatgatccacaacggcaggcgatggtgatcacttcgctgtttccttatgatccacaactctgctttgaacacttctcgattcagatggcacccggtgcaataagcgaatcgacgccccatgaaaagggggtaatcgaacatgtcgtcgtcattgatggacaacttgatctgtgtgttgatggtgaatggcagagccttaattgtggggaaggcgttcgatttgctgcagacgtcacgcatgtctatcgtaatggtggagagcaaaccgtacattttcattccctcatccattacccgcgcagttaa

SEQ ID NO: 3360 - protein, 178 aa, Escherichia coli
MENLARFLSTTLKQLRQQRGWSLSRLAEATGVSKAMLGQIERNESSPTVATLWKIATGLNVPFSTFISPPQSATPSVYDPQRQAMVITSLFPYDPQLCFEHFSIQMAPGAISESTPHEKGVIEHVVVIDGQLDLCVDGEWQSLNCGEGVRFAADVTHVYRNGGEQTVHFHSLIHYPRS

SEQ ID NO: 3361 - DNA, 1197 bp, Escherichia coli
  n 1170, 1171, 1172, 1173, 1174: n is any nucleotide
gtggtggataaaaagcgagcgagattttccatgcgactcctccggcaaaacggaagtttatcacttgtgcgttataacggacaaatgctacggtacctgtacgttataacgcacgaggtgactatgcgtctgttttctattcctccacccacgctactggcggggtttctggcggtattaattggctacgccagttcagcggcaataatctggcaagcagcgattgtcgccggagccaccactgcacaaatctctggctggatgacggcgctggggctggcaatgggcgtcagtacgctggctctgacattatggtatcgcgtacctgttctcaccgcatggtcaacgcctggcgcggctttgttggtcaccggattgcagggactaacacttaacgaaaccatcggcgtttttattgtcaccaacgtgttaatagtcctctgcggcataacgggactctttgctcgtctgatgcgcattattccgcactcgcttgcggcggcaatgcttgccgggattttattacgttttggtttacaggcgtttgccagtctggatggtcaatttacgttgtgtggcagtatgttgctggcatggctggcaaccagggccgttgcgccgcgctatgcggtaattgccgcgatgattattgggatcgtgatcgttatcgcgcaaggtgacgttgtcacaactgatgttgtctttaaacccgttctccccacttatattccccctgatttttcgtttgctcacagtctgagcgttgcactccccctttttctggtgacgatggcatcgcaaaacgcaccgggtatcgcagcaatgaaagcagccgggtattcggctcctgtttcgccgttgattgtgtttactggattgctggcgcttgttttttcccctttcggcgtttattccgtcggtattgcggcaatcaccgcggctatttgccaaagcccggaagcgcatccggataaagatcaacgttggctggccgctgccgttgccggcattttttatttgatcgcaggtctgtttggtagtgccattaccgggatgatggctgccctgcccgtaagttggatccagatgctggcaggtcttgcgctgttgagtaccattggcggcagtttgtatcaggcgctgcataatgagcgtgagcgcgacgcggcnnnnncattccattcattaattaattaa

SEQ ID NO: 3362 - protein, 398 aa, Escherichia coli
  Xaa 391, 392: Xaa is any amino acid
MVDKKRARFSMRLLRQNGSLSLVRYNGQMLRYLYVITHEVTMRLFSIPPPTLLAGFLAVLIGYASSAAIIWQAAIVAGATTAQISGWMTALGLAMGVSTLALTLWYRVPVLTAWSTPGAALLVTGLQGLTLNETIGVFIVTNVLIVLCGITGLFARLMRIIPHSLAAAMLAGILLRFGLQAFASLDGQFTLCGSMLLAWLATRAVAPRYAVIAAMIIGIVIVIAQGDVVTTDVVFKPVLPTYIPPDFSFAHSLSVALPLFLVTMASQNAPGIAAMKAAGYSAPVSPLIVFTGLLALVFSPFGVYSVGIAAITAAICQSPEAHPDKDQRWLAAAVAGIFYLIAGLFGSAITGMMAALPVSWIQMLAGLALLSTIGGSLYQALHNERERDAAXXFHSLIN

SEQ ID NO: 3363 - DNA, 330 bp, Escherichia coli
  n 312, 313, 314, 315, 316: n is any nucleotide
atgcgtaccacatcatttgcgaaagttgcagctttatgcggcttgttggctctgtctggttgtgcctctaaaatcacccagccagataaatattctggttttttaaacaattactctgatttaaaagaaacaacctcggcaacaggtaaacctgttttacgttgggtagacccgagttttgatcaaagcaaatatgacagcatcgtctggaacccaatcacttattatccggtaccgaaaccttctacccaggtagggcagaaagttctggataaaattttgaactataccaacaccgaaatgaaagaagcnnnnncattcattcattaa

SEQ ID NO: 3364 - protein, 109 aa, Escherichia coli
  Xaa 105, 106: Xaa is any amino acid
MRTTSFAKVAALCGLLALSGCASKITQPDKYSGFLNNYSDLKETTSATGKPVLRWVDPSFDQSKYDSIVWNPITYYPVPKPSTQVGQKVLDKILNYTNTEMKEAXXFIH

SEQ ID NO: 3365 - DNA, 594 bp, Escherichia coli
atgatcattcgtgatgaaaactattttactgataaatatgaattaacccgcacacactctgaagtgctggaagcggtgaaagtggttaaaccgggtaaaacgctggatctgggctgtggcaatggtcgtaacagtctttacctggcagccaatggttatgatgttgacgcatgggataaaaatgccatgagtatcgccaacgtcgagcgcattaagtccattgaaaatctggataatttacacacccgggtcgttgatctgaataacctcacatttgatggacagtacgattttattctttctactgtggtgctgatgttccttgaggctaaaaccatcccagggctgattgccaatatgcaacgttgcactaaacctggcggttacaacctgattgtggcggcgatggataccgctgattatccatgtaccgtcggcttcccgtttgccttcaaagagggggaattacgtcgatattacgaaggctgggagagggtgaaatacaatgaagacgtcggcgagctgcaccgcaccgacgccaacggtaatcgtattaaactgcgtttcgccacgatgctggcacgtaaaaaatga

SEQ ID NO: 3366 - protein, 197 aa, Escherichia coli
MIIRDENYFTDKYELTRTHSEVLEAVKVVKPGKTLDLGCGNGRNSLYLAANGYDVDAWDKNAMSIANVERIKSIENLDNLHTRVVDLNNLTFDGQYDFILSTVVLMFLEAKTIPGLIANMQRCTKPGGYNLIVAAMDTADYPCTVGFPFAFKEGELRRYYEGWERVKYNEDVGELHRTDANGNRIKLRFATMLARKK

SEQ ID NO: 3367 - DNA, 1101 bp, Escherichia coli
gtgacttactataaccgtagcaaattctgcggctctggctatgctcgagaaaattccataaaatgcatttcaaatatactttataaattaaacaaaatgagtaagaagatgcagagcgataaagtgctcaatttgccggcaggctactttggtattgtgttggggacgatagggatgggatttgcctggcgctatgccagccagctttggcaggtcagccactggttgggtgatgggctggtgattctggcgatgatcatctggggattattgactggcgcatttattacccgactcatacgctttccgcatagcgtgctggcagaagtgcgccatccagtgctgagcagttttgtgagtttgtttccggcaacgacgatgctggtggcgattggttttgttccgtggtttcgcccactggcggtgtgcctgttcagttttggtgtcgtggttcagttggcttatgccgcatggcaaactgcgggattatggcgcggatctcaccctgaagaagctaccacgcctggactgtatctgccgacagttgccaacaactttatcagcgcaatggcctgtggtgcgttgggctacaccgacgccggtctggtgtttttaggcgcaggcgttttctcatggctaagcctggaaccggtgatcttgcagcgtctgcgcagttcgggagaattacccacggcactgcggacatcactcggcattcagctcgctcctgcgctggtggcctgtagtgcctggctgagcgtcaacggcggcgagggtgacacgctggcgaaaatgcttttcggttatggactgctgcaactgctgtttatgctacgtctgatgccatggtatctctcccagccatttaatgcttcattctggagtttctcgttcggtgtatctgcactggcaaccaccggtttgcatctggggagtggcagcgataatggatttttccatacgctggcggtgccgctgtttatctttaccaattttattattgcaatactgctcatccgtacttttgcgcttctgatgcagggaaaattgttagtcagaaccgagcgcgccgttttaatgaaagcagaggacaaagaatga

SEQ ID NO: 3368 - protein, 366 aa, Escherichia coli
MTYYNRSKFCGSGYARENSIKCISNILYKLNKMSKKMQSDKVLNLPAGYFGIVLGTIGMGFAWRYASQLWQVSHWLGDGLVILAMIIWGLLTGAFITRLIRFPHSVLAEVRHPVLSSFVSLFPATTMLVAIGFVPWFRPLAVCLFSFGVVVQLAYAAWQTAGLWRGSHPEEATTPGLYLPTVANNFISAMACGALGYTDAGLVFLGAGVFSWLSLEPVILQRLRSSGELPTALRTSLGIQLAPALVACSAWLSVNGGEGDTLAKMLFGYGLLQLLFMLRLMPWYLSQPFNASFWSFSFGVSALATTGLHLGSGSDNGFFHTLAVPLFIFTNFIIAILLIRTFALLMQGKLLVRTERAVLMKAEDKE

SEQ ID NO: 3369 - DNA, 540 bp, Escherichia coli
atgactgaaacgataaaagtaagcgaatcacttgaattacatgctgttgcggaaagtcatgtcacacctctttatcagttaatctgtaaaaataaaacctggttacagcagtcgctaaactggccgcagtttgttcaaagtgaagaggacacgcgaaaaacggtgcagggtaatgtgatgttgcatcaacgcggctatgccaaaatgttcatgattttcaaagaagatgaacttatcggcgttatctcttttaatcgtattgaaccactgaataaaaccgctgaaatcggctactggctggacgaatctcatcaggggcaggggatcatttctcaggcgctgcaggcattgattcatcattacgctcagtctggtgaacttagacgcttcgtgatcaaatgtcgggtggacaatccgcaaagcaaccaggtagcgttgcgcaatggttttatccttgaaggttgccttaaacaggctgagttcctgaatgatgcctatgatgatgtgaacttatacgcgcgtattatcgattcacaataa

SEQ ID NO: 3370 - protein, 179 aa, Escherichia coli
MTETIKVSESLELHAVAESHVTPLYQLICKNKTWLQQSLNWPQFVQSEEDTRKTVQGNVMLHQRGYAKMFMIFKEDELIGVISFNRIEPLNKTAEIGYWLDESHQGQGIISQALQALIHHYAQSGELRRFVIKCRVDNPQSNQVALRNGFILEGCLKQAEFLNDAYDDVNLYARIIDSQ

SEQ ID NO: 3371 - DNA, 981 bp, Escherichia coli
atgcgtaaatatcgtctaagtgaagaacagcgagcctttagttatcaggaagatggcactaaaaaaagtgtgttattacggcaaattatcgccatgagcgattttaacgatgtgatagcaggaagcgctggcggctggatcgatcacgaaacggtgttagcacaggaaggaaattgctggatttacgaccagaatgctattgcgttcggcggaacggtgatttccgggaatacgcgtatcaccggcaccagcgtgctgtggggagaggtttacgcaacggataatgtctggatcgataatagtgaaatcagccagggtgcatatataagtgacagtgtcaccattcgtgactcattagtttgtggtcaatgtagaatatttggtcacgccttaattgatcaacattctatgatcgtcgccgcacaaggcttaacgcccgaccatcaactcctgctacaaatttatgatcgcgcaaaggttagcgcctcgcgtattgtccaccaggcacaaatttatggcgatgccgtcgtccggtatgcttttattgaacatcgcgccgaagtttttgattttgccagtgttgaaggtaatgaagagaacaacgtctggctatgcgattgcgctaaagtctacggtcacgcgcaggtgaaagctggcatagaagaagatgccattccgacgattcattacagttcacaggtggcggaatatgccattgtggaaggtaattgtgtgttaaaacatcatgtcttgattggcggaaatgccgtggtacgtggcggaccgattctgctcgacgagcacgttgtcatacaaggtgagagccgtattacaggtgcggtgataattgaaaaccatgtggagttaactgaccacgccgtcgttgaagcctttgatggcgacacgattcatgtccgtggtccaaaagtcattaacggcgaggagcgcattacgcgaacgctgctggcagggttattgtga

SEQ ID NO: 3372 - protein, 326 aa, Escherichia coli
MRKYRLSEEQRAFSYQEDGTKKSVLLRQIIAMSDFNDVIAGSAGGWIDHETVLAQEGNCWIYDQNAIAFGGTVISGNTRITGTSVLWGEVYATDNVWIDNSEISQGAYISDSVTIRDSLVCGQCRIFGHALIDQHSMIVAAQGLTPDHQLLLQIYDRAKVSASRIVHQAQIYGDAVVRYAFIEHRAEVFDFASVEGNEENNVWLCDCAKVYGHAQVKAGIEEDAIPTIHYSSQVAEYAIVEGNCVLKHHVLIGGNAVVRGGPILLDEHVVIQGESRITGAVIIENHVELTDHAVVEAFDGDTIHVRGPKVINGEERITRTLLAGLL

SEQ ID NO: 3373 - DNA, 225 bp, Escherichia coli
atgtttccagaataccgagatttaatatcccgtctgaaaaacgaaaatcctcgctttatgtccttgttcgataaacacaataaacttgatcatgaaattgccagaaaggaaggttccgacggtcgagggtacaatgcggaagtggtccgcatgaaaaaacaaaagctacagttaaaagatgagatgctcaaaatcctgcagcaggtgagcgtcaaagaggtgtaa

SEQ ID NO: 3374 - protein, 74 aa, Escherichia coli
MFPEYRDLISRLKNENPRFMSLFDKHNKLDHEIARKEGSDGRGYNAEVVRMKKQKLQLKDEMLKILQQVSVKEV

SEQ ID NO: 3375 - DNA, 1656 bp, Escherichia coli
atggatcgtagacgatttattaaaggttcaatggctatggccgccgtgtgcggtaccagcggcattgcttctcttttttctcaggcggcattcgcggccgattctgatattgccgacgggcaaacccagcgttttgacttctccattctacagtcaatggcgcacgacttagcgcaaacagcatggcgtggtgcaccacgtccgttacctgacactttggcgacaatgacgccgcaggcttataacagtattcaatacgacgccgaaaaatcgctctggcataacgttgagaaccgtcaactggacgctcagtttttccatatgggaatgggattccgtcgccgcgttcgtatgttttctgtagatccagcaacacatctggcgcgtgaaattcactttcgcccggagttgttcaaatacaacgatgcgggtgtggataccaaacaattagaagggcaaagcgatctcggttttgccggttttcgcgtgtttaaagcccccgaactggcgcgccgtgatgtagtatcattcctcggcgcgagttatttccgcgccgttgatgacacatatcaatacggtttgtcggcccgcggcctggcgatcgacacttacaccgacagcaaagaagagttccccgactttaccgccttctggtttgatacggtaaaaccaggggcaaccacctttaccgtttatgcgttgctcgatagcgccagcattactggtgcctataagttcactatccattgtgagaaaaatcaggtgattatggatgtggaaaatcacctgtatgcgcgcaaagacattaaacagctgggcattgcgccgatgaccagtatgttcagctgcggtactaatgaacgtcggatgtgcgacaccattcatccgcaaatccatgactctgatcgtctgtccatgtggcggggcaacggcgagtggatttgccgtccgctgaacaatccgcaaaaattgcagttcaatgcttacaccgacaacaacccgaaagggtttggtttattgcaactggatcgtgatttctcccattatcaggacattatgggctggtataacaaacgcccaagtctgtgggtggaaccgcgtaacaagtggggtaagggcaccatcggcctgatggaaatcccaacaacgggcgaaacgctggataacattgtctgcttctggcagccagaaaaagctgtaaaagcgggtgatgagtttgcattccagtatcgtctgtactggagtgcgcaaccgcctgttcattgcccattagcgcgcgttatggcgacgcgtaccggcatgggcggtttcccggaaggttgggcgccaggtgaacactatcccgaaaaatgggcgcgacgttttgccgtcgatttcgttggtggtgatctgaaagctgccgcgccaaaaggcattgagccggtgattacgctttccagtggggaagcgaagcaaatcgaaattctctatattgaacccattgatggttatcgtattcagtttgactggtatccgacttcggactccactgatccggtcgatatgcggatgtatctgcgttgtcagggcgacgctatcagtgaaacatggctgtatcagtatttcccgccagcgccggataaacgtcagtatgttgatgaccgcgtgatgagttaa

SEQ ID NO: 3376 - protein, 551 aa, Escherichia coli
MDRRRFIKGSMAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKNQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 3377 - DNA, 1344 bp, Escherichia coli
atggcgaacagcatcacggcggatgagattcgggaacagttttcgcaggcaatgtcagccatgtaccagcaagaagttccgcagtacggcacgctgctggaactggtagctgatgtaaatctggcggtgctggaaaacaatcctcaactgcacgaaaaaatggtaaatgcagacgagctggcgcgactgaatgttgaacgtcatggggcgattcgcgttgggactgcacaagagcttgctactcttcggcggatgtttgccattatggggatgtacccggtgagctattacgatctctcgcaggcaggggtgccggtacattcgacagcatttcggcccattgatgatgcttctctggcgcgtaatcccttccgcgtttttacctcgttactccgtcttgagcttatcgagaacgaaattttgcgccagaaagcggcggagattctgcgtcagcgcgatatcttcaccccacgttgtcgacaactgttagaggaatatgagcagcagggcggttttaacgaaacacaggcacaggagtttgtgcaggaagccctggaaacgtttcgctggcaccagtcagcaacggtagatgaagaaacctatcgcgccttgcacaacgaaaatcggttgattgctgatgtggtctgttttcctggatgccatatcaaccatctgacgccacgtacgctggatattgaccgggtgcagtcgatgatgcctgaatgcggaattgaacccaaagttctgatcgaagggccgccgcgccgcgaggtgccgattttactacgccagaccagctttaaagcactggaagagacggtgttgtttgcggggcagaaacagggcacgcataccgcgcgctttggtgaaattgagcagcgtggtgtggcattaacgccgaaagggcgacaactgtatgatgatcttctgcggaacgctggaaccgggcaggataatctcactcaccaaatgcatttacaggaaaccttccgcacttttcctgacagtgagtttttaatgcgtcagcaagggctgggatggttccggtaccgtctgacgccttcgggtgaggcgcatcgtcaggtgattcatcccggagacgatccacagcccttaatagaacgtggttgggtagtggcgcaacccattacctatgaagatttcttgcccgttagcgcggcggggatcttccagtcaaatctgggtaatgaaacgcgggcatgcaatcacggtgatgccagtcgcgaagcatttgagcaggcgttggggtgtccggttttggatgagttccagctttatcaggaagcggaagaacgcagtaaacgtcgctgtggtttgctttaa

SEQ ID NO: 3378 - protein, 447 aa, Escherichia coli
MANSITADEIREQFSQAMSAMYQQEVPQYGTLLELVADVNLAVLENNPQLHEKMVNADELARLNVERHGAIRVGTAQELATLRRMFAIMGMYPVSYYDLSQAGVPVHSTAFRPIDDASLARNPFRVFTSLLRLELIENEILRQKAAEILRQRDIFTPRCRQLLEEYEQQGGFNETQAQEFVQEALETFRWHQSATVDEETYRALHNENRLIADVVCFPGCHINHLTPRTLDIDRVQSMMPECGIEPKVLIEGPPRREVPILLRQTSFKALEETVLFAGQKQGTHTARFGEIEQRGVALTPKGRQLYDDLLRNAGTGQDNLTHQMHLQETFRTFPDSEFLMRQQGLGWFRYRLTPSGEAHRQVIHPGDDPQPLIERGWVVAQPITYEDFLPVSAAGIFQSNLGNETRACNHGDASREAFEQALGCPVLDEFQLYQEAEERSKRRCGLL

SEQ ID NO: 3379 - DNA, 1065 bp, Escherichia coli
gtgatctcgccgcgaaaacatcaatattatccattttgctgtaacatagttgctttaattgttaataatattttgcaatcaagttatcataataaaacaacttcacttgtcagcgacaccgcttcgtttttaacatcgcttatggaaaaaaatagtctgtttagtcagcgcatccgtttgcgccaccttcatacattcgtagctgtcgcacaacaaggaactttggggcgcgcggctgaaacccttaatttgagtcaacctgcgctctctaagacattgaatgaactggagcagctgacgggcgctcgcttgtttgagcgtggtcgtcagggggcgcaacttaccttacccggcgaacaatttttaacgcatgcagtcagagttcttgacgccatcaacactgccggacagtcgcttcatcgtaaagaaggtcttaataatgatgtcgtcagggttggtgcgctacctactgcggcactagggatattaccttcggttataggtcagtttcatcagcaacaaaaagagacgaccttgcaagttgcgacaatgagtaaccctatgattctggcgggtttaaaaaccggggaaatcgatatcggcattggtcggatgtcagatcctgaactgatgaacgggcttaattatgaactgctgtttcttgaatcgctgaagctggttgtccgccccaatcacccgctacttcaggagaacgtaacgctaagccgggtgctggaatggccggtcgttgtatcaccagaaggcactgcgccacgccagcattcagatgcattagtgcagagccagggatgtaaaattccttcgggttgtatcgaaacgctgtctgcttcgctatctcgtcaacttacggttgaatacgattacgtgtggtttgtcccttctggcgctgtaaaagacgacctgcgtcatgccacgctggtggccctgcctgttccgggtcatggtgcaggcgaaccgattggaatactgacccgcgtagatgcgacgttctcttctggttgccagttgatgattaacgctattcgaaaatcaatgccgttctga

SEQ ID NO: 3380 - protein, 354 aa, Escherichia coli
MISPRKHQYYPFCCNIVALIVNNILQSSYHNKTTSLVSDTASFLTSLMEKNSLFSQRIRLRHLHTFVAVAQQGTLGRAAETLNLSQPALSKTLNELEQLTGARLFERGRQGAQLTLPGEQFLTHAVRVLDAINTAGQSLHRKEGLNNDVVRVGALPTAALGILPSVIGQFHQQQKETTLQVATMSNPMILAGLKTGEIDIGIGRMSDPELMNGLNYELLFLESLKLVVRPNHPLLQENVTLSRVLEWPVVVSPEGTAPRQHSDALVQSQGCKIPSGCIETLSASLSRQLTVEYDYVWFVPSGAVKDDLRHATLVALPVPGHGAGEPIGILTRVDATFSSGCQLMINAIRKSMPF

SEQ ID NO: 3381 - DNA, 471 bp, Escherichia coli
gtgaatgtcagaatcgtgttactctcgcaaggccctggatttgccgttgtcgccagcgaagtacggacactcgcaagccgcagcgcccaggcggcgaaagagattgaaggcttgatcagtgaatcagtcagattaattgacctgggatcggatgaggtggcaacggcagggaaaatcatgtgcactattgttgatgccgtcgcgagtgtcacacatatcatgcaggaaatcgccaccgcctcgggtgaacaaagtcgaggcataacgcaggttagccaggcgatttctgaaatggataaggtgacgcaacagaatgcttctctggtagaagaggcctcaacggcagcggtgtcccttgaagaacaggcggcacgactaactgaggcggtggacgtattccgtctcaacaaacattctgtgtcggcagaacctcgcggagcttgtgaaccagttagttttgctacggtgtga

SEQ ID NO: 3382 - protein, 156 aa, Escherichia coli
MNVRIVLLSQGPGFAVVASEVRTLASRSAQAAKEIEGLISESVRLIDLGSDEVATAGKIMCTIVDAVASVTHIMQEIATASGEQSRGITQVSQAISEMDKVTQQNASLVEEASTAAVSLEEQAARLTEAVDVFRLNKHSVSAEPRGACEPVSFATV

SEQ ID NO: 3383 - DNA, 102 bp, Escherichia coli
acgattctgacattcacactgacccgacaatcgctctacgaactgcggttccgggacggtgataaggaagttgctgcgctcatggcctgcacgtccaggtaa

SEQ ID NO: 3384 - protein, 33 aa, Escherichia coli
TILTFTLTRQSLYELRFRDGDKEVAALMACTSR

SEQ ID NO: 3385 - DNA, 174 bp, Escherichia coli
atgaaaaaactggcacttatcctggttatgggaacgcttgtttccttttatgccgatgccgggcgcaaaccctgttctggttcgaaaggggggatctcacactgtacggcaggcggcaaatttgtctgtaatgatggttctattagtgcatcgaaaaaaacatgcactaactga

SEQ ID NO: 3386 - protein, 57 aa, Escherichia coli
MKKLALILVMGTLVSFYADAGRKPCSGSKGGISHCTAGGKFVCNDGSISASKKTCTN

SEQ ID NO: 3387 - DNA, 531 bp, Escherichia coli
atgggaaataaatactcaaggttacaaatcagcattcactggctggtctttttgctggttatcgtagcgtattgcgcaatggagtttcgtggtttcttcccacgtagcgatcggcccctcatcaacatgattcatgtttcctgtggcatctcaattctcgtactgatggtggttcgtcttttgttaaggctgaaatgcccaaccccgccgattatacctaagccaaaaccgatgatgacgggactggcgcatttgggccatttggtgatttatctcctgtttattgcgctgccagtgattggtttggtgatgatgtataaccggggcaacccgtggtttgcgtttggtttgacgatgccttacgcttcagaggccaatttcgaacgggttgatagcttaaagtcgtggcatgaaacgctggcgaatctgggatattttgtcatcgggttgcacgctgcggctgcactggcacaccactatttctggaaggacaacacacttctacgcatgatgccgcgtaaacgttcctga

SEQ ID NO: 3388 - protein, 176 aa, Escherichia coli
MGNKYSRLQISIHWLVFLLVIVAYCAMEFRGFFPRSDRPLINMIHVSCGISILVLMVVRLLLRLKCPTPPIIPKPKPMMTGLAHLGHLVIYLLFIALPVIGLVMMYNRGNPWFAFGLTMPYASEANFERVDSLKSWHETLANLGYFVIGLHAAAALAHHYFWKDNTLLRMMPRKRS

SEQ ID NO: 3389 - DNA, 1002 bp, Escherichia coli
atgagtaaagttggtattaatggttttggtcgtatcggtcgactggtgttgcgtcgattacttgaagtcaaaagcaacatagacgttgtcgctattaatgatctcacttccccaaaaattctcgcctacctgctgaaacatgattcaaactacggaccgttcccctggagcgttgattatacggaagattcacttatcgttaatgggaaaagtatcgcggtttacgccgaaaaagaggctaaaaatattccgtggaaagcgaaaggcgcagaaatcattgtcgaatgtacaggcttttatacctccgccgagaaatcgcaggcgcatcttgatgctggcgcgaagaaggtgttgatttccgcccctgccggtgaaatgaaaaccatcgtttataacgtcaatgacgacactctggatggcaacgacaccattgtttccgtggcgtcatgcaccactaactgccttgcgccgatggccaaagccttgcatgacagtttcgggatagaagtcggcacgatgacaaccattcatgcctataccggcacccagtcactggtggatggcccacgtggtaaagatttacgtgcttcacgcgcagcggcagaaaatatcattccccacactacgggggcggcaaaagccattggtctggtgatcccggaactgagcggcaaactgaaaggtcatgcgcaacgcgtgccggtgaaaacaggttcggtcactgaactggtgtcgattctcggaaagaaagtgactgccgaagaggtgaacaacgcgcttaaaaaggcgacaaacaataacgagtcatttggttatactgatgaagaaatagtctcttccgatatcattggcagccatttcggttcggtgtttgatgccacgcaaacggaaattaccgccgtgggcgatttacaactggtgaaaacggtcgcctggtacgataacgaatatggcttcgtcacgcagcttattcgcaccctcgaaaaattcgctaaactctga

SEQ ID NO: 3390 - protein, 333 aa, Escherichia coli
MSKVGINGFGRIGRLVLRRLLEVKSNIDVVAINDLTSPKILAYLLKHDSNYGPFPWSVDYTEDSLIVNGKSIAVYAEKEAKNIPWKAKGAEIIVECTGFYTSAEKSQAHLDAGAKKVLISAPAGEMKTIVYNVNDDTLDGNDTIVSVASCTTNCLAPMAKALHDSFGIEVGTMTTIHAYTGTQSLVDGPRGKDLRASRAAAENIIPHTTGAAKAIGLVIPELSGKLKGHAQRVPVKTGSVTELVSILGKKVTAEEVNNALKKATNNNESFGYTDEEIVSSDIIGSHFGSVFDATQTEITAVGDLQLVKTVAWYDNEYGFVTQLIRTLEKFAKL

SEQ ID NO: 3391 - DNA, 1440 bp, Escherichia coli
atgtcagtacccgttcaacatcctatgtatatcgatggacagtttgttacctggcgtggagacgcatggattgatgtggtaaaccctgctacagaggttgtcatttcccgcattcccgatggtcaggccgaggatgcccgtaaggcaatcgatgcagcagaacgtgcacaaccagaatgggaagcgttgcctgctattgaacgcgccagttggttgcgcaaaatctccgccgggatccgggaacgtgccagtgaaatcagtgcgctgattgtcgaagaagggggcaagatccagcagttggctgaagtcgaagtggcttttactgcggactatatcgattatatggcggagtgggcacggcgttacgagggcgagattattcaaagcgatcgtccaggagaaaatatccttctgtttaaacgtgcgcttggcgtgactaccggcattctgccgtggaactttccgttcttcctcattgcccgcaaaatggctcccgctcttttgaccggtaataccatcgtcattaaacccagtgaatttacgccaaacaatgcgattgcattcgccaaaatcgttgatgaaataggccttccgcgcggcgtgtttaaccttgtactcgggcgtggtgaaaccgttgggcaagaactggcgggtaacccaaaggtcgcaatggtcagtatgacaggcagcgtctctgcaggtgaaaagattatggcgactgcggcgaaaaacatcaccaaagtgtgcctggaattggggggtaaagcaccggctatcgtaatggacgatgccgatcttgaactggcagtcaaagccatcgttgattcacgcgtcattaatagtgggcaagtgtgtaactgtgcagaacgtgtttatgtacagaaaagcatttatgatcagttcgtcaatcggctgggggaagcgatgcaggcggttcaatttggtaaccccgctgaacgcaacgacattgcgatgggaccgttgattaacgccgcggcgctggaaagggttgagcaaaaagtggcgcgcgcagtagaagaaggggcgagagtggcgttgggtggcaaagcggtagaggggaaaggatattattatccgccgacattgctgctggatgttcgccaggaaatgtcgattatgcatgaggaaacctttggcccggttctgccggtggtcgcatttgacacgctggaagaggctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgctggatggcgtaaatccggtattggcggcgcagatggtaaacatggcttgcatgaatatctgcagacccaggtggtttatttacagtcgtaa

SEQ ID NO: 3392 - protein, 479 aa, Escherichia coli
MSVPVQHPMYIDGQFVTWRGDAWIDVVNPATEVVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKSIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEEAISMANDSDYGLTSSIYTQNLNVAMKAIKGLKFGETYINRENFEAMQGFHAGWRKSGIGGADGKHGLHEYLQTQVVYLQS

SEQ ID NO: 3393 - DNA, 801 bp, Escherichia coli
atgaatattaccccgtttccgacgctttcgccggcaaccatagatgccataaatgttatcggacagtggctggcgcaggatgatttctccggtgaggtgccgtatcaggccgattgcgtgatccttgcaggcaatgcggttatgccgactatcgatgcggcatgtaagattgcccgcgatcagcaaattcctttactgattagtggtggtatcggtcactcgacaacttttttgtatagcgccatcgcacagcatccacactacaacactatccgcaccactggcagagctgaagctaccatcctggcggatatcgctcatcagttctggcatattccgcatgaaaaaatctggattgaagaccagtcaacaaactgcggtgaaaacgcacgctttagcatcgcgctattgaatcaggccgtagaacgagttcatacggctatcgttgttcaggaccccaccatgcagcggcgcacgatggcgacgttccgccgtataaccggggataatcccgatgcaccacgctggttaagttatcccggattcgttcctcagttaggaaataacgcagacagtgtaatctttgttaatccgttgcaaggattatggccggttgagcgttatctatcgctactcactggcgagctgccgcgtttacgcgatgatagcgatggctacggcccccgcgggcgagattttatcgttcacgttgattttccggcagaagtcatccaggcatggcaaacgctgaaacacgatgcggtgctcatcgaggcgatggaaagtcgctcgttacgttaa

SEQ ID NO: 3394 - protein, 266 aa, Escherichia coli
MNITPFPTLSPATIDAINVIGQWLAQDDFSGEVPYQADCVILAGNAVMPTIDAACKIARDQQIPLLISGGIGHSTTFLYSAIAQHPHYNTIRTTGRAEATILADIAHQFWHIPHEKIWIEDQSTNCGENARFSIALLNQAVERVHTAIVVQDPTMQRRTMATFRRITGDNPDAPRWLSYPGFVPQLGNNADSVIFVNPLQGLWPVERYLSLLTGELPRLRDDSDGYGPRGRDFIVHVDFPAEVIQAWQTLKHDAVLIEAMESRSLR

SEQ ID NO: 3395 - DNA, 3903 bp, Escherichia coli
atgacagaacaacaaaaattgacctttactgccttgcagcagcggctggattcgctgatgctgcgtgacagactgcgtttttctcgccgtctgcacggcgtgaagaaggttaaaaatcctgatgcacaacaggccattttccaggagatggcgaaagagattgaccatgcggcagggaaagtcctgctgcgtgaagcggcacgaccggagattacttacccggacaatttgccggttagtcagaaaaaacaggacattctcgaagcgattcgtgaccaccaggtggtgatcgtcgccggggaaacgggttccggtaaaacgactcagctaccgaaaatctgtatggagctgggtcgcgggattaaagggctgatcggccatacccagccgcgtcggctggcggcgcgaacggtggcgaaccgtattgcggaagagctaaaaacggagccgggcggttgcatcggttacaaagtgcgtttcagcgatcacgtcagtgataacacgatggtcaagctgatgaccgacggtatcctgctggcagagatccagcaagaccgcctgctgatgcagtacgacaccatcattattgacgaagcgcacgaacgcagcctgaatatcgattttctcctcggctatttgaaagagttgctgccgcggcgtcctgacctaaaaattattatcacttccgcgactatcgacccggaacgcttttcgcgccactttaataatgcgccgattatcgaagtctccggtcggacctatccggtggaagtgcgctatcgcccgattgttgaagaagctgatgacaccgagcgcgaccagttgcaggcgattttcgatgccgtagatgaactgagccaggaaagccctggcgacattctgatttttatgagcggcgagcgagaaattcgcgataccgccgatgcgctgaacaagctgaacttacgccatacggaaattcttccgctttatgcacggctttcgaacagcgagcagaaccgcgtcttccagtcgcacagcggacggcgcattgtgctggcgactaacgtcgcggaaacctcgctgaccgtaccggggattaaatacgttatcgacccaggtacggcgcgtatcagccgctacagctatcgcaccaaagtgcagcgtttgccgattgagccaatttcgcaggcttcagctaatcagcgtaaaggccgctgcggtcgtgtgtcagaagggatctgtattcgtctctattccgaagacgatttcctctcgcgcccggagtttaccgacccagaaattctgcgtactaacctggcctcggttattttgcagatgaccgcactgggcttgggcgatatcgccgcattcccgtttgtcgaagcaccggataaacgcaatatccaggatggcgtgcgtctgctcgaagaactgggcgcgatcaccacggatgaacaggccagcgcctataaactgacgccgctcggtcgccagctctcgcagttgcctgtcgacccacgtctggcgcgtatggtgctggaagcgcaaaaacatggctgcgtgcgtgaggcgatgattatcacttccgcgctctctattcaggacccgcgtgagcggccaatggacaagcagcaggcatcggacgaaaaacatcgtcgcttccacgacaaagagtctgacttcctcgcgtttgtgaatctgtggaattatcttggcgagcagcaaaaggcgctttcttcaaacgccttccgtcgcctgtgccgtactgattatctcaactatctgcgcgtgcgcgaatggcaggatatctacacccagttgcgccaggtggtgaaagaacttggcattccggttaacagcgaaccggcggattatcgcgaaattcacattgcgttgctgaccggtttgctttcgcatatcggcatgaaagatgccgataaacaagaatataccggcgcacgtaacgcgcgtttctccatcttccccggttccggcttattcaaaaaaccgccgaaatgggtaatggtggcggaactggtagaaaccagccgcctgtggggacgcattgctgcgcggatcgacccggaatgggtggagccagttgctcagcatttgattaaacgcacctatagcgaaccgcactgggaacgggcgcagggcgcggtgatggcaacggaaaaagtcactgtttatggtttgccgattgttgccgcgcgcaaggtcaactacagccagatcgatccggcgttatgtcgtgaactctttattcgccacgcgctggtggaaggtgactggcagacgcgtcacgcattcttccgtgaaaacctgaaactacgggccgaagtggaagaactggaacacaaaactcgtcgccgcgatattctggtggatgacgaaacgttgtttgagttctacgaccagcgcatcagccacgatgtgatctccgcacgccatttcgacagctggtggaaaaaagtcagccgcgaaacgcctgatttgctcaactttgaaaagagcatgttgatcaaagaaggggcggaaaaaatcagcaaactggattacccgaacttctggcatcagggcaatctcaaactgcgtttgagctatcagtttgagcccggcgcggatgctgacggtgtgaccgtgcatatcccgctgccgctacttaaccaggttgaggagagtgggtttgagtggcagatccccggtctgcgtcgtgagctgatcatcgccctgattaaatcgctgccgaagccggtacgccgtaattttgtgcccgcgccaaacttcgccgaagcgtttttaggccgcgtcacaccgctggaattgccgttgctcgacagccttgaacgagagttacggcggatgactggcgtcaccgttgaccgcgaagactggcactgggatcaggtgcccgatcacctgaaaatcactttccgcgtggtggatgacaaaaacaagaagctaaaagaagggcgctcattacaggatctgaaagacgccctgaaaggcaaagtgcaggaaacgctgtctgccgtggcggatgacggtatcgagcagagcggtttacatatctggagttttggtcaactgccggaaagctacgagcagaagcgcggcaactacaaagtgaaggcttggccggcgctggtggatgagcgtgacagcgtagcgatcaaactgtttgataacccgctggaacagaagcaggcaatgtggagcggtcttcgccgtttactgctgctaaatattccatcgccgatcaagtacttgcacgaaaagctgccaaacaaagccaagctggggctgtactttaacccgtatggcaaagtgctggagctgatcgatgactgtatctcatgcggtgtggataaattaatcgacgccaacggcggtccggtctggacggaagaaggctttgctgcgctgcatgaaaaagtccgcgctgaactgaacgacacggtggtggatattgcgaagcaggtcgagcaaatcctcactgcggtgttcaatatcaacaaacgtctgaaagggcgggtggatatgaccatggcgctggggctttctgacattaaagcgcagatgggcgggctggtgtatcgcggttttgtcactggtaacggcttcaaacggctgggcgacacgctgcgttatttgcaggcgattgaaaaacgactggaaaaactggcgattgatccacatcgcgaccgtgctcagatgctgaaagtcgaaaacgtccagcaggcgtggcagcaatggatcaacaaactaccgcctgcacgtcgtgaggatgaagacgtgaaagaggtccgctggatgatagaagagctgcgcgttagttacttcgctcaacaacttggcacgccttatccgatttcggataagcgtattttgcaggcgatggagcagattagcggttaa

SEQ ID NO: 3396 - protein, 1300 aa, Escherichia coli
MTEQQKLTFTALQQRLDSLMLRDRLRFSRRLHGVKKVKNPDAQQAIFQEMAKEIDHAAGKVLLREAARPEITYPDNLPVSQKKQDILEAIRDHQVVIVAGETGSGKTTQLPKICMELGRGIKGLIGHTQPRRLAARTVANRIAEELKTEPGGCIGYKVRFSDHVSDNTMVKLMTDGILLAEIQQDRLLMQYDTIIIDEAHERSLNIDFLLGYLKELLPRRPDLKIIITSATIDPERFSRHFNNAPIIEVSGRTYPVEVRYRPIVEEADDTERDQLQAIFDAVDELSQESPGDILIFMSGEREIRDTADALNKLNLRHTEILPLYARLSNSEQNRVFQSHSGRRIVLATNVAETSLTVPGIKYVIDPGTARISRYSYRTKVQRLPIEPISQASANQRKGRCGRVSEGICIRLYSEDDFLSRPEFTDPEILRTNLASVILQMTALGLGDIAAFPFVEAPDKRNIQDGVRLLEELGAITTDEQASAYKLTPLGRQLSQLPVDPRLARMVLEAQKHGCVREAMIITSALSIQDPRERPMDKQQASDEKHRRFHDKESDFLAFVNLWNYLGEQQKALSSNAFRRLCRTDYLNYLRVREWQDIYTQLRQVVKELGIPVNSEPADYREIHIALLTGLLSHIGMKDADKQEYTGARNARFSIFPGSGLFKKPPKWVMVAELVETSRLWGRIAARIDPEWVEPVAQHLIKRTYSEPHWERAQGAVMATEKVTVYGLPIVAARKVNYSQIDPALCRELFIRHALVEGDWQTRHAFFRENLKLRAEVEELEHKTRRRDILVDDETLFEFYDQRISHDVISARHFDSWWKKVSRETPDLLNFEKSMLIKEGAEKISKLDYPNFWHQGNLKLRLSYQFEPGADADGVTVHIPLPLLNQVEESGFEWQIPGLRRELIIALIKSLPKPVRRNFVPAPNFAEAFLGRVTPLELPLLDSLERELRRMTGVTVDREDWHWDQVPDHLKITFRVVDDKNKKLKEGRSLQDLKDALKGKVQETLSAVADDGIEQSGLHIWSFGQLPESYEQKRGNYKVKAWPALVDERDSVAIKLFDNPLEQKQAMWSGLRRLLLLNIPSPIKYLHEKLPNKAKLGLYFNPYGKVLELIDDCISCGVDKLIDANGGPVWTEEGFAALHEKVRAELNDTVVDIAKQVEQILTAVFNINKRLKGRVDMTMALGLSDIKAQMGGLVYRGFVTGNGFKRLGDTLRYLQAIEKRLEKLAIDPHRDRAQMLKVENVQQAWQQWINKLPPARREDEDVKEVRWMIEELRVSYFAQQLGTPYPISDKRILQAMEQISG

SEQ ID NO: 3397 - DNA, 606 bp, Escherichia coli
atgagcaaggtattagttcttaaatccagcatcctggcagggtactctcagtctaatcagttgtccgattattttgttgaacaatggcgcgaaaagcactccgctgatgaaatcaccgtgcgtgacctggctgcaaatccgattccggtcctggatggcgaactggttggtgcactgcgtccgagcgatgcgccgctgactccgcgtcagcaggaagctctggcgctttccgatgagctgattgccgagctgaaagcccacgacgttatcgttattgcggcaccgatgtataacttcaatatctcgacccagttgaaaaactattttgacctggttgcacgtgcaggcgttactttccgctataccgagaacggtccggaaggcctggtcaccggtaaaaaagccatcgttatcaccagccgcggtgggatccataaagatggcccaacggatctggtgacgccgtatctgtccacattcctgggctttatcggcattaccgatgtgaaatttgtcttcgccgaagggatcgcgtacggcccggaaatggcagcgaaagcgcagtctgacgcgaaagcagccatcgacagtattgttgctgcataa

SEQ ID NO: 3398 - protein, 201 aa, Escherichia coli
MSKVLVLKSSILAGYSQSNQLSDYFVEQWREKHSADEITVRDLAANPIPVLDGELVGALRPSDAPLTPRQQEALALSDELIAELKAHDVIVIAAPMYNFNISTQLKNYFDLVARAGVTFRYTENGPEGLVTGKKAIVITSRGGIHKDGPTDLVTPYLSTFLGFIGITDVKFVFAEGIAYGPEMAAKAQSDAKAAIDSIVAA

SEQ ID NO: 3399 - DNA, 1392 bp, Escherichia coli
atgatgccggattcgataaatgcacacaacggattgatgtgtggggcatttttacggtttcgatggcggtgcgtcgtgataactgaacgccggaacgtattgctacaaggagctggctggttattgttgctggccccgtttttcttctttacatatggatttcttaatcagttcaccgcgactcaggatcttaacaaccatgatatccccagtcaggtattcggttgggaaacggcgatcccttttcttccctggactattgttccttactggagtctggatcttttatatggattttcgctgttcatttgtagctcgacattcgaacagcgccgactggttcaccggcttattctggcaacggtaatggcctgctgcggtttttttctctatccgctgaagtttagttttatccgtcctgaagtgagtggggtgacaggatggctattttcgcaacttgaactgtttgatctgccttataaccagtctccttcgctgcatattattctctgctggctactttggcgtcactttcgtcagcatctggctgtgaggtggcgtaaagtctgcggcggatggtttttactcatcgccatttcgacgctgacgacctggcagcatcattttattgatgtcatcacggggctggcggtaggtatgttaattgactggatggtgcccgtcgaccgtcgttggaattatcagaaacctgatcaacgtcgaatcaaaatagcactgccatatgtcgcaggcgcgtgctcgtgcattgtgttgatggagctaatgataatgcttcagttatggtggtcagtctggttatgttggccagtattatcgctattcatcattggccgtgggtacggtgggcttggcgcgataacaacagggaaagatagtcaggggaaactcccgcccgccgtttactggctgacattgccctggcgtatcgggatgtggctgtctatgcgttggttttgtcttcgcctggagccggtgagcaaaattactgctggtgtttatttaggggcgtttccacgacatattccggcacagaatgcggttctggacgtcacctttgaattccctcgcggacgagcgacaaaagatcgactctatttttgtgtaccgatgttggatcgggtggttccggaagagggggagctccgacaggccgtggcgatgctggaaacattacgcgaagagcaaggcagcgttctggtccattgcgcgttgggattatcgcgcagtgcgctggtggtggcggcatggctgttatgttacggacattgtaaaaccgttgatgaagcgattagttatattcgagccagacgctcgcggattgtgcttaaggaagagcacaaagcgatgctgaaattatgggaaaacaggtaa

SEQ ID NO: 3400 - protein, 463 aa, Escherichia coli
MMPDSINAHNGLMCGAFLRFRWRCVVITERRNVLLQGAGWLLLLAPFFFFTYGFLNQFTATQDLNNHDIPSQVFGWETAIPFLPWTIVPYWSLDLLYGFSLFICSSTFEQRRLVHRLILATVMACCGFFLYPLKFSFIRPEVSGVTGWLFSQLELFDLPYNQSPSLHIILCWLLWRHFRQHLAVRWRKVCGGWFLLIAISTLTTWQHHFIDVITGLAVGMLIDWMVPVDRRWNYQKPDQRRIKIALPYVAGACSCIVLMELMIMLQLWWSVWLCWPVLSLFIIGRGYGGLGAITTGKDSQGKLPPAVYWLTLPWRIGMWLSMRWFCLRLEPVSKITAGVYLGAFPRHIPAQNAVLDVTFEFPRGRATKDRLYFCVPMLDRVVPEEGELRQAVAMLETLREEQGSVLVHCALGLSRSALVVAAWLLCYGHCKTVDEAISYIRARRSRIVLKEEHKAMLKLWENR

SEQ ID NO: 3401 - DNA, 1758 bp, Escherichia coli
atggaaaattcacgcatccctggggagcatttttttaccaccagtgataatacagcgttgttttatcggcactggcccactttactgccaggggcgaaaaaggtcatcgtcttatttcatcgcggtcatgaacattctggtcgtctacaacatatcgttgatgaactggcgatgccagatactgctttttatgcatgggatgcccgagggcatggacaaacttcggggccgcgtggttatagtccgtctcttgcgcgttcagtgcaggatgttgatgaatttgtccgttttgctgccagcgacagccaggtcggactggaagaggtggttgtgatcgcgcaaagcgtcggcgcagtgatggttgccacatgggttcatgattatgcgcctgctattcgcggactagtgctggcatctccggcctttaaggttaaattgtatgtgccgctggcacgtcctgggctggcgttatggcatcgtctgcgtggtctgttttttattaattcctatgtgaaagggcgttatctgacccacgatcggcaacgggtggcgagtttcaataatgatccgctgatcacacgggcgattgccgtcaatatcttgctcgatctctataaaacgtctgaacgtattgttagcgatgcggcggcgattacgctccccacgcaacttctgatatcaggcgatgactatgtggtgcatcgccaaccgcagattgatttttatcagcgtttacgtagtcctctgaaagagctgcatctgctgccaggcttttatcacgacacgttgggtgaagagaacagggcgcaggcatttgaaaaaatgcaaagctttatcagccgtttatatgctaacaagtcgcaaaaatttgattatcagcatgaagaccgcacaggaccatcagcggatcgctggcggctcctttctggtggacccgtgccgttatcgccggttgatttggcgtatcgctttatgcgaaaggcgatgaaactgttcggggcgcactctgcgggcctgcatctcggaatgagtaccggctttgattcaggcagttcgctggattatgtctatcaaaatcaaccgcaaggcagtaacgcattcgggcgctttatcgacaaaatctacctgaacagtgttggctggcgcggtattcgccagcgcaaaacccatttacaaatgctgattaaacaagccgttgcccatctccacgccaaaggtttagccgtccgcgtggttgacattgccgcagggcatgggcgctatgtactggatgcgctggcaaacgagcctgccgtaagcgatattttgttacgtgattacagcgagttaaatgttgcacaggggcaagagatgattgctcaacggggaatgtctgggcgggtgcgttttgaacagggcgatgcgtttaacctggaggaactcagcgcgttaactccgcggcctacgctggcgattgtctctggcctgtatgagcttttccccgaaaatgagcaggtaaaaaactcactcgcaggtcttgccaatgccatcgatccgggtggcattctcatctacaccgggcagccgtggcacccacaactggagctgattgccggggtgttaaccagtcataaagatggtaaaccgtgggtaatgcgcgtgcgttcgcaaggggagatggattcgctcgtgcatgatgccggattcgataaatgcacacaacggattgatgtgtggggcatttttacggtttcgatggcggtgcgtcgtgataactga

SEQ ID NO: 3402 - protein, 585 aa, Escherichia coli
MENSRIPGEHFFTTSDNTALFYRHWPTLLPGAKKVIVLFHRGHEHSGRLQHIVDELAMPDTAFYAWDARGHGQTSGPRGYSPSLARSVQDVDEFVRFAASDSQVGLEEVVVIAQSVGAVMVATWVHDYAPAIRGLVLASPAFKVKLYVPLARPGLALWHRLRGLFFINSYVKGRYLTHDRQRVASFNNDPLITRAIAVNILLDLYKTSERIVSDAAAITLPTQLLISGDDYVVHRQPQIDFYQRLRSPLKELHLLPGFYHDTLGEENRAQAFEKMQSFISRLYANKSQKFDYQHEDRTGPSADRWRLLSGGPVPLSPVDLAYRFMRKAMKLFGAHSAGLHLGMSTGFDSGSSLDYVYQNQPQGSNAFGRFIDKIYLNSVGWRGIRQRKTHLQMLIKQAVAHLHAKGLAVRVVDIAAGHGRYVLDALANEPAVSDILLRDYSELNVAQGQEMIAQRGMSGRVRFEQGDAFNLEELSALTPRPTLAIVSGLYELFPENEQVKNSLAGLANAIDPGGILIYTGQPWHPQLELIAGVLTSHKDGKPWVMRVRSQGEMDSLVHDAGFDKCTQRIDVWGIFTVSMAVRRDN

SEQ ID NO: 3403 - DNA, 897 bp, Escherichia coli
atgctggaaaaatctctggcaatactcttcgcgttgttaattttagcaacgctgataaaccgttttctggtatggcggttaccggagagaaaaggcgatgaagtaacattacgtattcgtacctggtggggcatcgtcatttgtttttcactggtgatttcaggtccacgctggatgacgttgacgttttttgcgctgataagttttctggcattgaaagaatattgtacgcttatatccgtacattttccgcgttggttatattgggttattcctcttaactatttgcttatcggttttaattgctttgagctgtttctgttatttatacctttggctgggtttctgatattagccacctggcgagtttttgtaggtgacccctctggttttctgcataccgtgagtgccattttttgtggctggataatgaccgttttcaccttgagtcatgccgcctggttattaatgttgccaaccataaatatccagggcggggcgttactggtgttatttcttttggcgttaaccgagtcaaacgatattgcacagtatttatggggaaaattctgcggcagaagaaaagtggtccccaaagtcagcccgggaaaaacgctggaaggtctggttggaggagtaatcaccaccatgattgcgtcactgattattggaccgttactgacaccgctaaatacattacaggtattattagcgggtttgttaattggtattagtggtttttgcggcgatgtagtgatgtcagccaccaaacgagatgttggtgttaaagatagcggaaaactattaccaggacatggcggactccttgacaggattgactcattaattttcaccgctccggtatttttttattttattcgctactgctgttactga

SEQ ID NO: 3404 - protein, 298 aa, Escherichia coli
MLEKSLAILFALLILATLINRFLVWRLPERKGDEVTLRIRTWWGIVICFSLVISGPRWMTLTFFALISFLALKEYCTLISVHFPRWLYWVIPLNYLLIGFNCFELFLLFIPLAGFLILATWRVFVGDPSGFLHTVSAIFCGWIMTVFTLSHAAWLLMLPTINIQGGALLVLFLLALTESNDIAQYLWGKFCGRRKVVPKVSPGKTLEGLVGGVITTMIASLIIGPLLTPLNTLQVLLAGLLIGISGFCGDVVMSATKRDVGVKDSGKLLPGHGGLLDRIDSLIFTAPVFFYFIRYCCY

SEQ ID NO: 3405 - DNA, 606 bp, Escherichia coli
atgacgctctaccagataaaaccgctctttcagtcgctgttaaggccgacgatgttttggctttataagcaccatgttacagcgaatcacatcactcttgctgcactggcgctttctcttcttaccggattgctgttggtgttggtggcacaacccatcctctttttgctattgcccatcgtgctttttatccgtatgacgctcaatgcgctggatggcatgttggcgcgtgagtgcaatcagaaaacacgtctgggggcgattttgaatgaaactggcgatgttatttccgatattgcgctctatttaccgtttttatttttaccggaaagtaacgcatcactcgtaatactcatgttattttgcaccatattgaccgagttttgcggtttactcgcgcagacgattaacggtattcgtagttatgtcggtccatttggcaaaagcgatcgcgcgttaatatttggtctgtgggggctggccattgccatttatccacaatggatgcaatggaataatcttttatggagcattgcttcaattctgcttctctggactgcgattaatcgttgtcgaagtgtgctcctgatgagcgctgaaagataa

SEQ ID NO: 3406 - protein, 201 aa, Escherichia coli
MTLYQIKPLFQSLLRPTMFWLYKHHVTANHITLAALALSLLTGLLLVLVAQPILFLLLPIVLFIRMTLNALDGMLARECNQKTRLGAILNETGDVISDIALYLPFLFLPESNASLVILMLFCTILTEFCGLLAQTINGIRSYVGPFGKSDRALIFGLWGLAIAIYPQWMQWNNLLWSIASILLLWTAINRCRSVLLMSAER

SEQ ID NO: 3407 - DNA, 861 bp, Escherichia coli
atgagcagcaacacatttactctcggtacaaaatccgttaaccgtcttggttatggcgcgatgcaactggctggtcctggggtttttggccccccaagagatcgccacgtcgctataaccgtgctgcgcgaggcgctggcattgggcgtcaatcatattgataccagcgacttttatggtccgcacgtcaccaatcagattatccgcgaagcgctttatccgtactctgacgacctgacaattgtcactaaaattggtgcgcggcgtggagaggacgcttcctggttacccgcattttctccggcagagctgcaaaaagcggtacacgataatctacgtaatctcggcctggacgtactggatgtggttaacctgcgcgttatgatgggggatggtcatggcccagcggaaggatcgattgaggccagcctgacagtgctggcggagatgcaacaacaaggcctggtaaaacatattggcctgagtaacgtcacaccgacgcaggttgcagaggcgcgaaagattgccgaaatcgtctgcgtgcagaacgaatacaacattgcccaccgtgctgatgacgcaatgattgatgctttggctcgtgatggcattgcctacgtgccattctttccgctcgggggctttacgccgctgcaatcctccacgctttccgatgttgctacgagcctgggtgcaacaccaatgcaggtggcgctggcgtggctgttacaacgttcaccgaatattttgttgattcctggaacatcttctgttgcgcatttacgggagaatatggctgctgaaaaattgcatctttctgagaaagtgttgtctacgttggatggtatttcgcgagaataa

SEQ ID NO: 3408 - protein, 286 aa, Escherichia coli
MSSNTFTLGTKSVNRLGYGAMQLAGPGVFGPPRDRHVAITVLREALALGVNHIDTSDFYGPHVTNQIIREALYPYSDDLTIVTKIGARRGEDASWLPAFSPAELQKAVHDNLRNLGLDVLDVVNLRVMMGDGHGPAEGSIEASLTVLAEMQQQGLVKHIGLSNVTPTQVAEARKIAEIVCVQNEYNIAHRADDAMIDALARDGIAYVPFFPLGGFTPLQSSTLSDVATSLGATPMQVALAWLLQRSPNILLIPGTSSVAHLRENMAAEKLHLSEKVLSTLDGISRE

SEQ ID NO: 3409 - DNA, 8316 bp, Escherichia coli
atgcaaaggaaaactctattgtcggcctgtattgcattagctctgagtggtcagggttgggcggcagatattacagaaatagaaaccaccacaggtgaaaagaaaaataccaatgtgacttgtccagcagatcctggaaaactcagtccagaagagcttaaacgcttaccctctgaatgctcctctgtagtcgaacagaacctgatgccatggcttgtcacaggtgctgctactgcgttaatcacaaccttagccatagtggaactaaacgacgatgatgatcatcatcgcaataattctccacttccaccaactccacctgatgatgattcagacgacactccagttcctccaactcctggcggagatgagataataccagacgatggtccggatgataccccgacgcctcccaaaccgattgcgtttaataatgacgttatcctcgataaaacagaaaaaacgttaactattcgcgattcagttttcagttataccgagaatgctgatgggactatttctctgcaagatagcaatgggcgtaaggcgactattaatctttggcagattgatgaaacgaataacacggttgcccttgaagggatgagcgcagatggtgcaacgaagtggcaatataatcacaacggtgagctcgttattacgggcgacaataccacagtaaacaacactggaaaaaccatcgtcgacggcaaaggcgccaccggaactgaaatcgcgggtaacaacgcggtggtgaatcaggacggcgagctggatgtgagcggcggcggtcacgggattgatatcaccggcgacagcgcaactgtggacaacaaaggcggcatgactgtcaccgatccggattccatcggtattcagatcgacggcgacaaggcggttgtcaataaggacggtgacagtgccatcagcaacggtggcaccggcacgcaggttaacggcgacgaagccaccgtgaacaataacggcagcaccaccgttgacggcaaggattccacgggcaccgagataaacggtgacaaagccatcgtcaacaacgacggtgacagcacgatccttgatggcggcaccggaacccgcattacgggtgatgatgcgacggccaacaacagcggcaataccaccgtagacggtcagggttcgaccggaactgaaatcgcgggtaacaacgcggtggtgaatcaggacggtacactggatgtcagcggcggcggtcacggtattgatatcaccggcgacagcgcgacggtggacaacaaaggcggcatgactgtcaccgatcctgactccatcggtattcagatagacggcgacaaggcggtcgtgaacaacgacggtgacaatgccatcagcaacggcggcaccggcacgcaggttaacggcgacgaagccaccgtgaacaataacggcagcaccaccgttgacggcaaggattccacgggcaccgagataaacggtgacaaagccatcgtcaacaacgacggtgacagcacgatccttgatggcggcaccggaacccgcattacgggtgatgatgcgacggccaacaacagtggcaataccaccgtagacggtcagggttcgaccggaactgaaatcgcgggtaacaacgcggtggtgaaccaggacggcgagctggatgtgagcggcggcggtcacggtattgatatcaccggcgacagcgcaacggtggataacaaaggcggtatgaccgtcaccgatccggactccatcggtattcagatcgacggcgacaaagcggttgtcaataacgacggtggcagtgccatcagcaacggcggcaccggcacgcagattaacggtgatgaagccaccgtaaacaataacggcaataccaccgtagacggtcagggttcgaccggaactgaaatcgcgggtaacaacgcggtggtgaaccaggacggcgagctggatgtgagcggcggcggtcacggtattgatatcaccggcgacagtgcgacggtggacaacaaaggtggaatgactgtcaccgatccggattcgattggcattcagatcgacggcgacaaggcggtcgtgaacaacgacggtgacagtgccatcagtaacggcggcaccggcacgcaggttaacggtgatgaagccaccgtgaacaataacggtaaaaccaccgttgacggcaaggattccacgggcaccgagataaacggtgacaaagccatcgtcaacaacgacggcgacagcacgatccttgatggcggcaccggaacccgcattacgggtgatgatgcgacggccaacaacagcggcaataccaccgtagacggtcagggttcgaccggaactgaaatcgcgggtaataacgcggtggtgaatcaggacggcgagctggatgtgagcggcggcggtcacggtattgatatcaccggcgacagcgcaacggtggacaacaaaggcggcatgactgtcaccgatcctgactccatcggtattcagatcgacggcgacaaagcggttgtcaataacgacggtgacaacgccatcagcaacggcggcaccggcacgcaggttaacggcgacgaagccaccgtgaacaataacggcaacaccaccgttgacggcaaggattccacgggcaccgagataaacggtgacaaagctatcgtcaacaacgacggcgacagcacgatccttgatggcggcaccggaacccgcattacgggtgatgatgcgacggccaacaacagcggcaataccaccgtagacggtcagggttcgaccggaactgaaatcgcgggtaacaacgcggtggtgaaccaggacggcgagctggatgtgagcggcggcggtcacggtattgatatcaccggcgacagcgcgacggtggacaacaaaggtggaatgactgtcaccgatccggattcgattggcattcagatcgacggcgacaaggcggtcgtgaacaacgacggtgacagtgccatcagtaacggcggcaccggcacgcaggttaacggcgacgaagccaccgtgaacaataacggcaacaccaccgttgacggcaaggattccacgggcaccgagataaacggtgacaaagccatcgtcaacaacgacggtgacagcacgatccttgatggcggcaccggaacccgcattacgggtgatgatgcgacggccaacaacagcggcaataccaccgtagacggtcagggttcgaccggaactgaaatcgcgggtaataacgcggtggtgaaccaggacggcgagctggatgtgagcggcggtggtcacgggattgatatcaccggcgacagcgcaacggtggataacaaaggcggtatgaccgttaccgatccggattccatcggcattcagatcgacggcgacaaggcggtcgtgaacaacgacggtgacaatgccatcagcaacggcggcaccggcacgcaggttaacggtgatgaagccaccgtaaacaataacggcagcaccaccgttgacggacagggctcgaccggtaccgaaatcgcgggtaataacgcggtggtgaatcaggacggtacactggatgtcagcggtggcggtcacggtattgatatcaccggcgacagcgcgacggtggacaacaaaggcggcatgaccgtcaccgatccggattccatcggtattcagatcgacggcgacaaggcagttgtcaataacgaaggtgacaacgccatcagtaacggcggcaccggcacgcaggttaacggtgatgaagccaccgtgaacaataacggtaaaaccaccgttgacggcaaggattccacgggcaccgagataaacggtgacaaagccattgtcaacaacgacggtgacagcacgatccttgatggcggcaccggaacccgcattacgggtgatgatgcgacggccaacaacagcggcaataccaccgttgatggtcagggttcgaccggtaccgaaatcgcgggtaataacgcggtggtgaatcaggacggcttactggatgtgagcggcggcggtcacggcattgatatcactggtgatagcgccactgtaatcaataaaggcaatataactgtcacggataaagattcggttggtgtgctgattaacggtgatcgagcgacctttgccaatacgggtcatattgacgtcaataattcagctactggcatgagcatcacgaccagcgagggggccatctcccaggcaggtagcatgaatgttggtgacttttcaacaggcatggcgctcagtggtaataacaacagtgtgacgttggcggcgaaagatctgaacgttatcgggcagaaggcaacgggcgtcaacatctctggtgacaataatgccgttgatatcactggtaacattttggtagataaagatcaaaccgcgactaacgcggtagattatttttacgaaccgtctattggtgtgaacgttagcggcaacagtaacactgtatcgctagacggcaagttaactgtggtggctgacagtgaacttacctcacgtatttatgctgactttgatggaagccaggagaatatttccgggcttgtcgtatctggtgatgataataccgtgtatctgaatggtggtatccagctggttggtgaagaaaatcaattgactgatggttctaccgtcgcatcaaatcgcaatggctatggcaaaacaccagtaatcactgttgatgggaagtcgtctgtttacctgaacggggactccacgattaatggtgatttacctctagcctattcagggatgattcggttgaagaatagcgccatgattgagatcggggcggatgccacgattaacatgcaggtagatatttatgaccactatgcgagatctgaatcccaaatgatctttgtagagtctggtgctgagttagtcaataaaggtgatattgatactcgaaatatcggttttgccgctatttctggtgaaaattcaacgggaagtaacagtggcaatattacgctttctcagtacaactatggcttgttagcaaatgcaggagttggctatttcacgactaaaggcggtagtgcggttaataatggtacgattactgcgaaagtcatggaacaagaaagtgtcattaatttgggggcgtctctgggtctgaatgaggcgaacactttctactctgatgcgaacagtatgatggggcttgatgcctttgatcacggatacgtgtccaatgaaagcggtggcagcattgagatgtatggtcgcggcaacgttggtatgttggctattgatgagagtacagcagaaaacgctgggcaaattacactggatgccctgtgggttgatgcagatgataccaccactttgcgtagcaatattggtaatgatgccaggagctatggcgttggtatggccgtaggtacaaatacttacagtgggccaagaaaaaatgctacggccgttaataaacagggtggtgtaataacggtttataatgctggaataggtatggccgcctacggtgccagcaataccgtgattaacgagggtatcatcaatctggagaaaaacgctaactacgatagtagtctgggagcagattctctgatcggtatggccgcctataagagtggtactgccattaatgaacagtctggcgtaattaatatcaatgctgacaatgggcaggcgttttatagtgatggatccggtactattcttaactatggaacgatttgtgttaacactaattgcctgacgggcaatgactataatgagactgactcttatacctcgttactttacacgggtggcgatgtaatcactgcgcagaatgaaacacaaaatctgacccaaaaagcctcgattaacgacaaaaaagaaggcaatgttgttaacagtggttcgctttccggtgctgatattgcgattagtagcggtgaattagttaatacatcgacgggtactattaataatgccatcattatcaatgatggagagttaagtaacgaaggctctgtggcgaaggtgacgctaaacgcaggcacgttcgggaacaccggtacggttaactcgcgcatgttccagacaggaggaacatttaataaccagcaaggtggggtcgtgcaaaacggtgctaacctgagtaaaactgcaatcaccaataacgagggtacctggtatctcggtgccagcagtagtagtgatagcaataatgccagcatgatggagatttataatactgcggtgtttaacaacagcggtgacttcattctaaataacagcagaaatgctattcacttatatcagtctgggtcgttctacaataccggtcatatgttaatttctggtgctaactatagcggtaacgcaattaattactggaacgcgaataataatggacggttcattaatagtggtacagttgatgttactgcaaaagcgctagcgaccagcggtgttgatgccagtaccaaccatgcatacttctggaaccaaaatagtggtatagtcaattttgataaagacagcggcgttgctgtgaaattcacccacagtaattatgttgcacagaatgatggcaccatgaatattagcggtaataacgctattgcgatggaagggaataaaaatgcacagttgattaacaacggcacgattaatcttggagcacaaggtacgacagataccggtatgataggtatgcagctggatagcagtgcgacggctgatgcggtgatcgagaataatggtactatcaacatatacgctaataattcctttgcgtttagtatgctaggttccgtaggccacctcgtgaataacggtacggtaaccattgcagatggggtgacggggtccgggctgattaagcaaggtaatagcgttaacattgaaggtgtcaatggcaataacggcaataatagtgaagtgcattatgctaattacacactgccagatgtgcccggctcgtcagttttcgtatctaccgacaatgtttcagataatggaggccagaacaacctaaatggctatgttgtgggaaccagttctgatggcagcgcaggtaagttgaaagtgagcaatgcaagcctgaagggtgtttccgttaacactggatttacgtcaggaacaagtgcgacttctgttacattcgataatgtggttcaaggtaacaatcttacggatgctgataccattacatcgacctctgtcgtgtggagcgcacaaggtaacaccgatgctaatggcaacgtagacgtcacgatgaccaaaaacgcctatacggatgttgtgacggattcttcagttaataatgtcgctcaggtactggatacgggttacaccaataacgacctgtacactagtctgaacgtaggaacgactgctgaactgaacagtgcgctgaaacaaattagcggcagccaggcaacaacggtatttaatgaagcacgagtgttaagtaaccgcttcagcatgttgtccgatgcagcaccggaagttgcaaacggtctggccttcaacgtggtagcgaaaggcgacccgcgtgctgaactgggtaacgacacacagtacgacatgatggcgctgcgtaaatctctgacgctgactgaacatcagaacctgagtctggaatacgggattgctcgtctggagggtaatggttcagataccgcaggcgataacggagtgacaggcggttacagccagttcttcggtctgaaacaccagatggcctttgacaacggtatgaactggaataacgccctgcgttatgatgtgcaccagctcgacagcagtcgctcgatagcttacggcgacgtcaacaaaaccgctgatgctaatgtgaaacaacagtacctggagttccgtagtgaaggagcaaaaacctttgagctgcgtgaagggctgaacgtcactccatatgccggggttaaactgcgtcacacactggaaggtggctatcaggaacgcaatgcgggtgactttaacctgagcatgaacagcggcagcgaaacggcggtggacagcatcgttgggctgaaactggactatgcagggaaagaaggctggagtgcgaacgccacgctggaaggtgggccgaatctgagctatgtgaaaagtcaacgtactgcgagtatttcgggcgctggaagccaacgttttaacattgacgatggtcagagtggcggtggtttcaacagcctggcgacgatgggtgtgaaatacagcagccaggaaagtgcgttgcaggtagatgcattccactggaaagaagacggcatcagtgataaaggtgtgatgctaaacttcaagaaaacgttctaa

SEQ ID NO: 3410 - protein, 2771 aa, Escherichia coli
MQRKTLLSACIALALSGQGWAADITEIETTTGEKKNTNVTCPADPGKLSPEELKRLPSECSSVVEQNLMPWLVTGAATALITTLAIVELNDDDDHHRNNSPLPPTPPDDDSDDTPVPPTPGGDEIIPDDGPDDTPTPPKPIAFNNDVILDKTEKTLTIRDSVFSYTENADGTISLQDSNGRKATINLWQIDETNNTVALEGMSADGATKWQYNHNGELVITGDNTTVNNTGKTIVDGKGATGTEIAGNNAVVNQDGELDVSGGGHGIDITGDSATVDNKGGMTVTDPDSIGIQIDGDKAVVNKDGDSAISNGGTGTQVNGDEATVNNNGSTTVDGKDSTGTEINGDKAIVNNDGDSTILDGGTGTRITGDDATANNSGNTTVDGQGSTGTEIAGNNAVVNQDGTLDVSGGGHGIDITGDSATVDNKGGMTVTDPDSIGIQIDGDKAVVNNDGDNAISNGGTGTQVNGDEATVNNNGSTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGGSAISNGGTGTQINGDEATVNNNGNTTVDGQGSTGTEIAGNNAVVNQDGELDVSGGGHGIDITGDSATVDNKGGMTVTDPDSIGIQIDGDKAVVNNDGDSAISNGGTGTQVNGDEATVNNNGKTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGDNAISNGGTGTQVNGDEATVNNNGNTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGDSAISNGGTGTQVNGDEATVNNNGNTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGDNAISNGGTGTQVNGDEATVNNNGSTTVDGQGSTGTEIAGNNAVVNQDGTLDVSGGGHGIDITGDSATVDNKGGMTVTDPDSIGIQIDGDKAVVNNEGDNAISNGGTGTQVNGDEATVNNNGKTTVDGKDSTGTEINGDKAIVNNDGDSTILDGGTGTRITGDDATANNSGNTTVDGQGSTGTEIAGNNAVVNQDGLLDVSGGGHGIDITGDSATVINKGNITVTDKDSVGVLINGDRATFANTGHIDVNNSATGMSITTSEGAISQAGSMNVGDFSTGMALSGNNNSVTLAAKDLNVIGQKATGVNISGDNNAVDITGNILVDKDQTATNAVDYFYEPSIGVNVSGNSNTVSLDGKLTVVADSELTSRIYADFDGSQENISGLVVSGDDNTVYLNGGIQLVGEENQLTDGSTVASNRNGYGKTPVITVDGKSSVYLNGDSTINGDLPLAYSGMIRLKNSAMIEIGADATINMQVDIYDHYARSESQMIFVESGAELVNKGDIDTRNIGFAAISGENSTGSNSGNITLSQYNYGLLANAGVGYFTTKGGSAVNNGTITAKVMEQESVINLGASLGLNEANTFYSDANSMMGLDAFDHGYVSNESGGSIEMYGRGNVGMLAIDESTAENAGQITLDALWVDADDTTTLRSNIGNDARSYGVGMAVGTNTYSGPRKNATAVNKQGGVITVYNAGIGMAAYGASNTVINEGIINLEKNANYDSSLGADSLIGMAAYKSGTAINEQSGVININADNGQAFYSDGSGTILNYGTICVNTNCLTGNDYNETDSYTSLLYTGGDVITAQNETQNLTQKASINDKKEGNVVNSGSLSGADIAISSGELVNTSTGTINNAIIINDGELSNEGSVAKVTLNAGTFGNTGTVNSRMFQTGGTFNNQQGGVVQNGANLSKTAITNNEGTWYLGASSSSDSNNASMMEIYNTAVFNNSGDFILNNSRNAIHLYQSGSFYNTGHMLISGANYSGNAINYWNANNNGRFINSGTVDVTAKALATSGVDASTNHAYFWNQNSGIVNFDKDSGVAVKFTHSNYVAQNDGTMNISGNNAIAMEGNKNAQLINNGTINLGAQGTTDTGMIGMQLDSSATADAVIENNGTINIYANNSFAFSMLGSVGHLVNNGTVTIADGVTGSGLIKQGNSVNIEGVNGNNGNNSEVHYANYTLPDVPGSSVFVSTDNVSDNGGQNNLNGYVVGTSSDGSAGKLKVSNASLKGVSVNTGFTSGTSATSVTFDNVVQGNNLTDADTITSTSVVWSAQGNTDANGNVDVTMTKNAYTDVVTDSSVNNVAQVLDTGYTNNDLYTSLNVGTTAELNSALKQISGSQATTVFNEARVLSNRFSMLSDAAPEVANGLAFNVVAKGDPRAELGNDTQYDMMALRKSLTLTEHQNLSLEYGIARLEGNGSDTAGDNGVTGGYSQFFGLKHQMAFDNGMNWNNALRYDVHQLDSSRSIAYGDVNKTADANVKQQYLEFRSEGAKTFELREGLNVTPYAGVKLRHTLEGGYQERNAGDFNLSMNSGSETAVDSIVGLKLDYAGKEGWSANATLEGGPNLSYVKSQRTASISGAGSQRFNIDDGQSGGGFNSLATMGVKYSSQESALQVDAFHWKEDGISDKGVMLNFKKTF

SEQ ID NO: 3411 - DNA, 360 bp, Escherichia coli
ttgagacccgtagcgatcttttttgaggtgatgatgaaaagaacattacttctttgtgcatttcttgttggcttggtaagcagcaatgtaatggcattgactctggatgaagccagaactcaggggcgggtaggcgaaacattttatggttatctggttgcgctgaaaacagatgctgaaactgagaaattagtaaccgacatcaatgccgaacgtaaagcgagctatcaacaactggcaaagcagaataatgtgtcggtggatgatatcgcgaaactcgccgggcaaaagcttgtagaacgggccaaacccggggaatatgtacaagggataaacggtaaatgggtgcgaaaattttaa

SEQ ID NO: 3412 - protein, 119 aa, Escherichia coli
MRPVAIFFEVMMKRTLLLCAFLVGLVSSNVMALTLDEARTQGRVGETFYGYLVALKTDAETEKLVTDINAERKASYQQLAKQNNVSVDDIAKLAGQKLVERAKPGEYVQGINGKWVRKF

SEQ ID NO: 3413 - DNA, 186 bp, Escherichia coli
atgaaaattttactggctgcgttgacgtcatcttttatgctggttggctgtacgcctcgcattgaagtcgctgcacctaaggaaccgatcactatcaatatgaacgttaaaattgagcatgagatcatcatcaaggcagacaaagatgtcgaagagctgcttgagacccgtagcgatcttttttga

SEQ ID NO: 3414 - protein, 61 aa, Escherichia coli
MKILLAALTSSFMLVGCTPRIEVAAPKEPITINMNVKIEHEIIIKADKDVEELLETRSDLF

SEQ ID NO: 3415 - DNA, 2640 bp, Escherichia coli
atgctgggtaaatataaagccgttctcgcgctgttattactgattattcttgtgccgttaacgctgctgatgacgctcgggctgtgggttcccacgctggcgggcatctggctaccgctcgggacacgtattgcattagatgaaagcccacgcattacgcgtaaaggtttaatcatccccgatctccgttatctggtgggagattgtcagcttgcgcatatcaccaacgccagcctttcacatcccagtcgctggttattgagcgtcggcacggtagaacttgattctgcttgtctggcgaaattgccgcagacggagcaatcgccagccgctccaaaaaccctcgcgcagtggcagtccatgctgcctaacacctggatcaatatcgataaactgattttttctccctggcaggaatggcagggaaaactctctctcgcattaacctccgatatccagcaactgtgttatcagggcgaaaaagttaaatttcaaggccagctgaaagggcaacaacttacagtcagcgaactggatgtcgccgcgtttgaaaatcagccgccggtaaaactggtgggggaatttactatgccgctcgtgccggatggacttccggtaagtggtcatgctactgcgacgttaaacttaccgcaggagccttcactggtggatgccgagctggactggcaggaaaatagcgggcaattgattgtgctggcacgggataacggcgatccgttgctcgatttgccgtggcaaattactcgtcaacaattgaccgtaagcgatggtcgctggagctggccgtatgcaggttttcctttaagtggccgactgggtgttaaagtcgacaactggcaggcagggctcgagaacgctctggtcagcgggcgactgagtgtgctgacccaggggcaagcgggtaaaggcaacgcggtgttaaattttggcccaggaaaattaagcatggataacagccagctgcctctgcagctgaccggtgaagcgaaacaggcggacctcattttatatgcccgtttacctgcgcagctaagtggaagtctgtctgacccaacgctgacctttgagcctggcgcgttacttcgttcaaagggaagagtcattgattcgctggacatcgatgaaatccgctggcctttagcgggtgtaaaagtcacccaacgtggtgttgacggacgtttgcaggccattttgcaggcgcatgaaaatgaactgggcgatttcgtgctgcatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagaaaagccgcgattaattctcgacaagcccgtcgtctggggacgtgacgcacagcatccctccttcagcggcgctctgtcactggacgccgggcaaacgctgttcactggcggcagtgtgttaccgccatcaaccttaaaatttagtgtcgatgggcgtgatccgacgtatttcctctttaaaggcgatttacatgctggtgagattggcccggttcgggtaaatggtcgctgggacggtattcgtctgcgcggtaacgcctggtggcctaaacaatcactgactgtattccagccgctggtgccacccgactggaagatgaacttacgcgatggtgaactgtatgctcaggttgcattttcagctgcgcctgaacaaggattccgcgcgggggggcacggcgtattgaaaggcggtagtgcctggatgccagataatcaggttaacggtgtcgattttgtcctgcctttccgttttgccgatggagcctggcatctggggactcgcggtcccgttacgttgcgaattgccgaagtgattaatctggtgacagcgaaaaatattacggctgatttgcaaggtcgttatccgtggactgaagaagaaccattgctgttgactgatgttagcgtcgatgtgttaggcggtaacgtgctgatgaaacaattacgtatgccgcaacatgacccggcgctgttgcggctgaataatctttcctccagcgaactggttagcgccgtcaatccgaaacaattcgccatgtccggggcatttagtggtgcattgccgttatggctaaacaacgaaaaatggatagtgaaagacggctggctggcaaatagcgggccgatgaccttgcggctggataaagacaccgcagatgcggtggtgaaagacaatatgaccgcggattcagcaattaactggttgcgctatatggaaattagccgttcatcgacaaaaattaatttagataatctcggtttattaaccatgcaggccaatattacaggtaccagtcgcgttgatggtaaaagcggtacggtaaatcttaattaccatcatgaagagaatatttttacgctgtggcgcagtttacgctttggcgataatctccaggcatggctggagcagaacgcgcgtctgccgggaaatgactgtccgcaaggaaaagagtgtgaggataaacaatga

SEQ ID NO: 3416 - protein, 879 aa, Escherichia coli
MLGKYKAVLALLLLIILVPLTLLMTLGLWVPTLAGIWLPLGTRIALDESPRITRKGLIIPDLRYLVGDCQLAHITNASLSHPSRWLLSVGTVELDSACLAKLPQTEQSPAAPKTLAQWQSMLPNTWINIDKLIFSPWQEWQGKLSLALTSDIQQLCYQGEKVKFQGQLKGQQLTVSELDVAAFENQPPVKLVGEFTMPLVPDGLPVSGHATATLNLPQEPSLVDAELDWQENSGQLIVLARDNGDPLLDLPWQITRQQLTVSDGRWSWPYAGFPLSGRLGVKVDNWQAGLENALVSGRLSVLTQGQAGKGNAVLNFGPGKLSMDNSQLPLQLTGEAKQADLILYARLPAQLSGSLSDPTLTFEPGALLRSKGRVIDSLDIDEIRWPLAGVKVTQRGVDGRLQAILQAHENELGDFVLHMDGLANDFLPDAGRWQWRYWGKGSFTPMNATWDVAGKGEWHDSTITLTDLSTGFDQLQYGTMTVEKPRLILDKPVVWGRDAQHPSFSGALSLDAGQTLFTGGSVLPPSTLKFSVDGRDPTYFLFKGDLHAGEIGPVRVNGRWDGIRLRGNAWWPKQSLTVFQPLVPPDWKMNLRDGELYAQVAFSAAPEQGFRAGGHGVLKGGSAWMPDNQVNGVDFVLPFRFADGAWHLGTRGPVTLRIAEVINLVTAKNITADLQGRYPWTEEEPLLLTDVSVDVLGGNVLMKQLRMPQHDPALLRLNNLSSSELVSAVNPKQFAMSGAFSGALPLWLNNEKWIVKDGWLANSGPMTLRLDKDTADAVVKDNMTADSAINWLRYMEISRSSTKINLDNLGLLTMQANITGTSRVDGKSGTVNLNYHHEENIFTLWRSLRFGDNLQAWLEQNARLPGNDCPQGKECEDKQ

SEQ ID NO: 3417 - DNA, 990 bp, Escherichia coli
atgaaactcgccgtttatagcacaaaacagtacgacaagaagtacctgcaacaggtgaacgagtcctttggctttgagctggaattttttgactttctgctgacggaaaaaaccgctaaaactgccaatggctgcgaagcggtatgtattttcgtaaacgatgacggcagccgcccggtgctggaagagctgaaaaagcacggcgttaaatatatcgccttgcgctgtgccggtttcaataacgtcgaccttgacgcggcaaaagaactggggctcaaagtagtccgtgttccagcctatgatccagaggccgttgctgaacacgccatcggtatgatgatgacgctgaaccgccgtattcaccgcgcgtatcagcgtacccgtgacgctaacttctctctggaaggtctgaccggctttactatgtatggcaaaacggcaggcgttatcggtaccggtaaaatcggtgtggcgatgctgcgcattctgaaaggttttggtatgcgtctgctggcgttcgatccgtatccaagtgcggcggcgctggaactcggtgtggagtatgtcgatctgccaaccctgttctctgaatcagacgttatctctctgcactgcccgctgacaccggaaaactaccatctgttgaacgaagccgccttcgatcagatgaaaaatggcgtgatgatcgtcaataccagtcgcggtgcattgattgattctcaggcggcaattgaagcgctgaaaaatcagaaaattggttcgttgggtatggacgtgtatgagaacgaacgcgatctgttctttgaagataaatccaacgacgtgatccaggatgacgtattccgtcgcttgtctgcctgccacaacgtgctgtttaccgggcaccaggcattcctgacagcagaagctctgaccagtatttctcagactacgctgcaaaacttaagcaatctggaaaaaggcgaaacctgcccgaacgaactggtttaa

SEQ ID NO: 3418 - protein, 329 aa, Escherichia coli
MKLAVYSTKQYDKKYLQQVNESFGFELEFFDFLLTEKTAKTANGCEAVCIFVNDDGSRPVLEELKKHGVKYIALRCAGFNNVDLDAAKELGLKVVRVPAYDPEAVAEHAIGMMMTLNRRIHRAYQRTRDANFSLEGLTGFTMYGKTAGVIGTGKIGVAMLRILKGFGMRLLAFDPYPSAAALELGVEYVDLPTLFSESDVISLHCPLTPENYHLLNEAAFDQMKNGVMIVNTSRGALIDSQAAIEALKNQKIGSLGMDVYENERDLFFEDKSNDVIQDDVFRRLSACHNVLFTGHQAFLTAEALTSISQTTLQNLSNLEKGETCPNELV

SEQ ID NO: 3419 - DNA, 435 bp, Escherichia coli
ttgagaaccacaatgaagaaagtagccgcgcttgttgcgctaagcctgctgatggcgggatgtgtaagtagtgacaaaattgctgtaacgccagaacagctacagcatcatcgctttgtgctggaaagcgtaaacggtaagcccgtgaccagcgataaaaatccgccagaaatcagctttggtgaaaagatgatgatttccggcagcatgtgtaaccgctttagcggtgaaggcaaactgtctaatggtgaactgaccgccaaagggctggcaatgacccgtatgatgtgcgttaacccgcagcttaatgaactcgataacaccattagcgaaatgctgaaagaaggtgcacaagtggatctgaccgcgaaccagttaacgctggcgaccgcgaaacagacattaacttataagctggcggatttaatgaattaa

SEQ ID NO: 3420 - protein, 144 aa, Escherichia coli
MRTTMKKVAALVALSLLMAGCVSSDKIAVTPEQLQHHRFVLESVNGKPVTSDKNPPEISFGEKMMISGSMCNRFSGEGKLSNGELTAKGLAMTRMMCVNPQLNELDNTISEMLKEGAQVDLTANQLTLATAKQTLTYKLADLMN

SEQ ID NO: 3421 - DNA, 267 bp, Escherichia coli
atgcgagcagcgttttgggtagggtgtgccgctttattgttgtcggcgtgtagtagtgaacctgttcagcaggcgactgcggcgcacgtagcgccaggtttaaaagcgtcgatgtccagtagtggagaagcaaattgtgcaatgatcggcggttcgctttctgttgcccgccaactggatggtacggcgattgggatgtgtgcattacccaacggcaaacgctgtagcgaacagtcacttgccgccgggagctgtggcagctattaa

SEQ ID NO: 3422 - protein, 88 aa, Escherichia coli
MRAAFWVGCAALLLSACSSEPVQQATAAHVAPGLKASMSSSGEANCAMIGGSLSVARQLDGTAIGMCALPNGKRCSEQSLAAGSCGSY

SEQ ID NO: 3423 - DNA, 3525 bp, Escherichia coli
atgattactattgacggtaatggcgcggttgcttcggtggcgtttcgcaccagtgaagttatcgccatctaccctattacccccagttccacgatggcagaacaggctgatgcatgggccggaaacggcttgaaaaacgtttggggagacacaccacgcgtggttgaaatgcagtcggaagcgggtgctatcgctaccgtgcatggtgctttgcaaactggtgccctctcaacatcgtttacgtcatcgcagggtttgctgctaatgatcccaacgctgtacaaactggcaggcgaactgacgccgtttgtcctgcatgttgcggcacgtaccgttgccacacatgcactctctatttttggcgatcattccgacgttatggcggtgcgccagacgggttgcgcgatgttgtgtgcagcaagcgtccaggaagcgcaagactttgctctcatttcgcacatcgcgacgctgaaaagccgcgtgccatttattcatttctttgatggtttccgcacatctcacgaaatcaataaaattgtcccgctggccgatgacacgattcttgaactgatgccgcaggcagaaattgatgctcatcgcgcccgggcactcaacccggaacatccggtgatccgcggtacgtccgccaatcctgacacttatttccagtctcgcgaagccaccaacccatggtacaacgcggtctatgaccatgttgaacaggcgatgaatgatttcgctgccgcgacaggtcgtcattatcagccgtttgagtattacgggcatccgcaagcggaacgggtgattatcctgatgggctcagccattggcacatgtgaagaagtggttgatgaattgctgacccgtggcgaaaaagtcggcgtgctgaaagttcgcctgtaccgccccttctccgccaaacacttgctgcaagctctgccgggatccgtgcgcaacgtagcggtactggacagaaccaaagaacccggtgcccaggcagaaccgctctatctggatgtgatgaccgcactggcagaagcctttaataatggcgagcgtgaaaccctgccccgtgtcattggtgggcgctatggtctttcatccaaagaatttggcccggactgtgtactggcggtatttgccgagctcaacgcggctaaaccgaaagcgcgctttacggttggtatttacgatgatgtaaccaatctgtcactgccgttgccggaaaacaccctaccaaactcggcgaaactggaagccttgttttatggccttggtagtgatggcagcgtttccgcgaccaaaaacaatatcaagattatcggaaattccacgccgtggtacgcacagggctattttgtttacgactccaaaaaggcgggcggcctgacggtttctcaccttcgcgtgagcgaacagccgattcgttccgcttatctcatttcccaggctgattttgttggctgccaccagttgcagtttatcgataaatatcagatggctgagcgtttaaaacctggcggcattttcctgctcaacacgccgtacagcgcagctgaagtgtggtcgcgcttgccgcaggaagttcaggccgtgctaaaccagaaaaaagcgcgcttctatgtgattaacgcggcgaaaatcgcccgcgaatgtggcctggcggcccgtattaataccgtcatgcagatggcttttttccatctgacgcagattctgcctggcgatagcgccctggcagaattgcagggtgcgattgccaaaagttacagtagcaaaggccaggatctggtggaacgcaactggcaggctctggcgctggcacgtgaatccgtagaagaagttccactgcagccagttaatccgcatagcgccaatcgaccgccagtggtttccgatgccgctcctgatttcgtgaaaaccgtaaccgctgcgatgctcgccgggcttggcgacgccctccccgtttcggcgctgccgccagacggcacctggccgatgggcaccacgcgctgggaaaaacgcaatatcgccgaagagatccccatctggaaagaggaactctgtacccaatgtaaccactgtgtcgccgcttgcccacactcagctattcgcgcaaaagtggtaccgcctgaagcgatggaaaacgcccctgccagcctgcattcgctggatgtgaaatcgcgtgatatgcgcgggcagaaatatgtcttgcaggtggctccggaagattgcaccggttgtaacctgtgcgtcgaagtttgcccggcgaaagaccgtcagaatccagagattaaagccatcaatatgatgtcgcgcctggaacatgtcgaagaagagaaaatcaattacgatttcttcctcaacctgccagaaatcgaccgtagcaaactggaacgtattgatattcgtacatcgcagctgattacaccgctgtttgaatattccggtgcttgctccggttgtggcgagacgccgtatattaaattgctgactcagctctatggcgaccggatgttgatcgctaatgccactggctgttcttcaatatacggcggtaacctgccttcaacaccatataccaccgatgccaatggtcgtggaccggcatgggcgaactcgctgtttgaagataacgccgaatttggccttggtttccgcctgacggtcgatcaacaccgtgtccgcgtgctgcgtctgctcgatcaatttgccgataaaatcccgacggaattactgactgcgttgaaatcagacgccacgccagaggttcgtcgtgcacaggttgcagctttacgccagcaactcaacgatgttgccgaagcacatgaactgctgcgtgacgcagatgcactggtggaaaaatcaatctggctgattggtggcgatggctgggcttacgatatcggctttggcggtctggatcatgtattgagtttgacggaaaacgtcaacattctggtgctggatacgcaatgctattccaacaccggtggtcaggcatcgaaagcgacaccgctgggtgcagtaactaagtttggcgagcatggcaaacgtaaagcgcgtaaagatcttggcgtcagtatgatgatgtacggtcatgtttatgtggcgcagatttctctcggcgcgcagttgaaccagacggtgaaagcgattcaggaagcggaagcgtatccggggccatcgctgatcatcgcttatagcccatgtgaagagcatggttacgatctggcactcagccacgatcagatgcgccaactcactgctaccggcttctggccgttatatcgcttcgatcctcgtcgtgccgatgaaggcaaactgccgctggcgctggattcacgcccgccgtcagaagcactggaagaaacgttacttcacgagcagcgtttccgtcgtctgaattcgcagcagccagaagtggcagaacagttatggaaagatgctgcagctgatttgcaaaaacgctatgacttcctggcacaaatggccggaaaagcggaaaaaagcaacaccgattaa

SEQ ID NO: 3424 - protein, 1174 aa, Escherichia coli
MITIDGNGAVASVAFRTSEVIAIYPITPSSTMAEQADAWAGNGLKNVWGDTPRVVEMQSEAGAIATVHGALQTGALSTSFTSSQGLLLMIPTLYKLAGELTPFVLHVAARTVATHALSIFGDHSDVMAVRQTGCAMLCAASVQEAQDFALISHIATLKSRVPFIHFFDGFRTSHEINKIVPLADDTILELMPQAEIDAHRARALNPEHPVIRGTSANPDTYFQSREATNPWYNAVYDHVEQAMNDFAAATGRHYQPFEYYGHPQAERVIILMGSAIGTCEEVVDELLTRGEKVGVLKVRLYRPFSAKHLLQALPGSVRNVAVLDRTKEPGAQAEPLYLDVMTALAEAFNNGERETLPRVIGGRYGLSSKEFGPDCVLAVFAELNAAKPKARFTVGIYDDVTNLSLPLPENTLPNSAKLEALFYGLGSDGSVSATKNNIKIIGNSTPWYAQGYFVYDSKKAGGLTVSHLRVSEQPIRSAYLISQADFVGCHQLQFIDKYQMAERLKPGGIFLLNTPYSAAEVWSRLPQEVQAVLNQKKARFYVINAAKIARECGLAARINTVMQMAFFHLTQILPGDSALAELQGAIAKSYSSKGQDLVERNWQALALARESVEEVPLQPVNPHSANRPPVVSDAAPDFVKTVTAAMLAGLGDALPVSALPPDGTWPMGTTRWEKRNIAEEIPIWKEELCTQCNHCVAACPHSAIRAKVVPPEAMENAPASLHSLDVKSRDMRGQKYVLQVAPEDCTGCNLCVEVCPAKDRQNPEIKAINMMSRLEHVEEEKINYDFFLNLPEIDRSKLERIDIRTSQLITPLFEYSGACSGCGETPYIKLLTQLYGDRMLIANATGCSSIYGGNLPSTPYTTDANGRGPAWANSLFEDNAEFGLGFRLTVDQHRVRVLRLLDQFADKIPTELLTALKSDATPEVRRAQVAALRQQLNDVAEAHELLRDADALVEKSIWLIGGDGWAYDIGFGGLDHVLSLTENVNILVLDTQCYSNTGGQASKATPLGAVTKFGEHGKRKARKDLGVSMMMYGHVYVAQISLGAQLNQTVKAIQEAEAYPGPSLIIAYSPCEEHGYDLALSHDQMRQLTATGFWPLYRFDPRRADEGKLPLALDSRPPSEALEETLLHEQRFRRLNSQQPEVAEQLWKDAAADLQKRYDFLAQMAGKAEKSNTD

SEQ ID NO: 3425 - DNA, 1134 bp, Escherichia coli
atgaaaagcaaagtactggcactcttaattcctgccctgctcgctgcaggtgctgcacatgcagccgaagtttataataaagacggcaacaaattagatctgtatggcaaagttgatggcctgcattatttttctgataattcagcgaaagatggcgaccagagctatgctcgtctgggttttaaaggcgaaacccaaattaacgatcaactcactggctacggtcaatgggaatacaatattcaggcaaacaacaccgaatcttcaacaaaccagtcatggacccgtctggcatttgccggactgaaatttgcagattacggttctttcgattacggacgtaattatggcgtaatgtacgacatcgaaggctggactgatatgctacctgaatttggcggtgactcttataccaatgcagacaactttatgactggtcgtgccaatggcgtcgcgacttatcgtaatactgatttcttcggtctggtaaatggtctgaacttcgcggtgcagtatcaaggtaacaacgaaggtgccagtaatggtcaggaaggcaccaacaacggacgtgatgttcgccatgaaaacggtgacggctggggtctttccacaacatatgatttaggcatgggctttagcgctggtgcggcatacacctcttctgaccgcaccaatgaccaggttaaccatactgcggcgggtggtgataaagcagacgcgtggactgctgggctaaaatacgatgctaacaatatttacctggcaaccatgtattcagaaacgcgtaatatgaccccgtttggcgacagcgattatgctgttgcaaacaaaacccagaactttgaagtcactgcacagtaccagtttgattttggtctgcgtccggcagtctctttcctgatgtctaaaggccgtgacctgcacgctgccggtggtgcagacaacccagcaggtgttgatgataaagatctggttaaatacgccgatgttggcgcgacttactatttcaacaaaaatatgtccacctacgttgactataaaatcaacctgttggatgaagatgacagcttctacgctgccaatggcatctctaccgatgatatcgtcgctttaggtctggtttatcagttctaa

SEQ ID NO: 3426 - protein, 377 aa, Escherichia coli
MKSKVLALLIPALLAAGAAHAAEVYNKDGNKLDLYGKVDGLHYFSDNSAKDGDQSYARLGFKGETQINDQLTGYGQWEYNIQANNTESSTNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADVGATYYFNKNMSTYVDYKINLLDEDDSFYAANGISTDDIVALGLVYQF

SEQ ID NO: 3427 - DNA, 435 bp, Escherichia coli
atgaacagaacgattcttgtccctatcgatatttccgattcagaattaactcaacgcgtgattagccacgttgaggcagaggcaaagattgatgatgcagaggttcatttcctgacggtaataccttcgctgccctactatgcctctctgggtttagcgtattccgcagaattaccggcaatggatgacctgaaagcggaagccaaatcgcaactggaagagatcattaaaaaatttaaactgccaaccgacagagtgcatgtccatgttgaggaaggctcgcccaaagaccgcattctggaattggcgaagaagatccccgctcatatgatcatcattgcttcccatcgaccggatatcaccacttatctgctcggttctaacgccgcagctgtagtgcgtcacgcagagtgctccgtgctggttgtgcgctga

SEQ ID NO: 3428 - protein, 144 aa, Escherichia coli
MNRTILVPIDISDSELTQRVISHVEAEAKIDDAEVHFLTVIPSLPYYASLGLAYSAELPAMDDLKAEAKSQLEEIIKKFKLPTDRVHVHVEEGSPKDRILELAKKIPAHMIIIASHRPDITTYLLGSNAAAVVRHAECSVLVVR

SEQ ID NO: 3429 - DNA, 309 bp, Escherichia coli
gtgttaccgcatcctgtacgggtagcgcaacaccagcatgctaagcaaggctttcccatcagatttcactacgactatttgggagcgagatggaatgcagcagtaaaacgtgctggtattcgccgccgtaatccgtaccatacgcgacatacttttgcctgctggctgttgacggcaggagcgaacccggcatttatagccagccagatggggcatgaaactgcgcagatggtgtatgaaatttacggtatgtggattgatgacatgaacgacgaacaggtagccatgttgaatgcgcggttatcgtag

SEQ ID NO: 3430 - protein, 102 aa, Escherichia coli
MLPHPVRVAQHQHAKQGFPIRFHYDYLGARWNAAVKRAGIRRRNPYHTRHTFACWLLTAGANPAFIASQMGHETAQMVYEIYGMWIDDMNDEQVAMLNARLS

SEQ ID NO: 3431 - DNA, 936 bp, Escherichia coli
atgcaagaaaatcaacaaattacaaagaaagaacaatacaacctgaacaaattacaaaaacgtctgcgtcgtaacgtgggcgaagccattgctgacttcaatatgattgaagaaggcgatcgcatcatggtttgcctctccgggggtaaagacagctataccatgctggagattctgcgcaatttgcagcaaagcgcgccaatcaatttttcgctggtggctgttaacctcgatcaaaagcaaccgggcttcccggaacacgttctgcccgagtatcttgaaacgctgggcgttgagtacaagattgttgaagagaacacttacggtatcgtgaaagagaagattccggagggcaaaaccacttgctcactgtgttctcgtcttcgtcgcggtatcctttatcgcaccgcaacggaactgggggcgacgaagatcgcgctgggtcaccatcgtgacgatatcctgcaaacgctgttcttaaatatgttctacggtggcaagatgaaaggtatgcctccgaaactgatgagcgatgatggcaaacatatcgtgattcgtccgctggcctactgccgcgagaaagatattcagcgctttgccgatgcaaaagcgttcccgattattccgtgcaacctgtgcggttcacagcctaacctgcaacgtcaggtgattgctgacatgttgcgtgactgggataaacgttatccggggcgtatcgagacgatgttcagcgcgatgcagaatgtggtgccgtcacatctgtgcgataccaacctgttcgattttaaaggcattactcacggttctgaagtggttaacgggggtgatctggcgtttgatcgcgaagagatcccactacaaccgtcgggctggcagcctgaagaagatgaaaatcagttggatgagttacggctgaatgtggttgaagtgaaataa

SEQ ID NO: 3432 - protein, 311 aa, Escherichia coli
MQENQQITKKEQYNLNKLQKRLRRNVGEAIADFNMIEEGDRIMVCLSGGKDSYTMLEILRNLQQSAPINFSLVAVNLDQKQPGFPEHVLPEYLETLGVEYKIVEENTYGIVKEKIPEGKTTCSLCSRLRRGILYRTATELGATKIALGHHRDDILQTLFLNMFYGGKMKGMPPKLMSDDGKHIVIRPLAYCREKDIQRFADAKAFPIIPCNLCGSQPNLQRQVIADMLRDWDKRYPGRIETMFSAMQNVVPSHLCDTNLFDFKGITHGSEVVNGGDLAFDREEIPLQPSGWQPEEDENQLDELRLNVVEVK

SEQ ID NO: 3433 - DNA, 1374 bp, Escherichia coli
gtgaccgctttttctaccctgaatgttttgcctcccgcccaactcacaaaccttaatgagttgggttatttaaccatgacgccggtgcaggacgccgcgcttccggcgatccttgccggaaaagatgttcgcgtgcaggcgaaaaccggcagcggcaaaacggcggcttttggcctcggcttgttacagcaaattgatgcgtcgctatttcaaacccaggctttagtgctgtgtcctacgcgtgaactggcggatcaggtggcaggtgaattgcgtcggctggcgcgttttctgccaaataccaaaattttgacgttgtgcggtggtcaaccgttcggtatgcagcgtgattcgttgcaacatgcgccgcatattatcgtggcaacgccgggccgtttgctggatcacctgcaaaaaggcactgtatcactggatgcgttgaatacgctggtgatggatgaggccgaccgcatgctggatatgggatttagcgacgccattgatgatgtcatccgttttgcgccagcatctcggcagacgcttctgttttcggcaacctggccggaggccatcgccgcaatcagcggaagagtgcaacgcgatcctttagcgattgaaattgactcaacagatgctctgccacctattgaacaacaattttatgagacatccagcaaaggcaaaattcctctgttgcaacggttattaagcttgcatcagccatcctcttgcgtggtgttttgcaataccaaaaaagattgccagtctgtctgcgacgtgctgaatgaagtagggcaaagtgcattgtcgttacacggcgatctggagcaacgcgatcgcgatcagaccctggtacgttttgctaacggtagcgcccgtgtactggtcgcgactgatgttgctgcgcgtggtctggatataaaatcgcttgagctggtggtgaactttgagctggcgtgggaccctgaagttcatgtacatcgcatcggtcgtacagctcgtgcaggaaatagtggtctggcgatcagtttctgtgccccggaagaagcacagcgggccaatatcatttctgacatgttgcagataaaacttaactggcaaacgctgccagcgaatagttccattgtgccgctggaagcagaaatggcaacgttgtgtatcgatggcgggaaaaaagccaaaatgcgcccgggtgatgtattaggtgcgctgacaggagacatcgggcttgatggcgcagatattggcaaaatcgccgtgcatccggcgcatgtttatgtcgcggtgcgtcaggctgttgctcataaagcatggaaacagctacagggcgggaagattaaaggaaaaacgtgccgggtgcggttattaaaataa

SEQ ID NO: 3434 - protein, 457 aa, Escherichia coli
MTAFSTLNVLPPAQLTNLNELGYLTMTPVQDAALPAILAGKDVRVQAKTGSGKTAAFGLGLLQQIDASLFQTQALVLCPTRELADQVAGELRRLARFLPNTKILTLCGGQPFGMQRDSLQHAPHIIVATPGRLLDHLQKGTVSLDALNTLVMDEADRMLDMGFSDAIDDVIRFAPASRQTLLFSATWPEAIAAISGRVQRDPLAIEIDSTDALPPIEQQFYETSSKGKIPLLQRLLSLHQPSSCVVFCNTKKDCQSVCDVLNEVGQSALSLHGDLEQRDRDQTLVRFANGSARVLVATDVAARGLDIKSLELVVNFELAWDPEVHVHRIGRTARAGNSGLAISFCAPEEAQRANIISDMLQIKLNWQTLPANSSIVPLEAEMATLCIDGGKKAKMRPGDVLGALTGDIGLDGADIGKIAVHPAHVYVAVRQAVAHKAWKQLQGGKIKGKTCRVRLLK

SEQ ID NO: 3435 - DNA, 99 bp, Escherichia coli
gtggtgggtcaggcatgggttgcgggcgagggatcggatcgggtactggaacaggatcgccaggaatcggttcagggacaggaatttgcaaataaataa

SEQ ID NO: 3436 - protein, 32 aa, Escherichia coli
MVGQAWVAGEGSDRVLEQDRQESVQGQEFANK

SEQ ID NO: 3437 - DNA, 984 bp, Escherichia coli
gtggaagcgattaagggatcggacgttaatgtcccggatgcagtatttgcatggatgctggatggtagaggcggcgttaaaccgctggaaaatacagatgtgattgatgaagcgcatccctgctggctccaccttaattatgtacaccatgatagcgcccaatggctggcgacaacaccgctgcttcccaataacgtacgtgatgcgctggcgggcgagagcacacggccccgagtcagtcgtctcggtgaaggcacgctgattacattgcgctgtataaacggcagcaccgatgaacgccccgatcaactggtcgccatgcgtgtatatatggacgggcggttaattgtttcgacccgacaacgcaaagtgctggcgctggacgatgtggtgagcgatcttgaagagggcactggtccgaccgattgcgggggatggctggttgatgtgtgcgatgcgttgaccgatcattccagcgaatttatcgagcagctgcacgataaaattatcgacctcgaagataatcttctcgatcagcaaattccaccgcgtggattcctggctctgctgcgcaaacaattaattgtgatgcgtcgctatatggcaccgcaacgtgatgtttatgctcgtcttgccagtgaacgtttgccgtggatgagcgatgaccaacgccgtcggatgcaggatattgccgatcgccttgggcgcggtcttgacgaaatcgacgcctgtatagcacggactggcgtgatggcggatgaaatcgctcaggtgatgcaggaaaatttagctcgtcgtacctatacaatgtcgttgatggcaatggtctttttacccagtacgtttctgacagggttatttggcgtcaaccttggtgggatccctggcggcggatggcaatttggattttcaattttttgtattctgttagttgttcttattggtggtgttgctttatggttgcatcgtagtaaatggttgtaa

SEQ ID NO: 3438 - protein, 327 aa, Escherichia coli
MEAIKGSDVNVPDAVFAWMLDGRGGVKPLENTDVIDEAHPCWLHLNYVHHDSAQWLATTPLLPNNVRDALAGESTRPRVSRLGEGTLITLRCINGSTDERPDQLVAMRVYMDGRLIVSTRQRKVLALDDVVSDLEEGTGPTDCGGWLVDVCDALTDHSSEFIEQLHDKIIDLEDNLLDQQIPPRGFLALLRKQLIVMRRYMAPQRDVYARLASERLPWMSDDQRRRMQDIADRLGRGLDEIDACIARTGVMADEIAQVMQENLARRTYTMSLMAMVFLPSTFLTGLFGVNLGGIPGGGWQFGFSIFCILLVVLIGGVALWLHRSKWL

SEQ ID NO: 3439 - DNA, 1293 bp, Escherichia coli
atgacgtggcttttttgcgatcggatagcaacaaaaattgataaaaataatgggatctcaatgattacacacaacttcaataccctggacttactcaccagtcctgtctggatcgtttcgccctttgaggaacagttaatttatgccaacagcgcggcgcgactgttgatgcaagacctcacgtttagtcagctacgaaccggtccctattccgtctcctcacaaaaagaactgccgaaatacctctccgatctgcaaaatcaacacgatattatcgaaatactcaccgttcagcgtaaagaagaggaaacagcattgagctgtcgacttgttttgcgaaagctgacagaagcagaaccggtgattattttcgaaggtatcgaagcgccggcaacgctgggtttaaaagccagtcgctcggcaaattatcagcgcaaaaaacaaggtttttatgcgcgcttttttctgactaactctgcaccaatgttgttgattgacccctcacgagatggccaaatcgtcgatgctaacctcgccgcgctcaatttctatggttataaccatgaaacgatgtgccagaaacatacctgggaaattaatatgctcgggcgtcgcgtcatgcctatcatgcatgaaatctcgcatttacccggtggtcataaacctttgaattttgttcataaactggcggatggttcgactcgtcatgtgcagacctatgccgggccgattgaaatttatggtgacaagctcatgttatgtattgtgcatgatattactgagcaaaaacggctggaggagcagctggaacatgctgcccaccatgatgcgatgacaggattactgaatcggcgacagttttatcacattaccgagccaggccaaatgcagcacctcgccatcgctcaggattacagcttgttgctcatcgacaccgatcgttttaaacacattaacgatctctatgggcattctaaaggtgatgaggtgttatgcgcccttgcccgcactctcgaaagttgcgctcgcaaaggcgatttggtgtttcgttggggaggcgaagagtttgtcttattgctaccaagaaccccactggataccgcgctttcgctggctgaaactatccgcgtaagcgtggcaaaagtgagtatttcgagcttaccacgctttactgtcagcattggtgtggcgcatcacgaaggaaatgaaagcatcgatgaactgtttaaacgcgttgatgatgctttgtatcgagcgaaaaatgatggacgcaaccgcgtgctggcggcataa

SEQ ID NO: 3440 - protein, 430 aa, Escherichia coli
MTWLFCDRIATKIDKNNGISMITHNFNTLDLLTSPVWIVSPFEEQLIYANSAARLLMQDLTFSQLRTGPYSVSSQKELPKYLSDLQNQHDIIEILTVQRKEEETALSCRLVLRKLTEAEPVIIFEGIEAPATLGLKASRSANYQRKKQGFYARFFLTNSAPMLLIDPSRDGQIVDANLAALNFYGYNHETMCQKHTWEINMLGRRVMPIMHEISHLPGGHKPLNFVHKLADGSTRHVQTYAGPIEIYGDKLMLCIVHDITEQKRLEEQLEHAAHHDAMTGLLNRRQFYHITEPGQMQHLAIAQDYSLLLIDTDRFKHINDLYGHSKGDEVLCALARTLESCARKGDLVFRWGGEEFVLLLPRTPLDTALSLAETIRVSVAKVSISSLPRFTVSIGVAHHEGNESIDELFKRVDDALYRAKNDGRNRVLAA

SEQ ID NO: 3441 - DNA, 564 bp, Escherichia coli
atgaaccttgacgacaaatcgctgtttcttgacgccatggaagatgtccagccgctgaaacgtgctacagatgtccactggcatccaacgcgtaaccaacgtgcgccgcagcgtatcgacacgctgcaacttgataatttcctcaccactggatttctcgacatcatcccgctaagtcagccgctggagtttcggcgggaaggtttgcaacatggggtgctggataagctgcgcagtggtaaatatccgcaacaggcgagcctgaatcttttgcgccagccggtggaagagtgccgcaaaatgatgttcagtttcattcaacaagccctggcggatggtttgcgtaacgtcctgattattcatggcaaaggacgggatgataaatcgcatgccaatattgtccgcagctatgtggcgcgctggctgaccgaatttgatgatgttcaggcatattgcaccgcgctaccgcatcatggcggcagcggggcgtgttacgtcgcactacgtaaaacagcgcaggcgaagcaagaaaactgggagcgccacgctaagcgcagtcgttga

SEQ ID NO: 3442 - protein, 187 aa, Escherichia coli
MNLDDKSLFLDAMEDVQPLKRATDVHWHPTRNQRAPQRIDTLQLDNFLTTGFLDIIPLSQPLEFRREGLQHGVLDKLRSGKYPQQASLNLLRQPVEECRKMMFSFIQQALADGLRNVLIIHGKGRDDKSHANIVRSYVARWLTEFDDVQAYCTALPHHGGSGACYVALRKTAQAKQENWERHAKRSR

SEQ ID NO: 3443 - DNA, 1512 bp, Escherichia coli
atgtctatgcgtaaacatattgctttcgccagtatgtgtattggattatttattgctcagcttgatattcaaattgtatcgtcatccctaaatgaaataggtggtggtctgtccgcaggtaaagacgaaatggcctggcttcagaccagctatttaattgccgagattattgttattccgctctctgggtggctgtcacgggtattttccactcgttggctttttactctatccgcgggaatatttactttaatgagtatcgcttgtggacttgcatggaatattcagatcatgattttttttcgtgctttacagggagttgctggcgcatccatgatccctttagttttcacgacggcgtttatttattaccagggtaaagagttggggttggctgctgcggtagtcagtgcgctggcctcactgtcaccgacgctagggccaactctggggggctggatcactgataacctcgactggcgatggctattttatatcaatatattaccgggcatatatttagttttgagtattccttttctggttaattttgataaacctgatctctctttactgaaagttgctgattatccgagtattatcctgttggccatgacactgggatgtctggaatatacccttgaagaaggagcgcgctggggatggctggatgataatactattttgctgacatcagttctggcattggtgagttttattttatttgctgcgcgtacacttaaaatatccaatccgataatggatcttcatgcttttaaggataaatatttcacactgggatgtttcttttctttttctggaggggttggaatattctctactgtatatttaatacctgtgtttttggggcaggttcgcggattaaatgccgaagagataggttttgccgtttgcacaacaggtattttccagttattttctgttcccttttacttctggttaagtaaaaaaataaatctgcaatggctgttgatggcggggctgggcggatttgtgttttcaatgtatctttttacccctataacccacgaatggggatggcaggagttactgtttccacaggcaattagagggatttcgcagcagtttgcgatggcccccatcgtaacattaacgctggggggaattccaaaagaacggctgaagttagcctctggtgtatttaatttaacacgtaatcttgggggcgcaagtggtattgccctgtgtggctctattctcaataatcgaactaattttcatttttcgagaatgggtgaaaaaatggtttctgttccccatacgatgaatgacttcatttccagaagtgctttgttttttaatcgcagtggaagtgaccagacatcggaaatactggcttcaaccaaattattgagtcaattgatgctgagggaggcgcaaactatggcattttcggatacctttctgctaatcagtggtctgttatttatcgcatttttgttggttcctgctatgaataaatcatcctga

SEQ ID NO: 3444 - protein, 503 aa, Escherichia coli
MSMRKHIAFASMCIGLFIAQLDIQIVSSSLNEIGGGLSAGKDEMAWLQTSYLIAEIIVIPLSGWLSRVFSTRWLFTLSAGIFTLMSIACGLAWNIQIMIFFRALQGVAGASMIPLVFTTAFIYYQGKELGLAAAVVSALASLSPTLGPTLGGWITDNLDWRWLFYINILPGIYLVLSIPFLVNFDKPDLSLLKVADYPSIILLAMTLGCLEYTLEEGARWGWLDDNTILLTSVLALVSFILFAARTLKISNPIMDLHAFKDKYFTLGCFFSFSGGVGIFSTVYLIPVFLGQVRGLNAEEIGFAVCTTGIFQLFSVPFYFWLSKKINLQWLLMAGLGGFVFSMYLFTPITHEWGWQELLFPQAIRGISQQFAMAPIVTLTLGGIPKERLKLASGVFNLTRNLGGASGIALCGSILNNRTNFHFSRMGEKMVSVPHTMNDFISRSALFFNRSGSDQTSEILASTKLLSQLMLREAQTMAFSDTFLLISGLLFIAFLLVPAMNKSS

SEQ ID NO: 3445 - DNA, 1032 bp, Escherichia coli
gtgatgataatttctaaaaaacagcttattggggtggtagcgatcggtattcttttggctggcgttgtcttttttatctggtgggtaagcaaaggaagatttatacagacgacggatgatgcttacataggtggtaatatcaccacggtggcaagtaaagtttctggttatatttctgctatagaggtgcgcgataatcagagtgtaaaaaaaggcgatattatcctgcgtctcgatgatcgggattatcgtgcaaatgtcgccaggcttgaggcaaaaataaaaagtagcaaagccaatctcgaaagcattcaagccactattgcgatgcagcagtcgataattcaaagtgccagtgaaacatggcaggcagtaaaacatgaggagcaaaagcgcctgcgagatactgaacgttatgaaaaactcgcacaatcagcggcaatatcgcaacaaattattgataacgccaggtttgactaccagcaggtcgcagcaaaggagcgcaaagccgcgaacgatttcctggtggagaagcaacggctggcagttttatctgctcaggaagaaaacgtacgtgcaagtatcgaagaagttcaggccgctttgactcaggcactactggatctggaatatacccttgttcgtgcgccgattgatggcattgtcgcaaaccgcagcgcccatacaggcagttgggtggaaggcggcacatcgttagtttcactagtaccagtcagtgagttgtgggttgatgcaaattataaagaaaaccaaatagcgggaatgaagccaggaatgaaggctgagatccgtgctgatattctcaaaggggaagtgtttcacggtcacattgaaagcctttccccagcgacaggagccagtttcagcttgattccgatagaaaatgccactggcaatttcaccaaaattgttcagcgtgtcccggtacggattgcatttgacgacgcaaaggaattaaagcaacttcttcgcccgggactgtccgtcaccgtcagtgttgatgagagatga

SEQ ID NO: 3446 - protein, 343 aa, Escherichia coli
MMIISKKQLIGVVAIGILLAGVVFFIWWVSKGRFIQTTDDAYIGGNITTVASKVSGYISAIEVRDNQSVKKGDIILRLDDRDYRANVARLEAKIKSSKANLESIQATIAMQQSIIQSASETWQAVKHEEQKRLRDTERYEKLAQSAAISQQIIDNARFDYQQVAAKERKAANDFLVEKQRLAVLSAQEENVRASIEEVQAALTQALLDLEYTLVRAPIDGIVANRSAHTGSWVEGGTSLVSLVPVSELWVDANYKENQIAGMKPGMKAEIRADILKGEVFHGHIESLSPATGASFSLIPIENATGNFTKIVQRVPVRIAFDDAKELKQLLRPGLSVTVSVDER

SEQ ID NO: 3447 - DNA, 816 bp, Escherichia coli
atgacaatcacactgcaacccaaagcatcaccagggcatcacattatcggactggattcggaacatctgaatggaggcacagttccctggcataaacatctctatgcccagttgctttacccggctgaaggagtcgttcgtgtatgggctggagaaagcgtctggctagtgcatgccagcagcgcgctttggctgcccccacaaatgccgcataagtttgttgcgacaggcaacgtacttttaaaaaccgtactggtttcagaagcggaaagtgaaacgctgggaaaagtttgcttcatgacgggtatttcacccctgttaagagaattactaattgcaattaaccaacttccaccgtcgcaaagtaccacagataaacaacagttacgtttttcagccctcgagacactgatacttcaggaaataaaaatgggggtgaaaatgtcacttgaactcccttggccaaatgatgagcggctacagcagctttgtgagaatttgctaaacaaccaagggtatctgccaacactggataatctagcggataaaattaacgtcagtagccgtacactcatgcgcttatttgttaaagagacgggattaacatttcgccactgggttcagcaaatgcacgttatttctgcagtgacgcttcttgatgatggatattcgttgaccaaaattgcccatcgtctgggctatgcctcagctgaatcgttcggcaatatgtttaagcgtcgaacgggctactcgcccggtaaatttactcgtcgattaacgatgcatgattatgcaatcacaaggcaaatgatttaa

SEQ ID NO: 3448 - protein, 271 aa, Escherichia coli
MTITLQPKASPGHHIIGLDSEHLNGGTVPWHKHLYAQLLYPAEGVVRVWAGESVWLVHASSALWLPPQMPHKFVATGNVLLKTVLVSEAESETLGKVCFMTGISPLLRELLIAINQLPPSQSTTDKQQLRFSALETLILQEIKMGVKMSLELPWPNDERLQQLCENLLNNQGYLPTLDNLADKINVSSRTLMRLFVKETGLTFRHWVQQMHVISAVTLLDDGYSLTKIAHRLGYASAESFGNMFKRRTGYSPGKFTRRLTMHDYAITRQMI

SEQ ID NO: 3449 - DNA, 192 bp, Escherichia coli
ttgccctcatttcttcaggcagaaaaatcaaaaaatcgctttatgcttaaatactgcgacaaaccagacgcgaaacctggtacttactttttgttagtattaatctttttggtggtatggctgctgatgttgctggcgtggtatcttgttggcttgccgataggtccgggtatttacccacgtttgtcttaa

SEQ ID NO: 3450 - protein, 63 aa, Escherichia coli
MPSFLQAEKSKNRFMLKYCDKPDAKPGTYFLLVLIFLVVWLLMLLAWYLVGLPIGPGIYPRLS

SEQ ID NO: 3451 - DNA, 516 bp, Escherichia coli
atgctgagattacttgaagaaaaaattgccacgccactgggtccactgtgggtgatttgcgatgagcaatttcgcctgcgggcggttgaatgggaagagtacagcgaacgcatggtgcagctgctggacatccattatcgcaaagaaggctatgagcgcatttctgccaccaacccaggtggtttaagcgacaagcttcgtgaatattttgccggtaatcttagcattattgatacgcttcccactgccacgggggggacgccatttcagcgcgaagtctggaaaacactgcgcactatcccctgcgggcaggtaatgcattatggccaactggctgaacaattaggccgccctggcgcggcgcgtgccgttggtgcggcaaacggatcgaatcccatcagcatcgtcgtaccttgccatcgggttattggccgaaacggcaccatgaccggatatgcaggcggagttcagcgaaaagagtggttattgcgccacgaaggttatcttttgctgtaa

SEQ ID NO: 3452 - protein, 171 aa, Escherichia coli
MLRLLEEKIATPLGPLWVICDEQFRLRAVEWEEYSERMVQLLDIHYRKEGYERISATNPGGLSDKLREYFAGNLSIIDTLPTATGGTPFQREVWKTLRTIPCGQVMHYGQLAEQLGRPGAARAVGAANGSNPISIVVPCHRVIGRNGTMTGYAGGVQRKEWLLRHEGYLLL

SEQ ID NO: 3453 - DNA, 810 bp, Escherichia coli
ttgctccctaaaaagatgttaaaattgacaaatatcaattacggcttgagcagacctatgatcccggaaaagcgaattatacggcgcattcagtctggcggttgtgctatccattgccaggattgcagcatcagccagctttgcatcccgttcacactcaacgaacatgagcttgatcagcttgataatatcattgagcggaagaagcctattcagaaaggccagacgctgtttaaggctggagatgaactaaaatcgctttatgccatccgctccggtacgattaaaagttataccatcactgagcaaggcgacgagcaaatcactggtttccatttagcaggcgatctggtgggatttgatgccatcggcagcggtcatcacccgagtttcgcgcaggcgctggaaacctcgatggtatgtgaaatcccgttcgaaacgctggacgatttgtctggtaaaatgccgaatctgcgtcagcagatgatgcgtctgatgagcggtgaaatcaaaggcgatcaggacatgatcctgctgttgtcgaagaaaaatgccgaggaacgtctggctgcattcatctacaacctgtcccgtcgttttgcccaacgcggcttctcccctcgtgaattccgcctgacgatgactcgtggtgatatcggtaactatctgggcctgacggttgaaaccatcagccgtctgctgggtcgcttccagaaaagcggtatgctggcagtcaaaggtaaatacatcactatcgaaaataacgatgcgctggcccagcttgctggtcatacgcgtaacgttgcctga

SEQ ID NO: 3454 - protein, 269 aa, Escherichia coli
MLPKKMLKLTNINYGLSRPMIPEKRIIRRIQSGGCAIHCQDCSISQLCIPFTLNEHELDQLDNIIERKKPIQKGQTLFKAGDELKSLYAIRSGTIKSYTITEQGDEQITGFHLAGDLVGFDAIGSGHHPSFAQALETSMVCEIPFETLDDLSGKMPNLRQQMMRLMSGEIKGDQDMILLLSKKNAEERLAAFIYNLSRRFAQRGFSPREFRLTMTRGDIGNYLGLTVETISRLLGRFQKSGMLAVKGKYITIENNDALAQLAGHTRNVA

SEQ ID NO: 3455 - DNA, 951 bp, Escherichia coli
atggctatgtatcagaacatgctcgttgttatcgatcctaaccaggacgaccaaccagcattgcggcgagctgtttatttacatcaacggattggtggcaaaattaaagcctttttgccgatctatgacttctcatacgaaatgaccaccctgctctctccggacgaacgtaccgctatgcgtcagggcgtcatcagccagcgtacagcctggatccacgagcaggcaaaatattatctcaatgctggcgttcccattgaaattaaagtggtctggcataaccgtcctttcgaagccatcattcaggaagtgatcagcggcgggcacgatttggtgctaaaaatggcgcaccaacatgaccgtctggaagcggtgatttttacgccaacggactggcatctgttacgcaaatgcccaagcccggtgtggatggtgaaagaccagccgtggccggaagggggtaaggcgctggtggcggtgaatctcgccagtgaagagccgtaccataatgcgctcaatgaaaaactggtcaaagagacgatcgaactggcagaacaagtcaaccataccgaagttcatctggttggcgcttatccggtaacgccaattaatatcgcgattgaactgccggaatttgacccgagcgtttataacgatgccattcgtgggcaacatttgctggcaatgaaagctctgcggcagaaattcggcattaatgaaaacatgacgcacgtagaaaaaggtctgcccgaagaggtgattcctgatttggcggagcacttacaggcggggattgtggttctgggcacggtcggacgcaccggtatttcagcagcattccttggcaacacggcggaacaggtgattgatcatcttcgctgcgacctgctggtcattaaacctgaccagtatcagacacccgttgaactggatgacgaagaagacgattaa

SEQ ID NO: 3456 - protein, 316 aa, Escherichia coli
MAMYQNMLVVIDPNQDDQPALRRAVYLHQRIGGKIKAFLPIYDFSYEMTTLLSPDERTAMRQGVISQRTAWIHEQAKYYLNAGVPIEIKVVWHNRPFEAIIQEVISGGHDLVLKMAHQHDRLEAVIFTPTDWHLLRKCPSPVWMVKDQPWPEGGKALVAVNLASEEPYHNALNEKLVKETIELAEQVNHTEVHLVGAYPVTPINIAIELPEFDPSVYNDAIRGQHLLAMKALRQKFGINENMTHVEKGLPEEVIPDLAEHLQAGIVVLGTVGRTGISAAFLGNTAEQVIDHLRCDLLVIKPDQYQTPVELDDEEDD

SEQ ID NO: 3457 - DNA, 258 bp, Escherichia coli
atgattatggcgaaactgaagtcagcgaaagggaagaaatttctctttggtttgttggcggttttcattattgcggcgtcggttgtgactcgcgcgaccatcggcggcgttatagaacagtacaatattccgctgtctgagtggacgacatcaatgtatgtgattcagtcatcgatgatttttgtttatagcctggtctttactgtgttgctggcaatcccgttgggaatttatttccttggcggcgaagagcagtaa

SEQ ID NO: 3458 - protein, 85 aa, Escherichia coli
MIMAKLKSAKGKKFLFGLLAVFIIAASVVTRATIGGVIEQYNIPLSEWTTSMYVIQSSMIFVYSLVFTVLLAIPLGIYFLGGEEQ

SEQ ID NO: 3459 - DNA, 1032 bp, Escherichia coli
atgatcgctgaactgtttacaaataatgcgcttaatctggtcattattttcggtagctgcgcagcattgattctgatgagcttttggtttcgccgtggaaatcgtaaaagaaaaggatttttattccatgcggtgcaatttttaatctacaccataattattagtgctgttggtagcatcattaactatgttatagaaaactataaactcaaatttatcaccccaggcgttatcgattttatctgtacgtccctgattgcggttattctgacgattaagctatttctgctgattaatcagtttgaaaaacagcagattaaaaaaggtcgcgatatcaccagtgcgcggatcatgtcgcgcattatcaaaatcaccattattgtggtgcttgttctgctttatggcgaacatttcggcatgagcctttctggcttgttgacctttggtggtattggtggtctggctgtcggtatggccggtaaagatattctgagtaacttcttttccgggattatgctctatttcgaccgtcctttcagtattggcgactggatccgttcaccggacagaaatatcgaaggtacagtaacggaaattggctggcgaattaccaaaattaagacctttgataatcgtccattgtacgtaccgaactcgctgttttcgtcgatcagcgtagaaaatcctggacgaatgaccaaccggcgcattaccacgaccattggtttacgttatgaggatgcggcaaaagtgggcgttattgtcgaagccgtacgtgagatgctgaaaaatcacccggccatcgaccagcgacaaaccttactggtttatttcaaccagtttgctgattcgtcattaaatattatggtttattgctttaccaaaaccacggtatgggctgagtggcttgccgcacagcaagacgtttatttgaagattatcgatattgtacagtcacacggcgcggactttgccttccccagccagacgctgtatatggataacattacaccgccggaccagggtcgctaa

SEQ ID NO: 3460 - protein, 343 aa, Escherichia coli
MIAELFTNNALNLVIIFGSCAALILMSFWFRRGNRKRKGFLFHAVQFLIYTIIISAVGSIINYVIENYKLKFITPGVIDFICTSLIAVILTIKLFLLINQFEKQQIKKGRDITSARIMSRIIKITIIVVLVLLYGEHFGMSLSGLLTFGGIGGLAVGMAGKDILSNFFSGIMLYFDRPFSIGDWIRSPDRNIEGTVTEIGWRITKIKTFDNRPLYVPNSLFSSISVENPGRMTNRRITTTIGLRYEDAAKVGVIVEAVREMLKNHPAIDQRQTLLVYFNQFADSSLNIMVYCFTKTTVWAEWLAAQQDVYLKIIDIVQSHGADFAFPSQTLYMDNITPPDQGR

SEQ ID NO: 3461 - DNA, 1614 bp, Escherichia coli
atgaagcactctgtttcagtcacgtgttgtgcgctgttggtcagcagcatttctctttcgtatgctgctgaagttccgagcggcacagtactggcagagaagcaggagctggtgcgccacattaaagatgagccagcgtcgctggatcccgctaaagccgtgggcctgccggagattcaggtcattcgcgatctgtttgaaggactggtgaatcagaacgagaaaggggagattgtccccggcgttgcgactcagtggaaaagtaatgacaaccgtatatggacttttaccctgcgcgataacgcaaaatgggcggatggcacaccggtaacggcgcaagattttgtctacagctggcaacgtctggtggacccgaaaacgctatcgccatttgcatggtttgccgcgctggcgggaatcaacaacgcacaggcgattattgatggtaaagccgcgcctgaccagcttggcgtcaccgcagttgatgcccatactttgaaaatccagcttgataaaccattgccgtggtttgtgaatttaaccgctaactttgccttcttcccggtgcaaaaagccaacgtagaaagcagtaaagagtggacgaaacccggaaatctgatcggcaatggcgcttatgttcttaaagagcgcgtagtcaatgaaaaactggtcgtagtgccgaatacccattattgggataacgccaaaacggtactgcaaaaagtgaccttcctgccaattaatcaggaatccgcagccactaagcgttatctcgcgggggatattgatatcaccgaatccttcccgaaaaatatgtatcagaagttgttgaaggatattccggggcaggtttatacgccgccgcagctcgggacctattattatgcgtttaacacgcaaaaagggccgacggcagatcagcgcgttcgcctggcattaagtatgacgatagatcgccgcctgatgaccgaaaaagtgttggggacgggcgaaaagccagcgtggcattttacaccagatgttaccgcgggatttacgccggaaccttcgccgtttgaacaaatgagtcaggaagaactgaatgcgcaggcaaaaactttgttgagcgcagctggttatggtccgcaaaaaccgctgaagttgacgcttttgtataacacttcagaaaaccatcaaaaaattgcgattgctgtagcatcgatgtggaaaaagaacctgggcgtagatgttaaattgcaaaaccaggaatggaaaacctatatcgatagccgtaataccggcaattttgatgttatccgcgcctcgtgggtaggggattataatgaaccctccactttcctgacattattaacgtcaacgcattccgggaatatttcacgctttaacaatccggcatatgacaaagttctggcccaggcatcgacggaaaataccgttaaagcgcgtaatgccgattacaacgcggcagaaaaaatcctcatggagcaagcaccgattgcaccaatttatcaatataccaatggacgattaatcaagccgtggctgaaaggttatcccattaataaccctgaagatgtggcgtacagtcggactatgtatattgtgaagcattaa

SEQ ID NO: 3462 - protein, 537 aa, Escherichia coli
MKHSVSVTCCALLVSSISLSYAAEVPSGTVLAEKQELVRHIKDEPASLDPAKAVGLPEIQVIRDLFEGLVNQNEKGEIVPGVATQWKSNDNRIWTFTLRDNAKWADGTPVTAQDFVYSWQRLVDPKTLSPFAWFAALAGINNAQAIIDGKAAPDQLGVTAVDAHTLKIQLDKPLPWFVNLTANFAFFPVQKANVESSKEWTKPGNLIGNGAYVLKERVVNEKLVVVPNTHYWDNAKTVLQKVTFLPINQESAATKRYLAGDIDITESFPKNMYQKLLKDIPGQVYTPPQLGTYYYAFNTQKGPTADQRVRLALSMTIDRRLMTEKVLGTGEKPAWHFTPDVTAGFTPEPSPFEQMSQEELNAQAKTLLSAAGYGPQKPLKLTLLYNTSENHQKIAIAVASMWKKNLGVDVKLQNQEWKTYIDSRNTGNFDVIRASWVGDYNEPSTFLTLLTSTHSGNISRFNNPAYDKVLAQASTENTVKARNADYNAAEKILMEQAPIAPIYQYTNGRLIKPWLKGYPINNPEDVAYSRTMYIVKH

SEQ ID NO: 3463 - DNA, 813 bp, Escherichia coli
atggcgcagtcagctttaagccagatagtgcgccgtatagaagaacgattgggattgcggcttctgacgcgaaccacgcgcagcgttgtacccactgaagcgggcgagcatcttttgtctgttcttggccctatgttgcatgacatagattctgccctgacatccctgagcgatctgcagaaccgcccatccgggacaatacgtattactactgtagaacatgcagcaaaaacgatattgttaccagctatgcgcacattcctgaaatcgcatcctgaaattgatattcagcttaccattgattatggtttgaccgatgtcgtttctgaacgttttgatgcaggcgtccgtctgggtggggagatggataaagatatgatcgccattcgaatcgggccagacataccaatggctattgttggctcaccggattatttttctcgtcgaagtgctccaacgtcagtgtcacaattaatagatcatcaggcaattaatttgtatcttcccacatcgggtacagcaaatcgctggagattaatacgcggtggacgtgaagttcgtgttcgcatggaaggtcagcttttactgaatacgatagacctgatcattgatgctgcaattgatgggcatggattggcgtatctaccttatgatcaggttgagcgggctattaaaggaaaaaaactgatacgtgttttggataaattcacaccagatttacccggttatcacctgtactatccacaccgtcgacatgctggctcggcattctcattatttatagataggctgaagtataaaggtgctgtttag

SEQ ID NO: 3464 - protein, 270 aa, Escherichia coli
MAQSALSQIVRRIEERLGLRLLTRTTRSVVPTEAGEHLLSVLGPMLHDIDSALTSLSDLQNRPSGTIRITTVEHAAKTILLPAMRTFLKSHPEIDIQLTIDYGLTDVVSERFDAGVRLGGEMDKDMIAIRIGPDIPMAIVGSPDYFSRRSAPTSVSQLIDHQAINLYLPTSGTANRWRLIRGGREVRVRMEGQLLLNTIDLIIDAAIDGHGLAYLPYDQVERAIKGKKLIRVLDKFTPDLPGYHLYYPHRRHAGSAFSLFIDRLKYKGAV

SEQ ID NO: 3465 - DNA, 918 bp, Escherichia coli
atgaataataaagtcagcttcactaacagcaataatccaaccatctctttgtctgcagtgatctatttccctccaaaatttgatgaaacccgtcagtatccggcaattgtggtatctcacccaggtgggggcgttaaagagcaaacggccggaacctatgccgaaaaactggcggaaaagggatttgtcactattgcttatgacgcatcttatcaaggtgaaagcggcggcgagccgcgtcagttagaaaacccatacattcgtactgaagacgtcagtgccgtgattgattacctgacaacgctttcttatgtcgacaatacccgaattggtgcgatgggaatttgtgccggagcaggatatacagccaatgctgcaattcaggatcgccgcatcaaggccatcggtactgttagtgcggtcaatattggttcgatgttccgtaatggttgggaaaacaatgtgaaatctattgatgccctaccatacgttgacgcgggttcaaacgcccgaaccagcgatattagcagcggagaatacgccactatgccactggcaccaatgaaggagtccgatgcgccgaacgaagaactgcgtcaggcctgggagtattaccacacccctcgcgcgcagtatccaacagcaccgggttacgctactttgcgcagccttaaccagattattacctatgatgcttaccatatggcggaagtgtacctgactcagccgatacagattgtggcgggcagccaggctgggagcaaatgcatgagtgacgacctgtacgatcgagcatcaagccaggataaacgctatcacattgttgaaggcgcaaaccatatggatctttatgatggcaaagtctatgtggctgaagcaatttcagtattagctccgttctttgaggaaactctgtaa

SEQ ID NO: 3466 - protein, 305 aa, Escherichia coli
MNNKVSFTNSNNPTISLSAVIYFPPKFDETRQYPAIVVSHPGGGVKEQTAGTYAEKLAEKGFVTIAYDASYQGESGGEPRQLENPYIRTEDVSAVIDYLTTLSYVDNTRIGAMGICAGAGYTANAAIQDRRIKAIGTVSAVNIGSMFRNGWENNVKSIDALPYVDAGSNARTSDISSGEYATMPLAPMKESDAPNEELRQAWEYYHTPRAQYPTAPGYATLRSLNQIITYDAYHMAEVYLTQPIQIVAGSQAGSKCMSDDLYDRASSQDKRYHIVEGANHMDLYDGKVYVAEAISVLAPFFEETL

SEQ ID NO: 3467 - DNA, 639 bp, Escherichia coli
atgaacaatgtactgattcttggtgctggcggtcagatagcccgccatgtgattaatcaactggcagataaacaaaccattaaacaaactttatttgcccgtcagccagcaaaaatccacaaaccctatccaactaatagcaagattattatgggggatgtactgaatcatgcagcactgaagcaggccatgcagggacaggatgttgtgtatgccaaccttacgggggaagatttagatattcaggcaaattcagtgatcgctgcgatgaaagcctgtgatgttaaacgtctgatctttgttctttccctcggtatttatgatgaagttccaggaaaatttggcgaatggaataatgcagttattggtgaacccctaaaaccattccgcagggctgcggatgcaattgaggcttctggactggaatatacaattcttcgccctgcctggctgactgatgaagatattattgattatgagcttacctcacgcaatgaaccattcaaaggtacgatcgtatcacgtaagagtgtcgcagcattaatcacagatatcatcgataaacctgagaaacacattggtgagaatataggcatcaatcaacccgggactgatggtgataagcccttcttcatgtaa

SEQ ID NO: 3468 - protein, 212 aa, Escherichia coli
MNNVLILGAGGQIARHVINQLADKQTIKQTLFARQPAKIHKPYPTNSKIIMGDVLNHAALKQAMQGQDVVYANLTGEDLDIQANSVIAAMKACDVKRLIFVLSLGIYDEVPGKFGEWNNAVIGEPLKPFRRAADAIEASGLEYTILRPAWLTDEDIIDYELTSRNEPFKGTIVSRKSVAALITDIIDKPEKHIGENIGINQPGTDGDKPFFM

SEQ ID NO: 3469 - DNA, 966 bp, Escherichia coli
atgagaaccgttaaggtatttgaggaggcctggcccttacataccccgtttgtgattgctcggggaagtcgcagtgaagcgcgcgtggtggtggttgaactggaagaagaaggtattaaaggcaccggtgaatgcacgccgtatccgcgttatggagaaagtgatgcctcggtaatggcgcaaattatgagcgtcgtgccgcaattagagaaagggctgacacgggaggagttgcaaaaaatcctccctgccggcgcagcacgtaatgcgctggattgtgcattgtgggatctggcggcgcgaaaacagcagcaatcgctggctgatttgatcggcataacgcttcccgagacagtcaccacggcacagacgatagtcatcggtacgcctgatcagatggccaatagtgcatcaacactctggcaggcaggcgcgaaattactgaaagtgaagctggataaccatcttatcagtgagcggatggtggcaattcgcacagctgtgcccgatgcgacgctgatcgttgatgcaaatgaatcctggcgtgcagaagggttggcggcgcgttgccagctattggcggatttaggcgttgcgatgcttgaacaaccgcttcctgcgcaggacgatgcggcgctggagaattttattcatccgttaccgatttgtgctgatgaaagttgtcatactcgtagcaatctgaaggcgctgaaagggcgctatgagatggttaacattaagcttgataaaaccggtggtctgacggaagcgctggcgctggcgactgaagcgcgtgcacaaggttttcgtctgatgctgggctgcatgttgtgtacctctcgtgccattagcgccgctttaccgctggtgccgcaggtcagtttcgccgatcttgacggaccgacctggctggcggtagatgtggaaccggcgcttcagtttacgacgggcgaattgcatctttag

SEQ ID NO: 3470 - protein, 321 aa, Escherichia coli
MRTVKVFEEAWPLHTPFVIARGSRSEARVVVVELEEEGIKGTGECTPYPRYGESDASVMAQIMSVVPQLEKGLTREELQKILPAGAARNALDCALWDLAARKQQQSLADLIGITLPETVTTAQTIVIGTPDQMANSASTLWQAGAKLLKVKLDNHLISERMVAIRTAVPDATLIVDANESWRAEGLAARCQLLADLGVAMLEQPLPAQDDAALENFIHPLPICADESCHTRSNLKALKGRYEMVNIKLDKTGGLTEALALATEARAQGFRLMLGCMLCTSRAISAALPLVPQVSFADLDGPTWLAVDVEPALQFTTGELHL

SEQ ID NO: 3471 - DNA, 789 bp, Escherichia coli
ttgataatccgcaaaatttgcacaacactgcctgtaatacttcctgaaccagagacgatcatgaccgtaactcgcccacgcgccgaacgcggcgcatttccgcccggaacagaacattacggacgttcattattgggcgcgccgttaatctggtttccggcccctgcagccagtcacgaaagtggtttgattctggctggcactcacggtgatgaaaactcttcgatcgtcacgctctcctgtgctctgcggactttgacaccttctttgcgccgccatcatgtggtgctgtgtgtgaatcctgacggctgccagttagggttacgggccaatgctaatggtgtggatttaaaccgaaactttccggcagcgaactggaaggaaggtgaaacagtttatcgctggaacagcgccgctgaagaacgtgatgtcgttttactgacaggtgacaaacctggctccgaacctgaaacccaggcgctgtgccagcttatacaccgcattcaacctgcctgggtggtctcattccacgatccgctggcctgtattgaagatcccagacacagcgaattaggtgaatggctggcccaggcgtttgaattgcctctggtaaccagcgtcggttatgaaacgcctggctctttcggcagttggtgtgcagatctcaacttgcattgcatcaccgcagagtttccacccatctcctccgacgaagccagcgaaaaatatctctttgcgatggcaaacttgctgcgctggcatcctaaagatgcaattcgcccgtcgtaa

SEQ ID NO: 3472 - protein, 262 aa, Escherichia coli
MIIRKICTTLPVILPEPETIMTVTRPRAERGAFPPGTEHYGRSLLGAPLIWFPAPAASHESGLILAGTHGDENSSIVTLSCALRTLTPSLRRHHVVLCVNPDGCQLGLRANANGVDLNRNFPAANWKEGETVYRWNSAAEERDVVLLTGDKPGSEPETQALCQLIHRIQPAWVVSFHDPLACIEDPRHSELGEWLAQAFELPLVTSVGYETPGSFGSWCADLNLHCITAEFPPISSDEASEKYLFAMANLLRWHPKDAIRPS

SEQ ID NO: 3473 - DNA, 507 bp, Escherichia coli
atgtcacaaaccgttcatttccagggcaacccggttacagtcgccaattccatcccgcaggcaggtagcaaagcgcagacttttactctcgtggcaaaagatctgtctgacgtcaccctcggtcagtttgcgggtaaacgcaaagtgctgaacattttcccgagtattgataccggtgtttgcgccgcatcagtacgtaagtttaaccaactggcaaccgagatcgacaacaccgttgtgctgtgtatctctgccgatctgccgttcgcccagtctcgtttctgcggcgcagaaggtctgaacaacgttatcaccctctccactttccgtaacgctgaattcctgcaagcctacggtgtggcaattgctgatggcccactgaaaggtctggcagcgcgtgccgttgtggttattgatgaaaatgacaatgtgattttcagccagctggtggatgaaatcaccaccgagccggattacgaagcagctctggctgtactgaaagcataa

SEQ ID NO: 3474 - protein, 168 aa, Escherichia coli
MSQTVHFQGNPVTVANSIPQAGSKAQTFTLVAKDLSDVTLGQFAGKRKVLNIFPSIDTGVCAASVRKFNQLATEIDNTVVLCISADLPFAQSRFCGAEGLNNVITLSTFRNAEFLQAYGVAIADGPLKGLAARAVVVIDENDNVIFSQLVDEITTEPDYEAALAVLKA

SEQ ID NO: 3475 - DNA, 1542 bp, Escherichia coli
atgcgtctggaagtcttttgtgaagaccgactcggtctgacccgcgaattactcgatctactcgtgctaagaggcattgatttacgcggtattgagattgaccccattgggcgaatctacctcaattttgctgaactggagtttgagagtttcagcagtctgatggccgaaatacgccgtattgcaggtgttaccgatgtgcgtactgtcccgtggatgccttccgaacgtgagcatctggcgttgagcgcgttactggaggcgttgcctgaacctgtgctctctgtcgatatgaaaagcaaagtggatatggcgaacccggcgagctgtcagctttttgggcaaaaattggatcgcctgcgcaaccataccgccgcgcaattgattaacggctttaattttttacgctggctggaaagcgaaccgcaagattcgcataacgagcatgtcgttattaatgggcagaatttcctgatggagattacgcctgtttatcttcaggatgaaaatgatcaacacgtcctgaccggtgcggtggtgatgctgcgatcaacgattcgtatgggccgtcagttgcaaaatgtcgccgcccaggatgtcagcgccttcagtcaaattgtcgctgtcagcccgaaaatgaagcatgttgtcgaacaggcgcagaaactggcgatgctaagcgcgccactgctgattacgggtgataccggcaccggaaaagatctctttgcgtatgcctgtcatcaggcaagccccagagcgagcaaaccttacctggcactgaactgtgcgtctataccggaagatgcggtcgagagtgaactgtttggtcatgctccggaagggaagaaagggttctttgagcaggcgaacggtggttcggtgctgttggatgaaataggtgagatgtcaccacggatgcaggcgaaattactgcgtttccttaatgatggcaccttccgtcgggttggcgaagaccatgaggtgcatgtcgatgtgcgggtgatttgtgctacgcagaagaatctggtcgaactggtgcaaaaaggcgtgttccgtgaagatctctattatcgtctgaacgtgttgacgctcaatctgccgccgctacgtgactgtccgcaggacatcatgccgttaaccgagctgttcgtcgcccgctttgccgacgagcagggcgtgccgcgtccgaaactggccgctgatctgaatactgtacttacgcgttatgcgtggccgggaaatgtgcggcagttaaagaacgctatctatcgcgcactgacacaactggacggttatgagctgcgtccacaggatattttgttgccggattatgacgccgcaacggtagccgtgggcgaagatgcgatggaaggttcgctggacgaaatcaccagccgttttgaacgctcggtattaacccagctttatcgcaattatcccagcacgcgcaaactggcaaaacgtctcggcgtttcacataccgcgattgccaataagttgcgggaatatggtctgagtcagaagaagaacgaagagtaa

SEQ ID NO: 3476 - protein, 513 aa, Escherichia coli
MRLEVFCEDRLGLTRELLDLLVLRGIDLRGIEIDPIGRIYLNFAELEFESFSSLMAEIRRIAGVTDVRTVPWMPSEREHLALSALLEALPEPVLSVDMKSKVDMANPASCQLFGQKLDRLRNHTAAQLINGFNFLRWLESEPQDSHNEHVVINGQNFLMEITPVYLQDENDQHVLTGAVVMLRSTIRMGRQLQNVAAQDVSAFSQIVAVSPKMKHVVEQAQKLAMLSAPLLITGDTGTGKDLFAYACHQASPRASKPYLALNCASIPEDAVESELFGHAPEGKKGFFEQANGGSVLLDEIGEMSPRMQAKLLRFLNDGTFRRVGEDHEVHVDVRVICATQKNLVELVQKGVFREDLYYRLNVLTLNLPPLRDCPQDIMPLTELFVARFADEQGVPRPKLAADLNTVLTRYAWPGNVRQLKNAIYRALTQLDGYELRPQDILLPDYDAATVAVGEDAMEGSLDEITSRFERSVLTQLYRNYPSTRKLAKRLGVSHTAIANKLREYGLSQKKNEE

SEQ ID NO: 3477 - DNA, 1062 bp, Escherichia coli
atgaccgaaccgttaaaaccacgtattgatttcgacggtccactggaggtcgatcagaatccaaaattcagggcgcagcagacctttgacgaaaatcaggcgcaaaattttgccccagccacgctcgatgaagcgcaggaagaagaggggcaagttgaagcggtaatggatgcagcgttacgtccgaaacgcagcctgtggcgcaaaatggtgatgggcgggctggctctgtttggcgcaagcgttgtcgggcagggcgtgcagtggacaatgaacgcctggcaaacccaggactgggtggcgctgggtggatgtgccgctggggcattgattatcggcgctggcgtaggttctgtggtaacagagtggcggcgcttatggcgcttgcgacagcgcgcccatgaacgcgacgaagcgcgcgatttgttgcacagtcacggcacgggtaaaggccgtgcattctgcgaaaaactggcgcagcaggcgggcatcgatcagtcacatccggcgctgcagcgctggtatgcctcaatccatgaaacgcagaacgatcgtgaagtggtcagcctgtatgctcacctggtccagccagttttagatgcccaggcgcggcgcgaaatcagccgttcggcagcggaatcaacgttaatgattgccgttagcccactggcgctggtggatatggcgtttatcgcctggcgcaatctgcgtttgattaatcgcatcgccacgctgtatggcattgaactgggatattacagccgtttgcgcctgtttaagctggtattgctgaatattgcttttgccggagccagcgaactggtgcgcgaagtggggatggactggatgtcgcaagatctcgctgcgcgtttgtctacccgggcagctcaggggattggtgctggacttctgacggcacgactggggattaaagctatggagctttgccgcccgctgccgtggattgacgatgacaaacctcgcctcggggatttccgtcgtcagcttatcggtcaggtgaaagagacgctgcaaaaaggcaaaacgcccagcgaaaaataa

SEQ ID NO: 3478 - protein, 353 aa, Escherichia coli
MTEPLKPRIDFDGPLEVDQNPKFRAQQTFDENQAQNFAPATLDEAQEEEGQVEAVMDAALRPKRSLWRKMVMGGLALFGASVVGQGVQWTMNAWQTQDWVALGGCAAGALIIGAGVGSVVTEWRRLWRLRQRAHERDEARDLLHSHGTGKGRAFCEKLAQQAGIDQSHPALQRWYASIHETQNDREVVSLYAHLVQPVLDAQARREISRSAAESTLMIAVSPLALVDMAFIAWRNLRLINRIATLYGIELGYYSRLRLFKLVLLNIAFAGASELVREVGMDWMSQDLAARLSTRAAQGIGAGLLTARLGIKAMELCRPLPWIDDDKPRLGDFRRQLIGQVKETLQKGKTPSEK

SEQ ID NO: 3479 - DNA, 1470 bp, Escherichia coli
atggcctggcccccacattcatattcttacgaacgattttttttctggtcttcagagcagcacaggacagcaatgaagcgacttaaaaatgaactcaatgcgctggtgaatcggggtgtcgacagacatctgcgcctcgctgtaaccggacttagccgcagcggcaaaacagcgtttatcaccgcgatggttaatcagttgctcaatattcatgccggagcacgtttgccgcttttaagtgcggtgcgtgaagagcgcctgctgggcgtaaaacgcattccccagcgtgactttggcattccgcgcttcacctatgatgaagggttggcgcagttatatggcgatcctcccgcctggccgacgcctacgcgcggcgtcagtgaaattcgcctggcgttacgttttaaatcgaacgattcgctgctgcgccactttaaggacacctccacgctgtatcttgagattgtggattatcccggcgaatggctgctcgacctgccgatgctggcacaggactattttagctggtcgcgccagatgacgggcttactcaatggtcagcgcggcgaatggtcggcgaaatggcgaatgatgtgcgaagggctggacccgctagcgcctgccgacgaaaaccggctggcagacattgccgccgcgtggaccgattatctccatcactgcaaacagcaggggctgcactttattcagccaggacgctttgttttgcctggcgatatggcaggagcgcccgcgctgcaattcttcccatggccagatgtcgatgcctggggcgagtctaaactggcgcaggccgataaacacaccaacgccggaatgttgcgcgagcgttttaattattactgcgagaaagtggtgaaggggttctataagaatcacttcctgcgttttgaccgccagattgtgctggtggactgcctgcaaccgctcaacagtggaccacaggcatttaatgatatgcgtctggcgctgacgcagctgatgcaaagtttccactacgggcagcgtaccctgttccggcgtttgttttcgccggttattgataagctattgtttgctgccactaaagcggaccatgtgaccatcgatcagcacgccaatatggtttcattgctgcaacaactgattcaggatgcctggcaaaatgcggcgttcgaagggatcagtatggactgcctggggctggcgtctgttcaggcgaccaccagcggaattattgatgttaacggtgagaaaatcccggcgctgcgcggtaatcgactcagcgatggcgcaccgctcactgtttatcctggcgaagttcccgcacgtttgcctggtcaggcgttctgggataagcaaggcttccagtttgaggcgtttcgtccgcaggtgatggatgtcgacaaaccgctaccgcatattcgtcttgatgctgcgctggaatttttaataggagataaattgcgatga

SEQ ID NO: 3480 - protein, 489 aa, Escherichia coli
MAWPPHSYSYERFFFWSSEQHRTAMKRLKNELNALVNRGVDRHLRLAVTGLSRSGKTAFITAMVNQLLNIHAGARLPLLSAVREERLLGVKRIPQRDFGIPRFTYDEGLAQLYGDPPAWPTPTRGVSEIRLALRFKSNDSLLRHFKDTSTLYLEIVDYPGEWLLDLPMLAQDYFSWSRQMTGLLNGQRGEWSAKWRMMCEGLDPLAPADENRLADIAAAWTDYLHHCKQQGLHFIQPGRFVLPGDMAGAPALQFFPWPDVDAWGESKLAQADKHTNAGMLRERFNYYCEKVVKGFYKNHFLRFDRQIVLVDCLQPLNSGPQAFNDMRLALTQLMQSFHYGQRTLFRRLFSPVIDKLLFAATKADHVTIDQHANMVSLLQQLIQDAWQNAAFEGISMDCLGLASVQATTSGIIDVNGEKIPALRGNRLSDGAPLTVYPGEVPARLPGQAFWDKQGFQFEAFRPQVMDVDKPLPHIRLDAALEFLIGDKLR

SEQ ID NO: 3481 - DNA, 999 bp, Escherichia coli
atgtcccctactatttatgatattgccagggttgcaggcgtatcaaaatccaccgtatcacgcgtgctgaataagcaaaccaatatctccccggaagcgcgcgaaaaagtgttacgggccattgaagaattacagtatcaaccaaacaagctggcacgcgcgctgacctcttcgggttttgatgccattatggtgatttctacccgttcgaccaaaactacggcgggtaatccgtttttctcggaagttttacatgccatcaccgccaaagctgaagaagaaggtttcgacgtgatattgcagacgtcgcacaacctggcagaagacttacataaatgcgaaagcaaaattaagcagaaaatgattaaaggcattattatgctaagttcgccagcggatgagtcattttttgcccaactcgataaatatgatattccggtagtggtaattggcaaagttgaaggtcaatacagccatgtttattccgtcgataccgataattatggcgacagtattgcgctaaccgatgcgttaattgaaagcgggcataagaatattgcctgcctgcatgcgccgcttgatgttcatgtttcagtggatcgggtaaatggttataagcaaagcctggctacgcataatattgcagtgcgtgatgaatggattgttgacggcggttatacccatgagacagcattaaaagcagcacgggaattattaagccagtcaccgttgcctgaggcagtgtttgctactgacagcctgaaattaatgagtatttatcgtgcggcggcagagaaaaacattgctattccgcagcagttagcggtggtgggttatagtaatgaaacgctgtcgtttatattaacgcctgcaccaggcggcatcgatgttccgacgcaggagttaggtcaacgaagctgcgagttattattccagttaattgccggaaaaccgtcaccacaaaatattaccgttgctacgcatatgtcgttgaaataa

SEQ ID NO: 3482 - protein, 332 aa, Escherichia coli
MSPTIYDIARVAGVSKSTVSRVLNKQTNISPEAREKVLRAIEELQYQPNKLARALTSSGFDAIMVISTRSTKTTAGNPFFSEVLHAITAKAEEEGFDVILQTSHNLAEDLHKCESKIKQKMIKGIIMLSSPADESFFAQLDKYDIPVVVIGKVEGQYSHVYSVDTDNYGDSIALTDALIESGHKNIACLHAPLDVHVSVDRVNGYKQSLATHNIAVRDEWIVDGGYTHETALKAARELLSQSPLPEAVFATDSLKLMSIYRAAAEKNIAIPQQLAVVGYSNETLSFILTPAPGGIDVPTQELGQRSCELLFQLIAGKPSPQNITVATHMSLK

SEQ ID NO: 3483 - DNA, 906 bp, Escherichia coli
atgaaaaagttattactctgtaccgcactggtgatgtgtgcgggaatggcctgcgcacaggccgaggaaaagaacgactggcactttaatatcggcgcgatgtacgaaatagaaaacgtcgaaggttatggcgaagatatggatgggctggcggagccttctgtctattttaatgccgccaacgggccgtggagaatttctctggcctattatcaggaagggccggtagattatagcgcgggtaaacgtggaacgtggtttgatcgcccggagctggaggtacattatcagttcctcgaaagcgatgatttcagtttcggtctgactggtggtttccgtaattatggttatcactacgttgatgaaccgggtaaagacacggcgaatatgcagcgctggaaaattgcgccagactgggatgtgaaactgactgacgatttacgtttcaacggttggctgtcgatgtataaatttgccaacgatctgaatacgaccggttatgctgatacccgtgtcgaaacggaaacaggtctgcaatataccttcaacgaaacgcttgccttgcgagtgaactattatctcgagcgtggtttcaatatggatgatagccgcaataacggtgagttttccacgcaagaaattcgcgcctatttgccgctgacgctcggcaaccactcggtgacgccgtatacgcgcattgggctggatcgctggagtaactgggactggcaggatgatattgaacgtgaaggccatgattttaaccgtgtgggtttattttacggttatgatttccagaatggtctttccgtttcgctggaatacgcgtttgagtggcaggatcacgacgaaggcgacagcgataaattccattatgcgggtgttggggtgaattactcgttctga

SEQ ID NO: 3484 - protein, 301 aa, Escherichia coli
MKKLLLCTALVMCAGMACAQAEEKNDWHFNIGAMYEIENVEGYGEDMDGLAEPSVYFNAANGPWRISLAYYQEGPVDYSAGKRGTWFDRPELEVHYQFLESDDFSFGLTGGFRNYGYHYVDEPGKDTANMQRWKIAPDWDVKLTDDLRFNGWLSMYKFANDLNTTGYADTRVETETGLQYTFNETLALRVNYYLERGFNMDDSRNNGEFSTQEIRAYLPLTLGNHSVTPYTRIGLDRWSNWDWQDDIEREGHDFNRVGLFYGYDFQNGLSVSLEYAFEWQDHDEGDSDKFHYAGVGVNYSF

SEQ ID NO: 3485 - DNA, 1083 bp, Escherichia coli
atggcacagctttcgttacaacatattcaaaagatctacgataaccaggtgcatgtggtgaaggacttcaacctggagattgccgataaagagttcatcgtgtttgtcggtccgtcgggctgcggtaaatcgaccaccctgcgtatgattgccgggcttgaggagatcagcggcggtgatctgttgatcgacggcaaacgaatgaatgacgttccagccaaagcacgcaatatcgcgatggtgttccagaactacgcgctgtatccgcatatgacggtctacgacaacatggcgtttggcctgaagatgcaaaaaatcgccagagaggtgattgatgagcgggtgaactgggcggcgcaaattctcggcctgcgtgagtacctgaaacgcaagccgggcgcgctttccggcgggcaacgtcagcgagtggcgcttgggcgggcgattgtgcgcgaagcgggcgtgtttttaatggatgagccgctctctaacctggatgccaagctgcgcgtgcaaatgcgcgcagagatcagcaagctgcatcagaaactgaacaccaccatgatctacgtgacccacgatcagaccgaagcgatgaccatggcgacgcggattgtcattatgaaggatgggattgttcagcaggtcggtgcgccgaaaacggtttataaccaacctgcgaatatgtttgttgccggatttattggatcaccagcgatgaattttattcgcggcacgatcgatggcgataaattcgttacggaaacgcttaaattaaccatacccgaagagaaattagcggttctgaaaacacaggaaagtttgcataagcccatcgtaatgggaatacgcccggaagatattcatccggacgcgcaagaggaaaataacatttccgccaaaattagcgtggcggaattaaccggtgcggaatttatgctctacaccacggttggggggcacgagttagtggtccgtgctggtgcgttaaatgattatcatgcaggagaaaatatcactattcattttgatatgactaaatgtcatttctttgatgcagaaacggaaatagcaatttgctaa

SEQ ID NO: 3486 - protein, 360 aa, Escherichia coli
MAQLSLQHIQKIYDNQVHVVKDFNLEIADKEFIVFVGPSGCGKSTTLRMIAGLEEISGGDLLIDGKRMNDVPAKARNIAMVFQNYALYPHMTVYDNMAFGLKMQKIAREVIDERVNWAAQILGLREYLKRKPGALSGGQRQRVALGRAIVREAGVFLMDEPLSNLDAKLRVQMRAEISKLHQKLNTTMIYVTHDQTEAMTMATRIVIMKDGIVQQVGAPKTVYNQPANMFVAGFIGSPAMNFIRGTIDGDKFVTETLKLTIPEEKLAVLKTQESLHKPIVMGIRPEDIHPDAQEENNISAKISVAELTGAEFMLYTTVGGHELVVRAGALNDYHAGENITIHFDMTKCHFFDAETEIAIC

SEQ ID NO: 3487 - DNA, 660 bp, Escherichia coli
atgaaactgcaaggggtaattttcgatctggatggagtaatcacagatagcgcacatctgcatttccaggcgtggcagcagattgccgctgaaattggcatcagcattgatgcgcagtttaacgaattcctaaaagggatcagccgcgatgagtccctgcggcgaattctgcagcacgggggtaaagagggcgattttaacccacaggaacgggcgcaactggcgtatcgcaaaaatctgctttacgtccactcactgcgcgaactgacggttaatgctgtgctgcctggcattcacaatttgctggtagatctccgagcacagcagattccggttgggctggcttctgtctccctgaatgcgccgacgattttagcagcgctggagctgcgcgagtttttcaccttctgcgcggacgcttcccaactcaaaaattcgaaaccggacccggaaatctttctcgccgcctgtgcagggctgggcgtgccgccacaggcatgtatcggcattgaagatgcgcaggcgggcattgaagccattaacgccagcggtatgcgctcggtggggatcggcgcgggcttaaccggggcgcaattattgttgccctcaacggactccctgacctggccgcggttatcggccttctggcaaaacgtatag

SEQ ID NO: 3488 - protein, 219 aa, Escherichia coli
MKLQGVIFDLDGVITDSAHLHFQAWQQIAAEIGISIDAQFNEFLKGISRDESLRRILQHGGKEGDFNPQERAQLAYRKNLLYVHSLRELTVNAVLPGIHNLLVDLRAQQIPVGLASVSLNAPTILAALELREFFTFCADASQLKNSKPDPEIFLAACAGLGVPPQACIGIEDAQAGIEAINASGMRSVGIGAGLTGAQLLLPSTDSLTWPRLSAFWQNV

SEQ ID NO: 3489 - DNA, 2268 bp, Escherichia coli
atgatcaggccagtaacgttaacggaaccccatttcagccagcataccctgaacaagtatgcttcgctgatggcgcaggggaacggctatcttgggcttcgcgccagccatgaagaagattacacgcgccagacgcgcggcatgtatctggcagggctttatcatcgggcgggtaaaggtgaaatcaacgaactggtgaacctgcctgatgtcgtggggatggagattgccataaatggtgagattttctcgttatcccgcgaagcatggcagcgtgagcttaactttgctagtggcgaattacgtcgcaacgttgtctggcgtaccagcaacggcgcaggttacaccatcaccagccgtcgctttgtttcggcagaccaactgccgctcattgcgctggaaatcactattacgccactggacgccgacgcgttagtgctgatttcaacaggcattgacgccacgcaaaccaaccacggtcgccaacatctcgacgaaacccaggtgcgggtatttggtcagcatctgatgcaggggatctacaccacccaggatgggcgcagtgatgtggccatcagctgttgctgtaaggtgagcggtgatgtgcagcaatgctataccgccaaagagcgccgtttactgcaacatacctgcgcgcagcttcacgcaggtgagacgctgacgctgcaaaaacgggtgtggatcgactggcgggacgacagacaagccgctttagacgaatggggcagtgcgtcgcttcgtcagcttgaaatgtgcgcgcagcagagttacgaccaacttcttgcagcatcaacagaaaactggcgtcaatggtggcagaaacgtcgtatcacggtaaacggcggcgatgcgcacgatcagcaagcgttagattatgcgctttatcacctgcgcatcatgacgcctgcccacgatgagcgcagcagcattgcggcgaaaggtttaaccggcgaaggctacaaaggccacgttttctgggatacagaagtatttttgctaccgttccatctgtttagcgatccgacggttgcccgaagtttactgcgttatcgctggcacaacttgcctggcgcgcaggagaaagcgcgacgcaacggctggcagggcgctctgtttccgtgggaaagcgcgcgtagtggcgaagaagagacgccggaatttgccgccattaacattcgtaccgggttgcggcaaaaagtggcctctgcgcaggcggaacatcatctggtggccgatatcgcctgggcggttattcaatactggcggaccacgggggatgaaagtttcattgctcatgaaggcatggcgctacttctggagacggcaaagttctggattagccgcgcggtgagggttaacgaccgtctggaaattcatgatgttattgggccagatgaatataccgaacatgtcaataataacgccttcaccagctatatggcgtattacaacgtccagcaggcgctgaatatcgctcgtcagtttggctgtagcgacgacgcgtttattcatcgtgcagaaatgtacctcaaagaactgctgctgccagaaattcagcccgacggcgttttgccgcaggatgattcgtttatggctaagccggtgattaatctggcgaaatacaaagcggcggcggggaagcaaaccattctgctggattattcacgcgcagaagtgaacgagatgcagatcctcaaacaagctgatgtggtgatgctcaattacatgctgccggagcagttctcagcggcatcgtgtcttgccaatctgcaattttatgaaccgcgcactattcacgactcgtcattaagtaaagcaatccacggcattgttgccgcacgctgtggcctgctgacccaaagttatcagttctggcgcgaggggactgaaatcgatcttggtgctgatccacatagctgtgatgacggtatccacgctgccgcaactggcgctatctggctgggggcgattcagggttttgccggggtgagcgtgcgtgacggtgaattacatctcaatccggcgttacctgagcagtggcaacagttgtctttccctctgttctggcagggctgcgaattacaggtcactctcgacgcgcagcgtattgcgattcgaacttctgcgcccgtttcactgcgcttgaacggtcagcttatttacgtcgctgaagaatctgttttctgtttgggggattttattttgcccttcaatgggaccgctaccacgcatcaggagggtgaatga

SEQ ID NO: 3490 - protein, 755 aa, Escherichia coli
MIRPVTLTEPHFSQHTLNKYASLMAQGNGYLGLRASHEEDYTRQTRGMYLAGLYHRAGKGEINELVNLPDVVGMEIAINGEIFSLSREAWQRELNFASGELRRNVVWRTSNGAGYTITSRRFVSADQLPLIALEITITPLDADALVLISTGIDATQTNHGRQHLDETQVRVFGQHLMQGIYTTQDGRSDVAISCCCKVSGDVQQCYTAKERRLLQHTCAQLHAGETLTLQKRVWIDWRDDRQAALDEWGSASLRQLEMCAQQSYDQLLAASTENWRQWWQKRRITVNGGDAHDQQALDYALYHLRIMTPAHDERSSIAAKGLTGEGYKGHVFWDTEVFLLPFHLFSDPTVARSLLRYRWHNLPGAQEKARRNGWQGALFPWESARSGEEETPEFAAINIRTGLRQKVASAQAEHHLVADIAWAVIQYWRTTGDESFIAHEGMALLLETAKFWISRAVRVNDRLEIHDVIGPDEYTEHVNNNAFTSYMAYYNVQQALNIARQFGCSDDAFIHRAEMYLKELLLPEIQPDGVLPQDDSFMAKPVINLAKYKAAAGKQTILLDYSRAEVNEMQILKQADVVMLNYMLPEQFSAASCLANLQFYEPRTIHDSSLSKAIHGIVAARCGLLTQSYQFWREGTEIDLGADPHSCDDGIHAAATGAIWLGAIQGFAGVSVRDGELHLNPALPEQWQQLSFPLFWQGCELQVTLDAQRIAIRTSAPVSLRLNGQLIYVAEESVFCLGDFILPFNGTATTHQEGE

SEQ ID NO: 3491 - DNA, 1056 bp, Escherichia coli
gtgaaaagtgcaatgacaagctctccactgcgggtcgcgataatcggcgcaggccaggtggcggataaggttcatgcttcgtactactgcacccgcaatgatctggaactggtggctgtctgtgacagccgcctttcccaggcgcaggcgctggcagaaaaatacgggaatgcatccgtgtgggacgatccgcaggccatgctgctggcggtgaaacctgatgtggttagcgtctgctcacctaaccgttttcattacgaacataccctgatggcgctggaagcgggctgccatgtgatgtgcgaaaaaccgcccgccatgacggcagaacaggcgcgggaaatgtgcgataccgcgcgcaaacagggcaaggtgctggcctacgactttcaccatcgttttgcactcgatacgcaacagctgcgtgaacaggtgaccaacggcgttttgggagagatttacgttaccaccgcccgcgccctgcgtcgttgcggtgttcccggctggggtgtctttactaataaagaattgcagggcggaggcccgctgatcgacatcggcattcatatgctggatgcggcgatgtatgtgctgggttttccagcggtgaaaagcgtgactgcgcatagctttcaaaagatcggcacgcaaaagagctgcggtcaatttggcgagtgggacccggcaacctacagcgtcgaagattcgctgtttggcaccattgaatttcataacggcggcattctgtggcttgagacctcatttgcactcaacatccgcgaacagtcgattatgaacgtcagcttttgtggtgataaagccggggcgacgctgtttccggcacatatctacaccgataacaacggtgagttaatgacgctgatgcaacgggaaatggcagacgacaaccgtcatctgcgcagtatggaagcctttatcaaccacgtacaaggtaagcccgtgatgatagccgacgccgagcaggggtacatcatccagcaactggtggcggcgttgtatcaatccgcagaaacagggacgcgtgtggaattatga

SEQ ID NO: 3492 - protein, 351 aa, Escherichia coli
MKSAMTSSPLRVAIIGAGQVADKVHASYYCTRNDLELVAVCDSRLSQAQALAEKYGNASVWDDPQAMLLAVKPDVVSVCSPNRFHYEHTLMALEAGCHVMCEKPPAMTAEQAREMCDTARKQGKVLAYDFHHRFALDTQQLREQVTNGVLGEIYVTTARALRRCGVPGWGVFTNKELQGGGPLIDIGIHMLDAAMYVLGFPAVKSVTAHSFQKIGTQKSCGQFGEWDPATYSVEDSLFGTIEFHNGGILWLETSFALNIREQSIMNVSFCGDKAGATLFPAHIYTDNNGELMTLMQREMADDNRHLRSMEAFINHVQGKPVMIADAEQGYIIQQLVAALYQSAETGTRVEL

SEQ ID NO: 3493 - DNA, 789 bp, Escherichia coli
atgaaaatcggcacacagaatcaggcgttctttccggaaaacattctggagaaatttcgttatatcaaagagatgggtttcgatggttttgagattgacggcaaactgctggtcaacaatctcgaagaagtcaaagcagcaatcaaagaaaccggtttaccggtgaccaccgcctgcggtggctatgacggttggattggcgactttatcgaagagcgtcgacttaatggcttaaagcagatcgaacgcattcttgaagcgctggcagaagtgggcggtaaaggtatcgtcgttccggctgcgtggggcatgtttaccttccgcttaccgccgatgacctcgccgcgcagccttgacggcgatcgtaaaatggtgagtgattccctgcgcgtactggaacaggtcgccgcgcggactggaactgtggtgtatctcgaaccgttaaaccgctatcaggatcacatgatcaacaccctcgccgatgctcgtcgttacatcgtcgaaaacgatcttaaacatgtacagattatcggcgatttctatcacatgaatatcgaagaagataacctggcgcaggcgttgcacgacaaccgcgacttgctcggtcatgtgcatattgccgataaccatcgctaccagccgggcagcggcaccctcgatttccacgcgctgtttgaacagctgcgcgccgataactatcagggctatgtggtgtatgaagggcgtatccgggcagaaaatcctgcccaggcgtaccgtgattctttggcctggttgcgtacctgctaa

SEQ ID NO: 3494 - protein, 262 aa, Escherichia coli
MKIGTQNQAFFPENILEKFRYIKEMGFDGFEIDGKLLVNNLEEVKAAIKETGLPVTTACGGYDGWIGDFIEERRLNGLKQIERILEALAEVGGKGIVVPAAWGMFTFRLPPMTSPRSLDGDRKMVSDSLRVLEQVAARTGTVVYLEPLNRYQDHMINTLADARRYIVENDLKHVQIIGDFYHMNIEEDNLAQALHDNRDLLGHVHIADNHRYQPGSGTLDFHALFEQLRADNYQGYVVYEGRIRAENPAQAYRDSLAWLRTC

SEQ ID NO: 3495 - DNA, 1053 bp, Escherichia coli
atgaaaaagttagtagccacagcaccgcgtgttgctgcgctggttgagtatgaagagcgggcgattttagccaatgaagtgaagatccgcgtgcgtttcggcgcgccgaaacacgggacggaagtggttgatttccgcgccgccagcccgtttattaatgacgactttaatggcgaatggcagatgttcaccccgcgtccggcagatgcgccgcgcggcattgagtttggcaagttccagcttggcaacatggtggttggcgacattatcgagtgcggcagcgacgttaacgactacgcggtgggcgacagcgtatgcggctacggcccgctctccgagacggtcatcattaacgcagtgaataactacaagctgcgcaaaatgccgcaaggcagctcctggaaaaacgccgtctgctacgacccggcgcagtttgccatgagcggcgtgcgcgatgccaacgtacgcgtaggggattttgtggtggtggtagggcttggcgcgatcggtcaaattgccatccaactggcgaaacgcgctggcgcatcggtggtaattggcgtcgatcctatcgcccatcgctgtgatattgcccgtcgccacggtgcggatttctgtcttaaccccattggcgctgacgtaggtaaagagatcaaaacgctgaccggcaagcagggtgccgatgtgattatcgaaaccagtggctatgccgacgcgctgcaatcggcactccgcggtctggcctatggcggcaccatctcctatgtcgcgtttgccaaaccgtttgccgaaggttttaacctcggacgcgaagcccatttcaataacgccaaaattgttttctcccgtgcgtgcagcgagccgaacccggattatccgcgctggagccgtaagcgtattgaagaaacctgctgggaactgctgatgaacggttatctcaattgcgaagatttaatcgatccggtggtgacctttgccaacagcccggaaagctacatgcagtatgtcgaccagcatccggaacagagcatcaaaatgggcgtcacgttttaa

SEQ ID NO: 3496 - protein, 350 aa, Escherichia coli
MKKLVATAPRVAALVEYEERAILANEVKIRVRFGAPKHGTEVVDFRAASPFINDDFNGEWQMFTPRPADAPRGIEFGKFQLGNMVVGDIIECGSDVNDYAVGDSVCGYGPLSETVIINAVNNYKLRKMPQGSSWKNAVCYDPAQFAMSGVRDANVRVGDFVVVVGLGAIGQIAIQLAKRAGASVVIGVDPIAHRCDIARRHGADFCLNPIGADVGKEIKTLTGKQGADVIIETSGYADALQSALRGLAYGGTISYVAFAKPFAEGFNLGREAHFNNAKIVFSRACSEPNPDYPRWSRKRIEETCWELLMNGYLNCEDLIDPVVTFANSPESYMQYVDQHPEQSIKMGVTF

SEQ ID NO: 3497 - DNA, 843 bp, Escherichia coli
atggcaacaaataaacgcacactcagtcgaatcggtttttactgcgggctggcgctgtttctcatcatcacgctgtttccattttttgtgatgctgatgacctcgttcaagagcgcaaaagaggcgatctcgctgcatcctacgctgctgccacagcagtggacgctggagcattacgtcgacatttttaatccggtgattttcccgtttgtcgactacttccgtaacagcatggtggtgtcggtggtttcatccgtggtggcggtatttctcggcattctcggggcttacgcgctttcccgcctgcgctttaaagggcggatgaccatcaacgccagcttttacacggtgtacatgttctccggcattttgctggtggtgccgctgttcaaaatcatcaccgcacttggcatttacgacaccgagatggcgctgatcattaccatggtgacgcaaaccctgcccaccgccgtgtttatgctgaaaagctacttcgacaccatccctgatgagatcgaagaagcggcgatgatggatggcctcaatcgtctgcaaattatcttccgtatcaccgtgcccctggcgatgtccgggctgatatcggtgtttgtctactgctttatggtggcgtggaacgactatctgtttgcgtcgattttcctctccagcgccagcaatttcaccttaccagtgggcctgaacgcgctgttcagtacgcctgattacatctggggacggatgatggcggcctcgctggtgaccgcattgccagtggtgattatgtatgcgctttcggaacattttattaagagtggtttgaccgccggtggcgtgaagggctaa

SEQ ID NO: 3498 - protein, 280 aa, Escherichia coli
MATNKRTLSRIGFYCGLALFLIITLFPFFVMLMTSFKSAKEAISLHPTLLPQQWTLEHYVDIFNPVIFPFVDYFRNSMVVSVVSSVVAVFLGILGAYALSRLRFKGRMTINASFYTVYMFSGILLVVPLFKIITALGIYDTEMALIITMVTQTLPTAVFMLKSYFDTIPDEIEEAAMMDGLNRLQIIFRITVPLAMSGLISVFVYCFMVAWNDYLFASIFLSSASNFTLPVGLNALFSTPDYIWGRMMAASLVTALPVVIMYALSEHFIKSGLTAGGVKG

SEQ ID NO: 3499 - DNA, 882 bp, Escherichia coli
atgaacaggcttttttcaggtcgttccgatatgccttttgcactgctgcttctcgcgcccagcttattactgctgggcggtctggtggcgtggccgatggtgtcgaatatcgaaatcagttttttacgtctgccgctcaatcccaacatcgaggcaacatttgttggggtgagcaactatgtgcgtattctctccgatccgggcttctggcattcgctgtggatgacggtctggtataccgcgcttgtggtggcgggcagcaccgtgctcgggctggccgtggcgatgtttttcaaccgcgagttccgcctgcgcaaaaccgcgcgttcgctggtgatcctttcctacgtaacgccgtctatttcgctggtgttcgcctggaaatacatgttcaacaacggttacggcattgtgaactacctcggcgtcgatcttctgcatctctatgagcaggcaccgctgtggttcgataacccgggcagtagttttgtgctggtggtgctgttcgctatctggcgctacttcccgtatgcctttatctcgtttctggcgattttgcagaccatcgacaaatcgctgtacgaagcggcagagatggatggcgcgaatgcctggcagcggtttcgcatcgtcacgctgcccgcgattatgccggtcctggcgacggtggtgaccctgcgcactatctggatgttctacatgttcgcggatgtttatctgctgacgaccaaggtcgatattctcggtgtctatctctacaaaaccgcctttgcctttaatgacttagggaaagcggcggcgatctcggtggtgcttttcatcattattttcgctgtcattctgctgaccaggaaacgggtgaacctcaatggcaacaaataa

SEQ ID NO: 3500 - protein, 293 aa, Escherichia coli
MNRLFSGRSDMPFALLLLAPSLLLLGGLVAWPMVSNIEISFLRLPLNPNIEATFVGVSNYVRILSDPGFWHSLWMTVWYTALVVAGSTVLGLAVAMFFNREFRLRKTARSLVILSYVTPSISLVFAWKYMFNNGYGIVNYLGVDLLHLYEQAPLWFDNPGSSFVLVVLFAIWRYFPYAFISFLAILQTIDKSLYEAAEMDGANAWQRFRIVTLPAIMPVLATVVTLRTIWMFYMFADVYLLTTKVDILGVYLYKTAFAFNDLGKAAAISVVLFIIIFAVILLTRKRVNLNGNK

SEQ ID NO: 3501 - DNA, 1275 bp, Escherichia coli
gtgctgttatcagcactggtttcctgcaccctgatttcaggctgtaaagaagaaaataaaaataatgtatccatcgaatttatgcattcttcggtggagcaggagcgccaggccgtcatcagcaaattgattgcccgttttgaaaaagaaaacccaggtatcaccgtaaaacaagtgcccgtggaagaagacgcctataacaccaaagtcattaccctttcacgtagcggttcgctgccggaagtgatcgaaaccagccatgactacgccaaagtgatggacaaagagcagcttatcgatcgccaggcggttgccacggtcatcagcaacgtcggtgaaggcgcgttctacgatggcgtactgcggattgtgcgcaccgaagatggcagcgcctggaccggtgttcctgtcagcgcatggattggcgggatctggtatcgcaaagatgtgctggcaaaagctgggctggaggagccaaaaaactggcagcaattgctggacgttgcacagaaactgaatgacccggcgaataaaaaatacggtattgcgctgcctacagcagaaagcgtgttgacggaacagtctttctcccagtttgcgttatccaatcaggctaacgtctttaacgccgaaggcaaaatcacccttgatacaccagagatgatgcaggcgctgacctattaccgcaaccttgctgccaacaccatgccaggttctaacgacatcatggaagtgaaagacgcttttatgaacggcaccgcgccgatggcgatttactccacctatatccttccggctgtgattaaagaaggcgatccgaaaaacgtcggtttcgtggtgccaaccgagaaaaattctgcggtctacggcatgttgacctcgctgaccattaccgccgggcaaaaggccgaagagacggaagcagcagaaaaatttgtcacctttatggagcaggcggacaacattgccgactgggtgatgatgtcgccaggcgcggcgctgccggtgaacaaagcggtggtgactaccgccacctggaaagacaacgacgttattaaggcgctgggagaattgccgaatcagctaatcagcgaactgccaaatattcaggtctttggcgcagtaggggataaaaactttacccgcatgggcgatgtgacggggtctggcgtggtgagttcaatggtgcataacgtcaccgtggggaaagccgatctccctggcacgctgcaagcgagccagaaaaagctggatgaactgatcgaacagcactaa

SEQ ID NO: 3502 - protein, 424 aa, Escherichia coli
MLLSALVSCTLISGCKEENKNNVSIEFMHSSVEQERQAVISKLIARFEKENPGITVKQVPVEEDAYNTKVITLSRSGSLPEVIETSHDYAKVMDKEQLIDRQAVATVISNVGEGAFYDGVLRIVRTEDGSAWTGVPVSAWIGGIWYRKDVLAKAGLEEPKNWQQLLDVAQKLNDPANKKYGIALPTAESVLTEQSFSQFALSNQANVFNAEGKITLDTPEMMQALTYYRNLAANTMPGSNDIMEVKDAFMNGTAPMAIYSTYILPAVIKEGDPKNVGFVVPTEKNSAVYGMLTSLTITAGQKAEETEAAEKFVTFMEQADNIADWVMMSPGAALPVNKAVVTTATWKDNDVIKALGELPNQLISELPNIQVFGAVGDKNFTRMGDVTGSGVVSSMVHNVTVGKADLPGTLQASQKKLDELIEQH

SEQ ID NO: 3503 - DNA, 1707 bp, Escherichia coli
atgggaccgctaccacggaaaggcaacatgaaacagaaaattacggattacctggacgaaatctacggtggaacatttaccgcgactcatttacagaaacttgtaacgcgtcttgagagtgcgaaacgattaattacacagcgacgtaaaaaacactgggatgaaagtgatgtcgtgttaattacctatgccgatcaatttcacagtaatgatttaaagccactacccacatttaatcagttttaccctcaatggctgcaaagaattttttcacatgttcatttattacctttttatccatggtcatctgatgatggattttcggtaattgattatcatcaggtcgccagtgaagcgggggagtggcaggatattcagcaactcggtgaatgcagccatttaatgtttgattttgtctgcaaccatatgtcggcaaaaagtgaatggtttaaaaactatttacaacagcagccaggttttgaagatttttttattgccgttgatccgaaaaccgatctcagcgccgtcactcgcccgcgtgcgttaccgttattaacgccattccagatgcgcgatcattcaatgcgccatttatggaccacctttagcgacgatcaaattgacctcaattaccgtagccctgaagtgttgctggcgatggtggatgtattgctgtgctacctggaaaagggcgcagagtatgtccgtctggatgccgttggctttatgtggaaagagccgggaacaaactgcatccatctggaaaaaacacatctgattatcaaactgttacggtcgattattgataacgtcgcgccaggcacagtgatcattaccgagaccaatgttccgcataaagacaacattgcttactttggcgaaggcgatgacgaagcgcatatggtgtaccagttctcgctgccgccgctggtgctgcatgcggtgcaaaaacagaacgttgaggcactttgtgcgtgggcgcaaaacctgacactaccttccagcaacaccacctggtttaacttccttgcctctcacgatggcatcgggcttaacccactgcgggggttgttgcccgaaaacgaaatattagcgctggtcgaggtgttacagcaggaaggagcattagtaaactggaaaaataatcccgacggtacgcgtagcccctatgaaatgaatgtcacctatatggatgcgttgagccgccgtgagtgtagcgacgaagaacggtgtgccaggtttattctcgcccatgcgattttgttaagtttccccggtgtgccagcgatatatattcaaagcattctggggtcgcgtaatgattacgcaggtgtcgaaaaacttggatataatcgtgcgattaaccgtaaaaaatactctagtaaagagataacgacagaactgaacaataaagcgacattaagttattcggtatattataagttgtcgcatttaattacacttcgtcgcagtcataaagagtttcatccggataataatttcaccattgatgcgattaattcatttgtaatgcgaattcaaagaagcaatgcggatggcgattgcctgacgggattgtttaatgtcagtgaaaatattcagcatataaatattactgacctgcacggtcgggatctgattagtgaagttgatatattgggtaatgaaataacactgcatccctggcaggttatgtggattaaataa

SEQ ID NO: 3504 - protein, 568 aa, Escherichia coli
MGPLPRKGNMKQKITDYLDEIYGGTFTATHLQKLVTRLESAKRLITQRRKKHWDESDVVLITYADQFHSNDLKPLPTFNQFYPQWLQRIFSHVHLLPFYPWSSDDGFSVIDYHQVASEAGEWQDIQQLGECSHLMFDFVCNHMSAKSEWFKNYLQQQPGFEDFFIAVDPKTDLSAVTRPRALPLLTPFQMRDHSMRHLWTTFSDDQIDLNYRSPEVLLAMVDVLLCYLEKGAEYVRLDAVGFMWKEPGTNCIHLEKTHLIIKLLRSIIDNVAPGTVIITETNVPHKDNIAYFGEGDDEAHMVYQFSLPPLVLHAVQKQNVEALCAWAQNLTLPSSNTTWFNFLASHDGIGLNPLRGLLPENEILALVEVLQQEGALVNWKNNPDGTRSPYEMNVTYMDALSRRECSDEERCARFILAHAILLSFPGVPAIYIQSILGSRNDYAGVEKLGYNRAINRKKYSSKEITTELNNKATLSYSVYYKLSHLITLRRSHKEFHPDNNFTIDAINSFVMRIQRSNADGDCLTGLFNVSENIQHINITDLHGRDLISEVDILGNEITLHPWQVMWIK

SEQ ID NO: 3505 - DNA, 315 bp, Escherichia coli
atgtttaaaaaaggcttacttgctctgacactggtgttttcactgcccgttttcgccgctgaacactggatcgatgttcgtgttccagagcagtatcagcaagaacacgttcagggggccatcaatattcccttgaaggaagtgaaagagcgcattgccaccgccgttccggataaaaacgacaccgtgaaagtgtattgcaatgctggacgccagtcagggcaggcaaaagagatccttagcgagatgggatatacccacgttgagaacgccggtggcctgaaagacatcgcaatgccgaaggtcaaaggttaa

SEQ ID NO: 3506 - protein, 104 aa, Escherichia coli
MFKKGLLALTLVFSLPVFAAEHWIDVRVPEQYQQEHVQGAINIPLKEVKERIATAVPDKNDTVKVYCNAGRQSGQAKEILSEMGYTHVENAGGLKDIAMPKVKG

SEQ ID NO: 3507 - DNA, 234 bp, Escherichia coli
gtgaggaaagttatgaatactcgctggcaacaggccgggcaaaaggtgaagcctgggttcaaattagcaggcaagctggtacttctaaccgcactgcgctatggcccggcgggtgtggcgggctgggcgataaaatcagttgctcgccgaccgctgaaaatgttgctggctgtggcgctggaaccgctgttaagtcgggctgccaataaactggcgcagcgttataaaaggtga

SEQ ID NO: 3508 - protein, 77 aa, Escherichia coli
MRKVMNTRWQQAGQKVKPGFKLAGKLVLLTALRYGPAGVAGWAIKSVARRPLKMLLAVALEPLLSRAANKLAQRYKR

SEQ ID NO: 3509 - DNA, 360 bp, Escherichia coli
atggcgggcattaatctcaataaaaaattatggcgtattccgcagcagggcatggtccgtggcgtctgcgccgggattgccaactattttgatgtaccagtaaaactggtgcgtatcctggtggtgctgtcgattttcttcggtctggcgctgtttaccctggttgcttacatcattttgtcatttgcgcttgatccaatgccggacaacatggtctttggtgagcagctaccttccagcagcgaattgctggatgaagtcgaccgtgaactggcggcaagtgaaacgcgtttacgcgagatggaacgttatgtcacttccgacactttcacgctgcgtagccgtttccgtcaactgtga

SEQ ID NO: 3510 - protein, 119 aa, Escherichia coli
MAGINLNKKLWRIPQQGMVRGVCAGIANYFDVPVKLVRILVVLSIFFGLALFTLVAYIILSFALDPMPDNMVFGEQLPSSSELLDEVDRELAASETRLREMERYVTSDTFTLRSRFRQL

SEQ ID NO: 3511 - DNA, 225 bp, Escherichia coli
atgagcgcgctatttctggctattccgttaaccatttttgtgctgtttgttttaccgatctggttatggctgcattacagcaatcgttctggtcgcagtgaattgtcgcaaagtgagcagcagcgattagcgcaactggctgatgaagcaaaacggatgcgcgaacgtattcaggcgctggaatccattcttgatgcagaacatccgaactggagggatcgctaa

SEQ ID NO: 3512 - protein, 74 aa, Escherichia coli
MSALFLAIPLTIFVLFVLPIWLWLHYSNRSGRSELSQSEQQRLAQLADEAKRMRERIQALESILDAEHPNWRDR

SEQ ID NO: 3513 - DNA, 669 bp, Escherichia coli
atgggtattttttctcgctttgccgacatcgtgaatgccaacatcaacgctctgttagagaaagcggaagatccacagaaactggtgcgtctgatgatccaggagatggaagatacattggttgaagtacgttctacttcggcgcgtgcgctggcagaaaagaaacagctgactcgtcgtattgaacaagcgtcggcgcgtgaaattgaatggcaggaaaaagcggaactggcactgctgaaagatagagaagatctggcgcgtgcggcgttaattgaaaaacagaaactgaccgatctgattaagagcctggaacatgaagtgacgctggtggacgatacgctagtgcgtatgaagaaagagatcggcgagctggaaaacaaattgagcgaaacacgcgctcgccagcaggcattgatgttacgccatcaggcggcaaactcgtcgcgcgatgtgcgtcgtcagctggacagtggcaaactggatgaagcaatggctcgtttcgaatctttcgaacgccgtatcgaccagatggaagcggaagcagaaagccacagcttcggtaaacaaaaatcgctggacgatcagtttgccgaactgaaagccgatgatgcaatcagcgagcaactggcacaattaaaagccaaaatgaagcaagacaatcaataa

SEQ ID NO: 3514 - protein, 222 aa, Escherichia coli
MGIFSRFADIVNANINALLEKAEDPQKLVRLMIQEMEDTLVEVRSTSARALAEKKQLTRRIEQASAREIEWQEKAELALLKDREDLARAALIEKQKLTDLIKSLEHEVTLVDDTLVRMKKEIGELENKLSETRARQQALMLRHQAANSSRDVRRQLDSGKLDEAMARFESFERRIDQMEAEAESHSFGKQKSLDDQFAELKADDAISEQLAQLKAKMKQDNQ

SEQ ID NO: 3515 - DNA, 993 bp, Escherichia coli
gtggcgaatttcatcatggcagaatacaaagataatttactcggtgaggcgaacagctttctcgaagtgctggaacaggtttcgcatctcgcaccgctggacaaaccggtgctcatcatcggcgagcgcggcaccggtaaagagctgatcgccagccgcctgcattatctctcctcccgttggcaagggccgtttatttcccttaactgcgcggcgttaaatgaaaatctgttggattccgaactgtttggtcacgaagcgggggcgtttaccggtgcgcaaaaacgtcatccagggagatttgaacgtgccgacggcggtacgctatttcttgatgaactcgctacggcaccgatgatggtgcaggaaaaattattgcgtgtgattgagtacggtgaactggagcgcgtcggcggcagccagccattgcaggtgaatgtgcggttggtatgcgcgacgaatgccgatctcccggcgatggtcaatgaaggtacttttcgcgcagacctgctcgaccgactagcgttcgatgttgtgcaactgccaccactgcgcgagcgtgaaagcgacattatgttgatggcagaacactttgccatccagatgtgtcgggaaatcaagctgcctctgttcccgggttttacagagcacgccagagaaacattgctgaattatcgctggccgggaaatatacgtgaattgaaaaacgtggtggaacgttcagtgtatcgtcacggcaccagcgattatccgcttgatgacatcattattgatccctttaaacgccgtccatctgaagaagccatcgccgtttcagaaaacacctcgcttccgacgctgccactggatttacgcgagtttcagatgcagcaggaaaaagagttgctgcaactcagtttgcaacaggggaaatataaccagaagcgcgccgctgaattgctggggttaacctatcatcagttccgcgcgttgttgaaaaagcaccagatttag

SEQ ID NO: 3516 - protein, 330 aa, Escherichia coli
MANFIMAEYKDNLLGEANSFLEVLEQVSHLAPLDKPVLIIGERGTGKELIASRLHYLSSRWQGPFISLNCAALNENLLDSELFGHEAGAFTGAQKRHPGRFERADGGTLFLDELATAPMMVQEKLLRVIEYGELERVGGSQPLQVNVRLVCATNADLPAMVNEGTFRADLLDRLAFDVVQLPPLRERESDIMLMAEHFAIQMCREIKLPLFPGFTEHARETLLNYRWPGNIRELKNVVERSVYRHGTSDYPLDDIIIDPFKRRPSEEAIAVSENTSLPTLPLDLREFQMQQEKELLQLSLQQGKYNQKRAAELLGLTYHQFRALLKKHQI

SEQ ID NO: 3517 - DNA, 105 bp, Escherichia coli
atggtatgggcttcgttaggtggcgcatatttgtggtatttgatccgccgctatcgcaaagtgccgttgtatgatggcgacagaacgccggtgagcgaaacgtaa

SEQ ID NO: 3518 - protein, 34 aa, Escherichia coli
MVWASLGGAYLWYLIRRYRKVPLYDGDRTPVSET

SEQ ID NO: 3519 - DNA, 246 bp, Escherichia coli
atgaaccacgatatcccgctaaaatattttgatattgccgatgagtacgcgaccgaatgcgcagagcctgtcgcagacgctgaacgcacaccgctggcccactacttccagttactgctcacccgtttgatgaataatgaagagatcagtgaagaagcccaacatgaaatggctgctgaagcggggattaatcccgtacgcattgatgagatcgcagagtttttgaatcaatggggtaatgagtaa

SEQ ID NO: 3520 - protein, 81 aa, Escherichia coli
MNHDIPLKYFDIADEYATECAEPVADAERTPLAHYFQLLLTRLMNNEEISEEAQHEMAAEAGINPVRIDEIAEFLNQWGNE

SEQ ID NO: 3521 - DNA, 1644 bp, Escherichia coli
atgcgccaggtattatcgtctcttttggtgattgctggacttgtgagtggtcaggcaatcgccgcgcctgaatcccccccgcatgctgatatccgtgacagcggttttgtctattgcgtcagcgggcaagtcaacacctttaacccatccaaagcgagcagtgggttaattgtcgatacccttgccgcccagttttatgatcgactgctggatgtcgatccctatacctatcgcctgatgccggaacttgccgaaagctgggaagtgctcgacaacggcgcgacctatcgcttccacctgcgtcgcgatgttccgtttcaaaaaaccgactggtttactcccactcgtaaaatgaatgccgatgatgtggtgtttaccttccaacggatttttgaccgcaacaacccgtggcataacgtcaacggcagtaacttcccctatttcgacagtctgcaatttgccgataacgtgaaaagcgtccgcaagctggataatcataccgttgagttccgtctcgcccagccggatgcttcttttttgtggcacctggcgacccattatgcttcggtcatgtcggcagaatatgcagggaagttagagaaagaagatcgccaggagcaactcgaccgtcaaccggtcggcaccggtccgtatcagttgtcggaataccgcgccgggcaatatattcgcttacaacgtcatgatgatttctggcgtggtaatccgttgatgccacaagtggtggtggatttaggctctggcggtacaggacgattgtcgaaactcctgaccggggagtgcgacgttctggcctggcctgctgccagtcagctatccattttgcgtgacgacccacgcttgcgtttaacgctgcgtcctgggatgaatgtcgcctatctggcattcaacaccgccaaaccgccgctaaataatccggcggtccgccatgcgctggcactggcgattaataaccagcgcctgatgcaatccatctattatggtacggctgaaacggcggcctctattttaccgcgagcctcgtgggcctatgacaacgaggctaaaattactgaatacaatccggcaaaatcgcgcgaacagttgaaggcgttggggctggaaaacttaacgctgaaactgtgggtgcccacacgttcgcaggcgtggaaccccagtccactgaaaaccgccgaactgattcaggcggatatggcacaggttggcgtaaaagtggtgattgtgccggtagaaggtcgttttcaggaggcgcggttgatggatatgagccatgatctgacgttatccggttgggcgacggacagtaacgacccggacagtttcttccgtccgttactgagctgcgcagcaattcattcgcagaccaacctcgcccactggtgcgatccgaaattcgacagcgtgttgcgtaaggcgctctcttcgcagcagctggcggcgcgtattgaagcctatgacgaagcgcaaagtattctggcgcaggaattacctattctgccgctggcgtcgtcattgcgtttgcaggcctatcggtacgatatcaaaggtctggtacttagcccgtttggtaacgcctcctttgctggggtgtatcgcgagaaacaggatgaggtgaaaaagccatga

SEQ ID NO: 3522 - protein, 547 aa, Escherichia coli
MRQVLSSLLVIAGLVSGQAIAAPESPPHADIRDSGFVYCVSGQVNTFNPSKASSGLIVDTLAAQFYDRLLDVDPYTYRLMPELAESWEVLDNGATYRFHLRRDVPFQKTDWFTPTRKMNADDVVFTFQRIFDRNNPWHNVNGSNFPYFDSLQFADNVKSVRKLDNHTVEFRLAQPDASFLWHLATHYASVMSAEYAGKLEKEDRQEQLDRQPVGTGPYQLSEYRAGQYIRLQRHDDFWRGNPLMPQVVVDLGSGGTGRLSKLLTGECDVLAWPAASQLSILRDDPRLRLTLRPGMNVAYLAFNTAKPPLNNPAVRHALALAINNQRLMQSIYYGTAETAASILPRASWAYDNEAKITEYNPAKSREQLKALGLENLTLKLWVPTRSQAWNPSPLKTAELIQADMAQVGVKVVIVPVEGRFQEARLMDMSHDLTLSGWATDSNDPDSFFRPLLSCAAIHSQTNLAHWCDPKFDSVLRKALSSQQLAARIEAYDEAQSILAQELPILPLASSLRLQAYRYDIKGLVLSPFGNASFAGVYREKQDEVKKP

SEQ ID NO: 3523 - DNA, 966 bp, Escherichia coli
atgattatcttcaccttacgccgtattttgttattgattgtgaccttgttcctgctgaccttcgttggcttcagcttgagctatttcaccccacatgcgccgttacaaggcgcgtcactgtggaatgcctgggtgttctggtttaacggcctgatccactgggattttggtgtttccagcattaacggtcaaccgattgccgaacagttaaaagaggtcttcccggcgacgatggaactgtgcatcctcgccttcggttttgcgctgattgttggcatccccgtaggaatgattgccgggattacgcgccataagtggcaggataacttgatcaacgccatcgccttactgggcttttcaatcccggtgttctggctggcgcttctgctgacgctgttttgttcactcacgctaggttggttgcccgtttctgggcgtttcgatttgctctacgaagtgaaaccgattaccggttttgcgttgattgatgcctggctttcgaactcaccgtggcgggatgaaatggtcatgagcgcaatccgccatatgatattgcccgtgatcaccctgtcggttgcgccaacaactgaagtgatccgactgatgcgtatcagcactatcgaagtgtatgaccagaactatgttaaagcagcggcaacccgcggtttgtcgcgctttactattttgcgtcgccacgttctgcataacgcgttacctccggttattcctcgcctgggcttacagttttccaccatgctgacgctggcgatgatcaccgaaatggtttttagctggccgggtttagggcgctggttaattaacgccatccgccagcaggattacgcagccatttccgccggagtgatggtgtgtggctcactggtcattattgttaacgtgatttctgatattttgggtgccatggctaaccctctgaaacataaggaatggtatgccttacgatag

SEQ ID NO: 3524 - protein, 321 aa, Escherichia coli
MIIFTLRRILLLIVTLFLLTFVGFSLSYFTPHAPLQGASLWNAWVFWFNGLIHWDFGVSSINGQPIAEQLKEVFPATMELCILAFGFALIVGIPVGMIAGITRHKWQDNLINAIALLGFSIPVFWLALLLTLFCSLTLGWLPVSGRFDLLYEVKPITGFALIDAWLSNSPWRDEMVMSAIRHMILPVITLSVAPTTEVIRLMRISTIEVYDQNYVKAAATRGLSRFTILRRHVLHNALPPVIPRLGLQFSTMLTLAMITEMVFSWPGLGRWLINAIRQQDYAAISAGVMVCGSLVIIVNVISDILGAMANPLKHKEWYALR

SEQ ID NO: 3525 - DNA, 891 bp, Escherichia coli
atgccttacgatagcgtatacagcgaaaagcgcccgccgggcacgctgcgtaccgcctggcgcaaattttatagtgacgcctctgcgatggtcggcctgtacggctgcgcggggctggctgtactgtgtatttttggcggctggtttgcgccttacggcatcgaccagcaatttctcggttatcaattattgccgccgtcatggtcgcgctatggcgaagtttctttcttcctggggactgacgacctcggacgcgatgttttaagccgtttactgagcggagctgcgccaaccgtaggtggcgcatttgtggtgacgcttgccgcgacgatctgtggcctggtactgggcaccttcgccggggcgacccacggcctacgctcagcggtgcttaaccatattctggataccttactggcgatcccttcgctgctgctggcaattatcgttgtagcgtttgccggaccgagtttgtctcacgccatgtttgctgtctggctggcgctgctgccgcgtatggtacgttcgatttacagcatggtgcatgacgaactggaaaaagagtacgttatcgccgcccgtctggatggcgcatcaacgctgaatattctctggtttgctgtgatgcccaacatcaccgccggactggtcaccgagatcactcgcgcattgtcgatggcaattctcgatatcgccgcgctgggctttcttgacctcggcgcacaactgccctcgcctgaatggggcgcgatgctcggtgatgcgctggaactgatttatgtcgccccatggactgtcatgctgccaggtgcggcaattatgattagcgtgctgttggttaacctccttggcgacggtgtccgtcgtgcaattattgcgggggtggaataa

SEQ ID NO: 3526 - protein, 296 aa, Escherichia coli
MPYDSVYSEKRPPGTLRTAWRKFYSDASAMVGLYGCAGLAVLCIFGGWFAPYGIDQQFLGYQLLPPSWSRYGEVSFFLGTDDLGRDVLSRLLSGAAPTVGGAFVVTLAATICGLVLGTFAGATHGLRSAVLNHILDTLLAIPSLLLAIIVVAFAGPSLSHAMFAVWLALLPRMVRSIYSMVHDELEKEYVIAARLDGASTLNILWFAVMPNITAGLVTEITRALSMAILDIAALGFLDLGAQLPSPEWGAMLGDALELIYVAPWTVMLPGAAIMISVLLVNLLGDGVRRAIIAGVE

SEQ ID NO: 3527 - DNA, 993 bp, Escherichia coli
atgccattactcgatattcgtaacctgaccattgaatttaaaaccggtgatgagtgggttaaagccgtcgaccgcgtaagtatgaccttaaccgaaggtgaaatccgcggtcttgttggcgaatccggttccggcaaaagtttgattgctaaagcgatttgtggggtgaataaagataactggcgtgttactgctgaccgtatgcgttttgatgatatcgatttgctgcgtctctccgcacgcgaacggcgcaagctggttggtcacaacgtgtcgatgattttccaggaaccacagtcgtgtcttgacccttcagaacgtgtgggtcgccagttgatgcaaaacatccctgcctggacctataaaggccgttggtggcagcgttttggctggcgcaaacgccgtgccattgaactgctgcaccgcgtggggattaaagatcacaaagatgcgatgcgcagttttccctatgagttgaccgaaggtgaatgtcagaaagtgatgatagccattgcactggcgaatcaaccgcgtctgctaattgctgacgaaccgaccaactcaatggagccaacaacccaggcgcaaatctttcgcctgctgacgcgtctcaaccaaaacagtaataccactattttgcttatcagccatgacttacaaatgcttagccaatgggcggataaaattaacgtgctttactgcggtcaaacggtggaaaccgcgccgagtaaggagttggtgacgatgccacaccatccttatacccaggcgctgatccgcgcgataccagacttcggcagcgcgatgccgcataaaagtcgcctcaatacgctgcccggcgctatcccgctgctggaacagttaccgattggttgtcgtctggggccacgttgcccgtatgcacaacgagaatgcattgtgacgccacgtttgacgggggcgaaaaatcatctctatgcctgtcatttcccactgaacatggagaaagagtga

SEQ ID NO: 3528 - protein, 330 aa, Escherichia coli
MPLLDIRNLTIEFKTGDEWVKAVDRVSMTLTEGEIRGLVGESGSGKSLIAKAICGVNKDNWRVTADRMRFDDIDLLRLSARERRKLVGHNVSMIFQEPQSCLDPSERVGRQLMQNIPAWTYKGRWWQRFGWRKRRAIELLHRVGIKDHKDAMRSFPYELTEGECQKVMIAIALANQPRLLIADEPTNSMEPTTQAQIFRLLTRLNQNSNTTILLISHDLQMLSQWADKINVLYCGQTVETAPSKELVTMPHHPYTQALIRAIPDFGSAMPHKSRLNTLPGAIPLLEQLPIGCRLGPRCPYAQRECIVTPRLTGAKNHLYACHFPLNMEKE

SEQ ID NO: 3529 - DNA, 807 bp, Escherichia coli
atgatcgaaacgctacttgaagtgcgcaatttaagtaaaacgttccgctaccggaccggctggtttcgtcgtcagaccgtagaagcggtaaaacccttgagctttacgctacgtgaaggccagacactggcgattatcggcgagaatggttcgggtaaatccacgctggcaaaaatgctggcgggaatgatagaacctaccagcggcgagttattgattgacgatcatccgctgcattttggcgattattccttccgcagtcagcgtattcgcatgatttttcaggatccttcgacctcgttgaatccccgtcaacgtatctcgcaaattctggattttccactgcgcctgaacaccgacctggaaccggaacagcgtcgcaaacagattattgaaacgatgcgtatggttgggctgctaccggatcacgtcagttactatccgcatatgttagcacccgggcaaaaacagcgtctgggtctggcgcgcgcgctgatattgcgcccaaaagtcattattgccgatgaagccctcgcctcactggatatgtcgatgcgttcgcagttgattaatctgatgctggagttacaggaaaaacagggcatttcgtatatttatgttacccagcatatcggaatgatgaagcacattagcgaccaggtgctggtgatgcatcagggcgaggttgtcgagcgaggcagcaccgcagatgtgctggcatcgccgctgcatgaactcaccaaacggctgatcgccggtcattttggcgaggcattgacggcggatgcgtggcgtaaggaccgttag

SEQ ID NO: 3530 - protein, 268 aa, Escherichia coli
MIETLLEVRNLSKTFRYRTGWFRRQTVEAVKPLSFTLREGQTLAIIGENGSGKSTLAKMLAGMIEPTSGELLIDDHPLHFGDYSFRSQRIRMIFQDPSTSLNPRQRISQILDFPLRLNTDLEPEQRRKQIIETMRMVGLLPDHVSYYPHMLAPGQKQRLGLARALILRPKVIIADEALASLDMSMRSQLINLMLELQEKQGISYIYVTQHIGMMKHISDQVLVMHQGEVVERGSTADVLASPLHELTKRLIAGHFGEALTADAWRKDR

SEQ ID NO: 3531 - DNA, 1164 bp, Escherichia coli
atggctagagtctctctttcatgggcattgattcttggtcttttagccggtatcggcccgatgtgtaccgatctttatttgccggctttgccggagatgtctgagcaactggcggcaaccacgaccataacgcaattaaccctgaccgcatcactgattggtcttggcgtcggacaactgttatttggccctctgagcgacaaaatagggcgtaaacgtccgttaatcttgtcgttgttattgtttattgtttcttccattttgtgcgcgacaacgaacaatatttactggctggtggtctggcgttttattcaagggatcgcgggggcgggtggttcggtgctctctcgttctattgctcgtgacaaatatcagggagtaacgttgacccagttttttgcgctgttaatgacggtgaatggcctggcaccggtgttgtcgccagtgctgggcgggtacattgttagcacttttgactggcgcactttattctgggtaatggctgaaattagcaccgtactgttgctgggctgcctgttatttattaatgagaccttgccagaaaataaaaggggctcatcattgctattaaccggacgaagcgtggtgcagaaccgccgttttatgcgcttttgcctgattcaaagttttatgctggctggtttgtttgcatatatcggctcttcgtcgttcgtgttgcagaaggaatttggctttagtccaatgcaatttagcctggtgtttggccttaacggcatcggacttatcattgcttcatggatcttctcgcgcctggcgcgacggattaacgcgatgacattgttgcgaggtggtctgatagcggcaattttgtgtgcattgctcacggtcttatgcgcatgggtacaattgcccattccggcactggtggcattatttttcaccatcgcattttgtagcggcatcggcactgttggcggggcagaggctatgagtgcagtagggacgcaggaatctggaacggcgtctgcgttgatggggatgagcatgtttgtcttcggcggtatagccgcgccattgtcgggaattggcggagaaacactgttaaaaatgagtctggcaattacggtgtgttatacgctggcattgctggttgctctcaccagaatcgacaaccaaaagtaa

SEQ ID NO: 3532 - protein, 387 aa, Escherichia coli
MARVSLSWALILGLLAGIGPMCTDLYLPALPEMSEQLAATTTITQLTLTASLIGLGVGQLLFGPLSDKIGRKRPLILSLLLFIVSSILCATTNNIYWLVVWRFIQGIAGAGGSVLSRSIARDKYQGVTLTQFFALLMTVNGLAPVLSPVLGGYIVSTFDWRTLFWVMAEISTVLLLGCLLFINETLPENKRGSSLLLTGRSVVQNRRFMRFCLIQSFMLAGLFAYIGSSSFVLQKEFGFSPMQFSLVFGLNGIGLIIASWIFSRLARRINAMTLLRGGLIAAILCALLTVLCAWVQLPIPALVALFFTIAFCSGIGTVGGAEAMSAVGTQESGTASALMGMSMFVFGGIAAPLSGIGGETLLKMSLAITVCYTLALLVALTRIDNQK

SEQ ID NO: 3533 - DNA, 1374 bp, Escherichia coli
atgttgcgtcgttctcttatttttctggtgttgttgagtgcgggatgtgtctcgctcgatcctcactacagtacgcctgaatccccaatcccggcgaccttgccgggagcacagggccaggggaaggcaatcagccatgactggcagcaggtgattcacgatccccgattgcagcaggtagtaaccattgcactgaacagtaaccgcgatgtgcaaaaagcgattgctgatattgactcagcacgggcgctctatgggcaaactaatgcgtcgttatttccgacggtgaatgcggccttaagttcgactcgcagtcgttcgctggcgaatggtacgggaacaactgccgaggctgacggcacggtgtccagttatacgttagatctgtttggtcgtaatcagagtttatctcgggcggcgcgggaaacctggcttgccagtgaatttacagcccagaacactcgtttaacgctgattgctgaaatcagcaccgcctggctgacactggcggccgataacagcaacctggccctggcaaaagaaacgatggccagtgcagaaaactcattgaaaattatccagcgccagcaacaggttggcacggcggcagcgacagatgtcagtgaggcgatgagtgtttatcagcaagcgcgcgccagcgttgccagctatcagacacaagtgatgcaggataaaaatgcgctgaacttactggcaggtacaacgcttgcggaaaatctgctaccgggaacactggaaagcctgccggaacaaatgataagtctggttcctgcgggagtatcatctgatgttctgctgcgtcgcccggatatccaggaagctgaacataatttgaagagcgccaatgcagatattggcgcggcgcgggctaactttttcccgacgatttcgctgactgccagtgccggtgttggcagtgacgcattgtcgtcgttgttcagccacggaatgcagatctggtcatttgcgccatcggtcacattaccgctgttcactggcggaagtaatctggcgcagcttcgttacgcagaagcacaaaagcgtgggctcattgccacctatgaaaaaaccgttcagagcgcatttaaagatgtcgctaacgcactggcgcggcggaccacgcttgaagagcaactggatgcacagcgccagtatgttaaagctgagcaacaaacggtcgatgttggcttgcgtcgctatcaggcgggtgttggtgattacctgaccgtgttgacggcgcagcgcagcttgtggagtgcacagcaggagctgctggcactgcaactgactgattttacaaaccgaatcacgctctggcagtcgctgggcggcggcatgtcatcactcaagtaa

SEQ ID NO: 3534 - protein, 457 aa, Escherichia coli
MLRRSLIFLVLLSAGCVSLDPHYSTPESPIPATLPGAQGQGKAISHDWQQVIHDPRLQQVVTIALNSNRDVQKAIADIDSARALYGQTNASLFPTVNAALSSTRSRSLANGTGTTAEADGTVSSYTLDLFGRNQSLSRAARETWLASEFTAQNTRLTLIAEISTAWLTLAADNSNLALAKETMASAENSLKIIQRQQQVGTAAATDVSEAMSVYQQARASVASYQTQVMQDKNALNLLAGTTLAENLLPGTLESLPEQMISLVPAGVSSDVLLRRPDIQEAEHNLKSANADIGAARANFFPTISLTASAGVGSDALSSLFSHGMQIWSFAPSVTLPLFTGGSNLAQLRYAEAQKRGLIATYEKTVQSAFKDVANALARRTTLEEQLDAQRQYVKAEQQTVDVGLRRYQAGVGDYLTVLTAQRSLWSAQQELLALQLTDFTNRITLWQSLGGGMSSLK

(The sequence listing continues in the following parts.)

What is claimed:

1. A substantially purified polypeptide comprising an amino acid sequence selected from the group consisting of (a) the sequence which has at least 95% sequence identity to SEQ ID NO: 7052; and (b) a fragment of SEQ ID NO: 7052, wherein the fragment (i) includes at least 100 consecutive amino acids from SEQ ID NO: 7052; or (ii) consists of 40 or more consecutive amino acids from SEQ ID NO: 7052.

2. The polypeptide of claim 1, wherein said at least 100 consecutive amino acids or said 40 or more consecutive amino acids comprise at least one B-cell epitope of (a).

3. The substantially purified polypeptide of claim 1, wherein the at least 100 consecutive amino acids or said 40 or more consecutive amino acids consist of (a) said polypeptide without its N-terminal signal polypeptide, or (b) said polypeptide without 1-10 of its N-terminal amino acid residue(s).

4. The substantially purified polypeptide of claim 1 comprising an amino acid sequence which has at least 98% sequence identity to SEQ ID NO 7052.

5. The substantially purified polypeptide of claim 1 comprising an amino acid sequence which has at least 99% sequence identity to SEQ ID NO 7052.

6. The substantially purified polypeptide of claim 1, wherein the fragment includes at least 120 consecutive amino acids from SEQ ID NO 7052.

7. The substantially purified polypeptide of claim 1, wherein the fragment includes at least 140 consecutive amino acids from SEQ ID NO 7052.

8. The substantially purified polypeptide of claim 1, wherein the fragment includes at least 180 consecutive amino acids from SEQ ID NO 7052.

9. The substantially purified polypeptide of claim 1, wherein the fragment consists of 60 or more consecutive amino acids from SEQ ID NO 7052.

10. The substantially purified polypeptide of claim 1, wherein the fragment consists of 80 or more consecutive amino acids from SEQ ID NO 7052.

11. The substantially purified polypeptide of claim 1, wherein the fragment consists of 100 or more consecutive amino acids from SEQ ID NO 7052.

12. An immunogenic composition comprising the polypeptide of claim 1 in admixture with a pharmaceutically acceptable carrier.

13. An immunogenic composition comprising two or more polypeptides of claim 1 in admixture with a pharmaceutically acceptable carrier.

14. The immunogenic composition of claim 13 or claim 12, further comprising a vaccine adjuvant.

15. The immunogenic composition of claim 12, further comprising an adjuvant.

16. The immunogenic composition of claim 15, wherein the adjuvant is an aluminum salt.

* * * * *